United States Patent 11,312,770 (BISPECIFIC AND MONOSPECIFIC ANTIBODIES USING NOVEL ANTI-PD-1 SEQUENCES) - sequence listing, part 3

SEQ ID NO: 26885 - protein, 118 aa, Artificial Sequence; identical to SEQ ID NO: 17236
  Description of Artificial Sequence: Synthetic polypeptide
  VH of XENP021403

SEQ ID NO: 26886 - protein, 5 aa, Artificial Sequence
  Description of Artificial Sequence: Synthetic peptide
  XENP021403 vhCDR1
DYYMH

SEQ ID NO: 26887 - protein, 17 aa, Artificial Sequence
  Description of Artificial Sequence: Synthetic peptide
  XENP021403 vhCDR2
WIDPENGDTEYAPKFQG

SEQ ID NO: 26888 - protein, 9 aa, Artificial Sequence
  Description of Artificial Sequence: Synthetic peptide
  XENP021403 vhCDR3
RGVRQALDY

SEQ ID NO: 26889 - protein, 214 aa, Artificial Sequence
  Description of Artificial Sequence: Synthetic polypeptide
  XENP021403 2A11_H1_L2.52_Fab Light Chain
DIQMTQSPAFLSVTPGEKVTITCQASQDIGNYLNWFQQKPDQTVKLLIYYTSRYHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26890 - protein, 107 aa, Artificial Sequence
  Description of Artificial Sequence: Synthetic polypeptide
  VL of XENP021403
DIQMTQSPAFLSVTPGEKVTITCQASQDIGNYLNWFQQKPDQTVKLLIYYTSRYHSGVPSRFSGSGSGTDYTFTISSLEAEDAATYFCQQGNTLPYTFGGGTKVEIK

SEQ ID NO: 26891 - protein, 11 aa, Artificial Sequence
  Description of Artificial Sequence: Synthetic peptide
  XENP021403 vlCDR1
QASQDIGNYLN

SEQ ID NO: 26892 - protein, 7 aa, Artificial Sequence
  Description of Artificial Sequence: Synthetic peptide
  XENP021403 vlCDR2
YTSRYHS

SEQ ID NO: 26893 - protein, 9 aa, Artificial Sequence
  Description of Artificial Sequence: Synthetic peptide
  XENP021403 vlCDR3
QQGNTLPYT

SEQ ID NO: 26894 - protein, 223 aa, Artificial Sequence; identical to SEQ ID NO: 25194
  Description of Artificial Sequence: Synthetic polypeptide
  XENP021404 2A11_H1_L2.53_Fab Heavy Chain

SEQ ID NO: 26895 - protein, 118 aa, Artificial Sequence; identical to SEQ ID NO: 17236
  Description of Artificial Sequence: Synthetic polypeptide
  VH of XENP021404

SEQ ID NO: 26896 - protein, 5 aa, Artificial Sequence
  Description of Artificial Sequence: Synthetic peptide
  XENP021404 vhCDR1
DYYMH

SEQ ID NO: 26897 - protein, 17 aa, Artificial Sequence
  Description of Artificial Sequence: Synthetic peptide
  XENP021404 vhCDR2
WIDPENGDTEYAPKFQG

SEQ ID NO: 26898 - protein, 9 aa, Artificial Sequence
  Description of Artificial Sequence: Synthetic peptide
  XENP021404 vhCDR3
RGVRQALDY

SEQ ID NO: 26899 - protein, 214 aa, Artificial Sequence
  Description of Artificial Sequence: Synthetic polypeptide
  XENP021404 2A11_H1_L2.53_Fab Light Chain
DIQMTQSPAFLSVTPGEKVTITCQASQDIGNYLNWFQQKPDQTVKLLIYYTSRRHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26900 - protein, 107 aa, Artificial Sequence
  Description of Artificial Sequence: Synthetic polypeptide
  VL of XENP021404
DIQMTQSPAFLSVTPGEKVTITCQASQDIGNYLNWFQQKPDQTVKLLIYYTSRRHSGVPSRFSGSGSGTDYTFTISSLEAEDAATYFCQQGNTLPYTFGGGTKVEIK

SEQ ID NO: 26901 - protein, 11 aa, Artificial Sequence
  Description of Artificial Sequence: Synthetic peptide
  XENP021404 vlCDR1
QASQDIGNYLN

SEQ ID NO: 26902 - protein, 7 aa, Artificial Sequence
  Description of Artificial Sequence: Synthetic peptide
  XENP021404 vlCDR2
YTSRRHS

SEQ ID NO: 26903 - protein, 9 aa, Artificial Sequence
  Description of Artificial Sequence: Synthetic peptide
  XENP021404 vlCDR3
QQGNTLPYT

SEQ ID NO: 26904 - protein, 223 aa, Artificial Sequence; identical to SEQ ID NO: 25194
  Description of Artificial Sequence: Synthetic polypeptide
  XENP021405 2A11_H1_L2.54_Fab Heavy Chain

SEQ ID NO: 26905 - protein, 118 aa, Artificial Sequence; identical to SEQ ID NO: 17236
  Description of Artificial Sequence: Synthetic polypeptide
  VH of XENP021405

SEQ ID NO: 26906 - protein, 5 aa, Artificial Sequence
  Description of Artificial Sequence: Synthetic peptide
  XENP021405 vhCDR1
DYYMH

SEQ ID NO: 26907 - protein, 17 aa, Artificial Sequence
  Description of Artificial Sequence: Synthetic peptide
  XENP021405 vhCDR2
WIDPENGDTEYAPKFQG

SEQ ID NO: 26908 - protein, 9 aa, Artificial Sequence
  Description of Artificial Sequence: Synthetic peptide
  XENP021405 vhCDR3
RGVRQALDY

SEQ ID NO: 26909 - protein, 214 aa, Artificial Sequence
  Description of Artificial Sequence: Synthetic polypeptide
  XENP021405 2A11_H1_L2.54_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQANTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26910 - protein, 107 aa, Artificial Sequence
  Description of Artificial Sequence: Synthetic polypeptide
  VL of XENP021405
DIQMTQSPAFLSVTPGEKVTITCQASQDIGNYLNWFQQKPDQTVKLLIYYTSRLHSGVPSRFSGSGSGTDYTFTISSLEAEDAATYFCQQANTLPYTFGGGTKVEIK

SEQ ID NO: 26911 - protein, 11 aa, Artificial Sequence
  Description of Artificial Sequence: Synthetic peptide
  XENP021405 vlCDR1
QASQDIGNYLN

SEQ ID NO: 26912 - protein, 7 aa, Artificial Sequence
  Description of Artificial Sequence: Synthetic peptide
  XENP021405 vlCDR2
YTSRLHS

SEQ ID NO: 26913 - protein, 9 aa, Artificial Sequence
  Description of Artificial Sequence: Synthetic peptide
  XENP021405 vlCDR3
QQANTLPYT

SEQ ID NO: 26914 - protein, 223 aa, Artificial Sequence; identical to SEQ ID NO: 25194
  Description of Artificial Sequence: Synthetic polypeptide
  XENP021406 2A11_H1_L2.55_Fab Heavy Chain

SEQ ID NO: 26915 - protein, 118 aa, Artificial Sequence; identical to SEQ ID NO: 17236
  Description of Artificial Sequence: Synthetic polypeptide
  VH of XENP021406

SEQ ID NO: 26916 - protein, 5 aa, Artificial Sequence
  Description of Artificial Sequence: Synthetic peptide
  XENP021406 vhCDR1
DYYMH

SEQ ID NO: 26917 - protein, 17 aa, Artificial Sequence
  Description of Artificial Sequence: Synthetic peptide
  XENP021406 vhCDR2
WIDPENGDTEYAPKFQG

SEQ ID NO: 26918 - protein, 9 aa, Artificial Sequence
  Description of Artificial Sequence: Synthetic peptide
  XENP021406 vhCDR3
RGVRQALDY

SEQ ID NO: 26919 - protein, 214 aa, Artificial Sequence
  Description of Artificial Sequence: Synthetic polypeptide
  XENP021406 2A11_H1_L2.55_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQSNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26920 - protein, 107 aa, Artificial Sequence
  Description of Artificial Sequence: Synthetic polypeptide
  VL of XENP021406
DIQMTQSPAFLSVTPGEKVTITCQASQDIGNYLNWFQQKPDQTVKLLIYYTSRLHSGVPSRFSGSGSGTDYTFTISSLEAEDAATYFCQQSNTLPYTFGGGTKVEIK

SEQ ID NO: 26921 - protein, 11 aa, Artificial Sequence
  Description of Artificial Sequence: Synthetic peptide
  XENP021406 vlCDR1
QASQDIGNYLN

SEQ ID NO: 26922 - protein, 7 aa, Artificial Sequence
  Description of Artificial Sequence: Synthetic peptide
  XENP021406 vlCDR2
YTSRLHS

SEQ ID NO: 26923 - protein, 9 aa, Artificial Sequence
  Description of Artificial Sequence: Synthetic peptide
  XENP021406 vlCDR3
QQSNTLPYT

SEQ ID NO: 26924 - protein, 223 aa, Artificial Sequence; identical to SEQ ID NO: 25194
  Description of Artificial Sequence: Synthetic polypeptide
  XENP021407 2A11_H1_L2.56_Fab Heavy Chain

SEQ ID NO: 26925 - protein, 118 aa, Artificial Sequence; identical to SEQ ID NO: 17236
  Description of Artificial Sequence: Synthetic polypeptide
  VH of XENP021407

SEQ ID NO: 26926 - protein, 5 aa, Artificial Sequence
  Description of Artificial Sequence: Synthetic peptide
  XENP021407 vhCDR1
DYYMH

SEQ ID NO: 26927 - protein, 17 aa, Artificial Sequence
  Description of Artificial Sequence: Synthetic peptide
  XENP021407 vhCDR2
WIDPENGDTEYAPKFQG

SEQ ID NO: 26928 - protein, 9 aa, Artificial Sequence
  Description of Artificial Sequence: Synthetic peptide
  XENP021407 vhCDR3
RGVRQALDY

SEQ ID NO: 26929 - protein, 214 aa, Artificial Sequence
  Description of Artificial Sequence: Synthetic polypeptide
  XENP021407 2A11_H1_L2.56_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQTNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26930 - protein, 107 aa, Artificial Sequence
  Description of Artificial Sequence: Synthetic polypeptide
  VL of XENP021407
DIQMTQSPAFLSVTPGEKVTITCQASQDIGNYLNWFQQKPDQTVKLLIYYTSRLHSGVPSRFSGSGSGTDYTFTISSLEAEDAATYFCQQTNTLPYTFGGGTKVEIK

SEQ ID NO: 26931 - protein, 11 aa, Artificial Sequence
  Description of Artificial Sequence: Synthetic peptide
  XENP021407 vlCDR1
QASQDIGNYLN

SEQ ID NO: 26932 - protein, 7 aa, Artificial Sequence
  Description of Artificial Sequence: Synthetic peptide
  XENP021407 vlCDR2
YTSRLHS

SEQ ID NO: 26933 - protein, 9 aa, Artificial Sequence
  Description of Artificial Sequence: Synthetic peptide
  XENP021407 vlCDR3
QQTNTLPYT

SEQ ID NO: 26934 - protein, 223 aa, Artificial Sequence; identical to SEQ ID NO: 25194
  Description of Artificial Sequence: Synthetic polypeptide
  XENP021408 2A11_H1_L2.57_Fab Heavy Chain

SEQ ID NO: 26935 - protein, 118 aa, Artificial Sequence; identical to SEQ ID NO: 17236
  Description of Artificial Sequence: Synthetic polypeptide
  VH of XENP021408

SEQ ID NO: 26936 - protein, 5 aa, Artificial Sequence
  Description of Artificial Sequence: Synthetic peptide
  XENP021408 vhCDR1
DYYMH

SEQ ID NO: 26937 - protein, 17 aa, Artificial Sequence
  Description of Artificial Sequence: Synthetic peptide
  XENP021408 vhCDR2
WIDPENGDTEYAPKFQG

SEQ ID NO: 26938 - protein, 9 aa, Artificial Sequence
  Description of Artificial Sequence: Synthetic peptide
  XENP021408 vhCDR3
RGVRQALDY

SEQ ID NO: 26939 - protein, 214 aa, Artificial Sequence
  Description of Artificial Sequence: Synthetic polypeptide
  XENP021408 2A11_H1_L2.57_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGQTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26940 - protein, 107 aa, Artificial Sequence
  Description of Artificial Sequence: Synthetic polypeptide
  VL of XENP021408
DIQMTQSPAFLSVTPGEKVTITCQASQDIGNYLNWFQQKPDQTVKLLIYYTSRLHSGVPSRFSGSGSGTDYTFTISSLEAEDAATYFCQQGQTLPYTFGGGTKVEIK

SEQ ID NO: 26941 - protein, 11 aa, Artificial Sequence
  Description of Artificial Sequence: Synthetic peptide
  XENP021408 vlCDR1
QASQDIGNYLN

SEQ ID NO: 26942 - protein, 7 aa, Artificial Sequence
  Description of Artificial Sequence: Synthetic peptide
  XENP021408 vlCDR2
YTSRLHS

SEQ ID NO: 26943 - protein, 9 aa, Artificial Sequence
  Description of Artificial Sequence: Synthetic peptide
  XENP021408 vlCDR3
QQGQTLPYT

SEQ ID NO: 26944 - protein, 223 aa, Artificial Sequence; identical to SEQ ID NO: 25194
  Description of Artificial Sequence: Synthetic polypeptide
  XENP021409 2A11_H1_L2.58_Fab Heavy Chain

SEQ ID NO: 26945 - protein, 118 aa, Artificial Sequence; identical to SEQ ID NO: 17236
  Description of Artificial Sequence: Synthetic polypeptide
  VH of XENP021409

SEQ ID NO: 26946 - protein, 5 aa, Artificial Sequence
  Description of Artificial Sequence: Synthetic peptide
  XENP021409 vhCDR1
DYYMH

SEQ ID NO: 26947 - protein, 17 aa, Artificial Sequence
  Description of Artificial Sequence: Synthetic peptide
  XENP021409 vhCDR2
WIDPENGDTEYAPKFQG

SEQ ID NO: 26948 - protein, 9 aa, Artificial Sequence
  Description of Artificial Sequence: Synthetic peptide
  XENP021409 vhCDR3
RGVRQALDY

SEQ ID NO: 26949 - protein, 214 aa, Artificial Sequence
  Description of Artificial Sequence: Synthetic polypeptide
  XENP021409 2A11_H1_L2.58_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGHTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26950 - protein, 107 aa, Artificial Sequence
  Description of Artificial Sequence: Synthetic polypeptide
  VL of XENP021409
DIQMTQSPAFLSVTPGEKVTITCQASQDIGNYLNWFQQKPDQTVKLLIYYTSRLHSGVPSRFSGSGSGTDYTFTISSLEAEDAATYFCQQGHTLPYTFGGGTKVEIK

SEQ ID NO: 26951 - protein, 11 aa, Artificial Sequence
  Description of Artificial Sequence: Synthetic peptide
  XENP021409 vlCDR1
QASQDIGNYLN

SEQ ID NO: 26952 - protein, 7 aa, Artificial Sequence
  Description of Artificial Sequence: Synthetic peptide
  XENP021409 vlCDR2
YTSRLHS

SEQ ID NO: 26953 - protein, 9 aa, Artificial Sequence
  Description of Artificial Sequence: Synthetic peptide
  XENP021409 vlCDR3
QQGHTLPYT

SEQ ID NO: 26954 - protein, 223 aa, Artificial Sequence; identical to SEQ ID NO: 25194
  Description of Artificial Sequence: Synthetic polypeptide
  XENP021410 2A11_H1_L2.59_Fab Heavy Chain

SEQ ID NO: 26955 - protein, 118 aa, Artificial Sequence; identical to SEQ ID NO: 17236
  Description of Artificial Sequence: Synthetic polypeptide
  VH of XENP021410

SEQ ID NO: 26956 - protein, 5 aa, Artificial Sequence
  Description of Artificial Sequence: Synthetic peptide
  XENP021410 vhCDR1
DYYMH

SEQ ID NO: 26957 - protein, 17 aa, Artificial Sequence
  Description of Artificial Sequence: Synthetic peptide
  XENP021410 vhCDR2
WIDPENGDTEYAPKFQG

SEQ ID NO: 26958 - protein, 9 aa, Artificial Sequence
  Description of Artificial Sequence: Synthetic peptide
  XENP021410 vhCDR3
RGVRQALDY

SEQ ID NO: 26959 - protein, 214 aa, Artificial Sequence
  Description of Artificial Sequence: Synthetic polypeptide
  XENP021410 2A11_H1_L2.59_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGETLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26960 - protein, 107 aa, Artificial Sequence
  Description of Artificial Sequence: Synthetic polypeptide
  VL of XENP021410
DIQMTQSPAFLSVTPGEKVTITCQASQDIGNYLNWFQQKPDQTVKLLIYYTSRLHSGVPSRFSGSGSGTDYTFTISSLEAEDAATYFCQQGETLPYTFGGGTKVEIK

SEQ ID NO: 26961 - protein, 11 aa, Artificial Sequence
  Description of Artificial Sequence: Synthetic peptide
  XENP021410 vlCDR1
QASQDIGNYLN

SEQ ID NO: 26962 - protein, 7 aa, Artificial Sequence
  Description of Artificial Sequence: Synthetic peptide
  XENP021410 vlCDR2
YTSRLHS

SEQ ID NO: 26963 - protein, 9 aa, Artificial Sequence
  Description of Artificial Sequence: Synthetic peptide
  XENP021410 vlCDR3
QQGETLPYT

SEQ ID NO: 26964 - protein, 223 aa, Artificial Sequence; identical to SEQ ID NO: 25194
  Description of Artificial Sequence: Synthetic polypeptide
  XENP021411 2A11_H1_L2.60_Fab Heavy Chain

SEQ ID NO: 26965 - protein, 118 aa, Artificial Sequence; identical to SEQ ID NO: 17236
  Description of Artificial Sequence: Synthetic polypeptide
  VH of XENP021411

SEQ ID NO: 26966 - protein, 5 aa, Artificial Sequence
  Description of Artificial Sequence: Synthetic peptide
  XENP021411 vhCDR1
DYYMH

SEQ ID NO: 26967 - protein, 17 aa, Artificial Sequence
  Description of Artificial Sequence: Synthetic peptide
  XENP021411 vhCDR2
WIDPENGDTEYAPKFQG

SEQ ID NO: 26968 - protein, 9 aa, Artificial Sequence
  Description of Artificial Sequence: Synthetic peptide
  XENP021411 vhCDR3
RGVRQALDY

SEQ ID NO: 26969 - protein, 214 aa, Artificial Sequence
  Description of Artificial Sequence: Synthetic polypeptide
  XENP021411 2A11_H1_L2.60_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGSTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26970 - protein, 107 aa, Artificial Sequence
  Description of Artificial Sequence: Synthetic polypeptide
  VL of XENP021411
DIQMTQSPAFLSVTPGEKVTITCQASQDIGNYLNWFQQKPDQTVKLLIYYTSRLHSGVPSRFSGSGSGTDYTFTISSLEAEDAATYFCQQGSTLPYTFGGGTKVEIK

SEQ ID NO: 26971 - protein, 11 aa, Artificial Sequence
  Description of Artificial Sequence: Synthetic peptide
  XENP021411 vlCDR1
QASQDIGNYLN

SEQ ID NO: 26972 - protein, 7 aa, Artificial Sequence
  Description of Artificial Sequence: Synthetic peptide
  XENP021411 vlCDR2
YTSRLHS

SEQ ID NO: 26973 - protein, 9 aa, Artificial Sequence
  Description of Artificial Sequence: Synthetic peptide
  XENP021411 vlCDR3
QQGSTLPYT

SEQ ID NO: 26974 - protein, 223 aa, Artificial Sequence; identical to SEQ ID NO: 25194
  Description of Artificial Sequence: Synthetic polypeptide
  XENP021412 2A11_H1_L2.61_Fab Heavy Chain

SEQ ID NO: 26975 - protein, 118 aa, Artificial Sequence; identical to SEQ ID NO: 17236
  Description of Artificial Sequence: Synthetic polypeptide
  VH of XENP021412

SEQ ID NO: 26976 - protein, 5 aa, Artificial Sequence
  Description of Artificial Sequence: Synthetic peptide
  XENP021412 vhCDR1
DYYMH

SEQ ID NO: 26977 - protein, 17 aa, Artificial Sequence
  Description of Artificial Sequence: Synthetic peptide
  XENP021412 vhCDR2
WIDPENGDTEYAPKFQG

SEQ ID NO: 26978 - protein, 9 aa, Artificial Sequence
  Description of Artificial Sequence: Synthetic peptide
  XENP021412 vhCDR3
RGVRQALDY

SEQ ID NO: 26979 - protein, 214 aa, Artificial Sequence
  Description of Artificial Sequence: Synthetic polypeptide
  XENP021412 2A11_H1_L2.61_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGRTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26980 - protein, 107 aa, Artificial Sequence
  Description of Artificial Sequence: Synthetic polypeptide
  VL of XENP021412
DIQMTQSPAFLSVTPGEKVTITCQASQDIGNYLNWFQQKPDQTVKLLIYYTSRLHSGVPSRFSGSGSGTDYTFTISSLEAEDAATYFCQQGRTLPYTFGGGTKVEIK

SEQ ID NO: 26981 - protein, 11 aa, Artificial Sequence
  Description of Artificial Sequence: Synthetic peptide
  XENP021412 vlCDR1
QASQDIGNYLN

SEQ ID NO: 26982 - protein, 7 aa, Artificial Sequence
  Description of Artificial Sequence: Synthetic peptide
  XENP021412 vlCDR2
YTSRLHS

SEQ ID NO: 26983 - protein, 9 aa, Artificial Sequence
  Description of Artificial Sequence: Synthetic peptide
  XENP021412 vlCDR3
QQGRTLPYT

SEQ ID NO: 26984 - protein, 223 aa, Artificial Sequence; identical to SEQ ID NO: 25194
  Description of Artificial Sequence: Synthetic polypeptide
  XENP021413 2A11_H1_L2.62_Fab Heavy Chain

SEQ ID NO: 26985 - protein, 118 aa, Artificial Sequence; identical to SEQ ID NO: 17236
  Description of Artificial Sequence: Synthetic polypeptide
  VH of XENP021413

SEQ ID NO: 26986 - protein, 5 aa, Artificial Sequence
  Description of Artificial Sequence: Synthetic peptide
  XENP021413 vhCDR1
DYYMH

SEQ ID NO: 26987 - protein, 17 aa, Artificial Sequence
  Description of Artificial Sequence: Synthetic peptide
  XENP021413 vhCDR2
WIDPENGDTEYAPKFQG

SEQ ID NO: 26988 - protein, 9 aa, Artificial Sequence
  Description of Artificial Sequence: Synthetic peptide
  XENP021413 vhCDR3
RGVRQALDY

SEQ ID NO: 26989 - protein, 214 aa, Artificial Sequence
  Description of Artificial Sequence: Synthetic polypeptide
  XENP021413 2A11_H1_L2.62_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGLTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26990 - protein, 107 aa, Artificial Sequence
  Description of Artificial Sequence: Synthetic polypeptide
  VL of XENP021413
DIQMTQSPAFLSVTPGEKVTITCQASQDIGNYLNWFQQKPDQTVKLLIYYTSRLHSGVPSRFSGSGSGTDYTFTISSLEAEDAATYFCQQGLTLPYTFGGGTKVEIK

SEQ ID NO: 26991 - protein, 11 aa, Artificial Sequence
  Description of Artificial Sequence: Synthetic peptide
  XENP021413 vlCDR1
QASQDIGNYLN

SEQ ID NO: 26992 - protein, 7 aa, Artificial Sequence
  Description of Artificial Sequence: Synthetic peptide
  XENP021413 vlCDR2
YTSRLHS

SEQ ID NO: 26993 - protein, 9 aa, Artificial Sequence
  Description of Artificial Sequence: Synthetic peptide
  XENP021413 vlCDR3
QQGLTLPYT

SEQ ID NO: 26994 - protein, 223 aa, Artificial Sequence; identical to SEQ ID NO: 25194
  Description of Artificial Sequence: Synthetic polypeptide
  XENP021414 2A11_H1_L2.63_Fab Heavy Chain

SEQ ID NO: 26995 - protein, 118 aa, Artificial Sequence; identical to SEQ ID NO: 17236
  Description of Artificial Sequence: Synthetic polypeptide
  VH of XENP021414

SEQ ID NO: 26996 - protein, 5 aa, Artificial Sequence
  Description of Artificial Sequence: Synthetic peptide
  XENP021414 vhCDR1
DYYMH

SEQ ID NO: 26997 - protein, 17 aa, Artificial Sequence
  Description of Artificial Sequence: Synthetic peptide
  XENP021414 vhCDR2
WIDPENGDTEYAPKFQG

SEQ ID NO: 26998 - protein, 9 aa, Artificial Sequence
  Description of Artificial Sequence: Synthetic peptide
  XENP021414 vhCDR3
RGVRQALDY

SEQ ID NO: 26999 - protein, 214 aa, Artificial Sequence
  Description of Artificial Sequence: Synthetic polypeptide
  XENP021414 2A11_H1_L2.63_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGTTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27000 - protein, 107 aa, Artificial Sequence
  Description of Artificial Sequence: Synthetic polypeptide
  VL of XENP021414
DIQMTQSPAFLSVTPGEKVTITCQASQDIGNYLNWFQQKPDQTVKLLIYYTSRLHSGVPSRFSGSGSGTDYTFTISSLEAEDAATYFCQQGTTLPYTFGGGTKVEIK

SEQ ID NO: 27001 - protein, 11 aa, Artificial Sequence
  Description of Artificial Sequence: Synthetic peptide
  XENP021414 vlCDR1
QASQDIGNYLN

SEQ ID NO: 27002 - protein, 7 aa, Artificial Sequence
  Description of Artificial Sequence: Synthetic peptide
  XENP021414 vlCDR2
YTSRLHS

SEQ ID NO: 27003 - protein, 9 aa, Artificial Sequence
  Description of Artificial Sequence: Synthetic peptide
  XENP021414 vlCDR3
QQGTTLPYT

SEQ ID NO: 27004 - protein, 223 aa, Artificial Sequence; identical to SEQ ID NO: 25194
  Description of Artificial Sequence: Synthetic polypeptide
  XENP021415 2A11_H1_L2.64_Fab Heavy Chain

SEQ ID NO: 27005 - protein, 118 aa, Artificial Sequence; identical to SEQ ID NO: 17236
  Description of Artificial Sequence: Synthetic polypeptide
  VH of XENP021415

SEQ ID NO: 27006 - protein, 5 aa, Artificial Sequence
  Description of Artificial Sequence: Synthetic peptide
  XENP021415 vhCDR1
DYYMH

SEQ ID NO: 27007 - protein, 17 aa, Artificial Sequence
  Description of Artificial Sequence: Synthetic peptide
  XENP021415 vhCDR2
WIDPENGDTEYAPKFQG

SEQ ID NO: 27008 - protein, 9 aa, Artificial Sequence
  Description of Artificial Sequence: Synthetic peptide
  XENP021415 vhCDR3
RGVRQALDY

SEQ ID NO: 27009 - protein, 214 aa, Artificial Sequence
  Description of Artificial Sequence: Synthetic polypeptide
  XENP021415 2A11_H1_L2.64_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGGTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27010 - protein, 107 aa, Artificial Sequence
  Description of Artificial Sequence: Synthetic polypeptide
  VL of XENP021415
DIQMTQSPAFLSVTPGEKVTITCQASQDIGNYLNWFQQKPDQTVKLLIYYTSRLHSGVPSRFSGSGSGTDYTFTISSLEAEDAATYFCQQGGTLPYTFGGGTKVEIK

SEQ ID NO: 27011 - protein, 11 aa, Artificial Sequence
  Description of Artificial Sequence: Synthetic peptide
  XENP021415 vlCDR1
QASQDIGNYLN

SEQ ID NO: 27012 - protein, 7 aa, Artificial Sequence
  Description of Artificial Sequence: Synthetic peptide
  XENP021415 vlCDR2
YTSRLHS

SEQ ID NO: 27013 - protein, 9 aa, Artificial Sequence
  Description of Artificial Sequence: Synthetic peptide
  XENP021415 vlCDR3
QQGGTLPYT

SEQ ID NO: 27014 - protein, 223 aa, Artificial Sequence; identical to SEQ ID NO: 25194
  Description of Artificial Sequence: Synthetic polypeptide
  XENP021416 2A11_H1_L2.65_Fab Heavy Chain

SEQ ID NO: 27015 - protein, 118 aa, Artificial Sequence; identical to SEQ ID NO: 17236
  Description of Artificial Sequence: Synthetic polypeptide
  VH of XENP021416

SEQ ID NO: 27016 - protein, 5 aa, Artificial Sequence
  Description of Artificial Sequence: Synthetic peptide
  XENP021416 vhCDR1
DYYMH

SEQ ID NO: 27017 - protein, 17 aa, Artificial Sequence
  Description of Artificial Sequence: Synthetic peptide
  XENP021416 vhCDR2
WIDPENGDTEYAPKFQG

SEQ ID NO: 27018 - protein, 9 aa, Artificial Sequence
  Description of Artificial Sequence: Synthetic peptide
  XENP021416 vhCDR3
RGVRQALDY

SEQ ID NO: 27019 - protein, 214 aa, Artificial Sequence
  Description of Artificial Sequence: Synthetic polypeptide
  XENP021416 2A11_H1_L2.65_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGYTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27020 - protein, 107 aa, Artificial Sequence
  Description of Artificial Sequence: Synthetic polypeptide
  VL of XENP021416
DIQMTQSPAFLSVTPGEKVTITCQASQDIGNYLNWFQQKPDQTVKLLIYYTSRLHSGVPSRFSGSGSGTDYTFTISSLEAEDAATYFCQQGYTLPYTFGGGTKVEIK

SEQ ID NO: 27021 - protein, 11 aa, Artificial Sequence
  Description of Artificial Sequence: Synthetic peptide
  XENP021416 vlCDR1
QASQDIGNYLN

SEQ ID NO: 27022 - protein, 7 aa, Artificial Sequence
  Description of Artificial Sequence: Synthetic peptide
  XENP021416 vlCDR2
YTSRLHS

SEQ ID NO: 27023 - protein, 9 aa, Artificial Sequence
  Description of Artificial Sequence: Synthetic peptide
  XENP021416 vlCDR3
QQGYTLPYT

SEQ ID NO: 27024 - protein, 223 aa, Artificial Sequence; identical to SEQ ID NO: 25194
  Description of Artificial Sequence: Synthetic polypeptide
  XENP021417 2A11_H1_L2.66_Fab Heavy Chain

SEQ ID NO: 27025 - protein, 118 aa, Artificial Sequence; identical to SEQ ID NO: 17236
  Description of Artificial Sequence: Synthetic polypeptide
  VH of XENP021417

SEQ ID NO: 27026 - protein, 5 aa, Artificial Sequence
  Description of Artificial Sequence: Synthetic peptide
  XENP021417 vhCDR1
DYYMH

SEQ ID NO: 27027 - protein, 17 aa, Artificial Sequence
  Description of Artificial Sequence: Synthetic peptide
  XENP021417 vhCDR2
WIDPENGDTEYAPKFQG

SEQ ID NO: 27028 - protein, 9 aa, Artificial Sequence
  Description of Artificial Sequence: Synthetic peptide
  XENP021417 vhCDR3
RGVRQALDY

SEQ ID NO: 27029 - protein, 214 aa, Artificial Sequence
  Description of Artificial Sequence: Synthetic polypeptide
  XENP021417 2A11_H1_L2.66_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNVLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27030 - protein, 107 aa, Artificial Sequence
  Description of Artificial Sequence: Synthetic polypeptide
  VL of XENP021417
DIQMTQSPAFLSVTPGEKVTITCQASQDIGNYLNWFQQKPDQTVKLLIYYTSRLHSGVPSRFSGSGSGTDYTFTISSLEAEDAATYFCQQGNVLPYTFGGGTKVEIK

SEQ ID NO: 27031 - protein, 11 aa, Artificial Sequence
  Description of Artificial Sequence: Synthetic peptide
  XENP021417 vlCDR1
QASQDIGNYLN

SEQ ID NO: 27032 - protein, 7 aa, Artificial Sequence
  Description of Artificial Sequence: Synthetic peptide
  XENP021417 vlCDR2
YTSRLHS

SEQ ID NO: 27033 - protein, 9 aa, Artificial Sequence
  Description of Artificial Sequence: Synthetic peptide
  XENP021417 vlCDR3
QQGNVLPYT

SEQ ID NO: 27034 - protein, 223 aa, Artificial Sequence; identical to SEQ ID NO: 25194
  Description of Artificial Sequence: Synthetic polypeptide
  XENP021418 2A11_H1_L2.67_Fab Heavy Chain

SEQ ID NO: 27035 - protein, 118 aa, Artificial Sequence; identical to SEQ ID NO: 17236
  Description of Artificial Sequence: Synthetic polypeptide
  VH of XENP021418

SEQ ID NO: 27036 - protein, 5 aa, Artificial Sequence
  Description of Artificial Sequence: Synthetic peptide
  XENP021418 vhCDR1
DYYMH

SEQ ID NO: 27037 - protein, 17 aa, Artificial Sequence
  Description of Artificial Sequence: Synthetic peptide
  XENP021418 vhCDR2
WIDPENGDTEYAPKFQG

SEQ ID NO: 27038 - protein, 9 aa, Artificial Sequence
  Description of Artificial Sequence: Synthetic peptide
  XENP021418 vhCDR3
RGVRQALDY

SEQ ID NO: 27039 - protein, 214 aa, Artificial Sequence
  Description of Artificial Sequence: Synthetic polypeptide
  XENP021418 2A11_H1_L2.67_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNSLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27040 - protein, 107 aa, Artificial Sequence
  Description of Artificial Sequence: Synthetic polypeptide
  VL of XENP021418
DIQMTQSPAFLSVTPGEKVTITCQASQDIGNYLNWFQQKPDQTVKLLIYYTSRLHSGVPSRFSGSGSGTDYTFTISSLEAEDAATYFCQQGNSLPYTFGGGTKVEIK

SEQ ID NO: 27041 - protein, 11 aa, Artificial Sequence
  Description of Artificial Sequence: Synthetic peptide
  XENP021418 vlCDR1
QASQDIGNYLN

SEQ ID NO: 27042 - protein, 7 aa, Artificial Sequence
  Description of Artificial Sequence: Synthetic peptide
  XENP021418 vlCDR2
YTSRLHS

SEQ ID NO: 27043 - protein, 9 aa, Artificial Sequence
  Description of Artificial Sequence: Synthetic peptide
  XENP021418 vlCDR3
QQGNSLPYT

SEQ ID NO: 27044 - protein, 223 aa, Artificial Sequence; identical to SEQ ID NO: 25194
  Description of Artificial Sequence: Synthetic polypeptide
  XENP021419 2A11_H1_L2.68_Fab Heavy Chain

SEQ ID NO: 27045 - protein, 118 aa, Artificial Sequence; identical to SEQ ID NO: 17236
  Description of Artificial Sequence: Synthetic polypeptide
  VH of XENP021419

SEQ ID NO: 27046 - protein, 5 aa, Artificial Sequence
  Description of Artificial Sequence: Synthetic peptide
  XENP021419 vhCDR1
DYYMH

SEQ ID NO: 27047 - protein, 17 aa, Artificial Sequence
  Description of Artificial Sequence: Synthetic peptide
  XENP021419 vhCDR2
WIDPENGDTEYAPKFQG

SEQ ID NO: 27048 - protein, 9 aa, Artificial Sequence
  Description of Artificial Sequence: Synthetic peptide
  XENP021419 vhCDR3
RGVRQALDY

SEQ ID NO: 27049 - protein, 214 aa, Artificial Sequence
  Description of Artificial Sequence: Synthetic polypeptide
  XENP021419 2A11_H1_L2.68_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNALPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27050 - protein, 107 aa, Artificial Sequence
  Description of Artificial Sequence: Synthetic polypeptide
  VL of XENP021419
DIQMTQSPAFLSVTPGEKVTITCQASQDIGNYLNWFQQKPDQTVKLLIYYTSRLHSGVPSRFSGSGSGTDYTFTISSLEAEDAATYFCQQGNALPYTFGGGTKVEIK

SEQ ID NO: 27051 - protein, 11 aa, Artificial Sequence
  Description of Artificial Sequence: Synthetic peptide
  XENP021419 vlCDR1
QASQDIGNYLN

SEQ ID NO: 27052 - protein, 7 aa, Artificial Sequence
  Description of Artificial Sequence: Synthetic peptide
  XENP021419 vlCDR2
YTSRLHS

SEQ ID NO: 27053 - protein, 9 aa, Artificial Sequence
  Description of Artificial Sequence: Synthetic peptide
  XENP021419 vlCDR3
QQGNALPYT

SEQ ID NO: 27054 - protein, 223 aa, Artificial Sequence; identical to SEQ ID NO: 25194
  Description of Artificial Sequence: Synthetic polypeptide
  XENP021420 2A11_H1_L2.69_Fab Heavy Chain

SEQ ID NO: 27055 - protein, 118 aa, Artificial Sequence; identical to SEQ ID NO: 17236
  Description of Artificial Sequence: Synthetic polypeptide
  VH of XENP021420

SEQ ID NO: 27056 - protein, 5 aa, Artificial Sequence
  Description of Artificial Sequence: Synthetic peptide
  XENP021420 vhCDR1
DYYMH

SEQ ID NO: 27057 - protein, 17 aa, Artificial Sequence
  Description of Artificial Sequence: Synthetic peptide
  XENP021420 vhCDR2
WIDPENGDTEYAPKFQG

SEQ ID NO: 27058 - protein, 9 aa, Artificial Sequence
  Description of Artificial Sequence: Synthetic peptide
  XENP021420 vhCDR3
RGVRQALDY

SEQ ID NO: 27059 - protein, 214 aa, Artificial Sequence
  Description of Artificial Sequence: Synthetic polypeptide
  XENP021420 2A11_H1_L2.69_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNILPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27060 - protein, 107 aa, Artificial Sequence
  Description of Artificial Sequence: Synthetic polypeptide
  VL of XENP021420
DIQMTQSPAFLSVTPGEKVTITCQASQDIGNYLNWFQQKPDQTVKLLIYYTSRLHSGVPSRFSGSGSGTDYTFTISSLEAEDAATYFCQQGNILPYTFGGGTKVEIK

SEQ ID NO: 27061 - protein, 11 aa, Artificial Sequence
  Description of Artificial Sequence: Synthetic peptide
  XENP021420 vlCDR1
QASQDIGNYLN

SEQ ID NO: 27062 - protein, 7 aa, Artificial Sequence
  Description of Artificial Sequence: Synthetic peptide
  XENP021420 vlCDR2
YTSRLHS

SEQ ID NO: 27063 - protein, 9 aa, Artificial Sequence
  Description of Artificial Sequence: Synthetic peptide
  XENP021420 vlCDR3
QQGNILPYT

SEQ ID NO: 27064 - protein, 223 aa, Artificial Sequence; identical to SEQ ID NO: 25194
  Description of Artificial Sequence: Synthetic polypeptide
  XENP021421 2A11_H1_L2.70_Fab Heavy Chain

SEQ ID NO: 27065 - protein, 118 aa, Artificial Sequence; identical to SEQ ID NO: 17236
  Description of Artificial Sequence: Synthetic polypeptide
  VH of XENP021421

SEQ ID NO: 27066 - protein, 5 aa, Artificial Sequence
  Description of Artificial Sequence: Synthetic peptide
  XENP021421 vhCDR1
DYYMH

SEQ ID NO: 27067 - protein, 17 aa, Artificial Sequence
  Description of Artificial Sequence: Synthetic peptide
  XENP021421 vhCDR2
WIDPENGDTEYAPKFQG

SEQ ID NO: 27068 - protein, 9 aa, Artificial Sequence
  Description of Artificial Sequence: Synthetic peptide
  XENP021421 vhCDR3
RGVRQALDY

SEQ ID NO: 27069 - protein, 214 aa, Artificial Sequence
  Description of Artificial Sequence: Synthetic polypeptide
  XENP021421 2A11_H1_L2.70_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27070 - protein, 107 aa, Artificial Sequence
  Description of Artificial Sequence: Synthetic polypeptide
  VL of XENP021421
DIQMTQSPAFLSVTPGEKVTITCQASQDIGNYLNWFQQKPDQTVKLLIYYTSRLHSGVPSRFSGSGSGTDYTFTISSLEAEDAATYFCQQGNQLPYTFGGGTKVEIK

SEQ ID NO: 27071 - protein, 11 aa, Artificial Sequence
  Description of Artificial Sequence: Synthetic peptide
  XENP021421 vlCDR1
QASQDIGNYLN

SEQ ID NO: 27072 - protein, 7 aa, Artificial Sequence
  Description of Artificial Sequence: Synthetic peptide
  XENP021421 vlCDR2
YTSRLHS

SEQ ID NO: 27073 - protein, 9 aa, Artificial Sequence
  Description of Artificial Sequence: Synthetic peptide
  XENP021421 vlCDR3
QQGNQLPYT

SEQ ID NO: 27074 - protein, 223 aa, Artificial Sequence; identical to SEQ ID NO: 25194
  Description of Artificial Sequence: Synthetic polypeptide
  XENP021422 2A11_H1_L2.71_Fab Heavy Chain

SEQ ID NO: 27075 - protein, 118 aa, Artificial Sequence; identical to SEQ ID NO: 17236
  Description of Artificial Sequence: Synthetic polypeptide
  VH of XENP021422

SEQ ID NO: 27076 - protein, 5 aa, Artificial Sequence
  Description of Artificial Sequence: Synthetic peptide
  XENP021422 vhCDR1
DYYMH

SEQ ID NO: 27077 - protein, 17 aa, Artificial Sequence
  Description of Artificial Sequence: Synthetic peptide
  XENP021422 vhCDR2
WIDPENGDTEYAPKFQG

SEQ ID NO: 27078 - protein, 9 aa, Artificial Sequence
  Description of Artificial Sequence: Synthetic peptide
  XENP021422 vhCDR3
RGVRQALDY

SEQ ID NO: 27079 - protein, 214 aa, Artificial Sequence
  Description of Artificial Sequence: Synthetic polypeptide
  XENP021422 2A11_H1_L2.71_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNHLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27080 - protein, 107 aa, Artificial Sequence
  Description of Artificial Sequence: Synthetic polypeptide
  VL of XENP021422
DIQMTQSPAFLSVTPGEKVTITCQASQDIGNYLNWFQQKPDQTVKLLIYYTSRLHSGVPSRFSGSGSGTDYTFTISSLEAEDAATYFCQQGNHLPYTFGGGTKVEIK

SEQ ID NO: 27081 - protein, 11 aa, Artificial Sequence
  Description of Artificial Sequence: Synthetic peptide
  XENP021422 vlCDR1
QASQDIGNYLN

SEQ ID NO: 27082 - protein, 7 aa, Artificial Sequence
  Description of Artificial Sequence: Synthetic peptide
  XENP021422 vlCDR2
YTSRLHS

SEQ ID NO: 27083 - protein, 9 aa, Artificial Sequence
  Description of Artificial Sequence: Synthetic peptide
  XENP021422 vlCDR3
QQGNHLPYT

SEQ ID NO: 27084 - protein, 223 aa, Artificial Sequence; identical to SEQ ID NO: 25194
  Description of Artificial Sequence: Synthetic polypeptide
  XENP021423 2A11_H1_L2.72_Fab Heavy Chain

SEQ ID NO: 27085 - protein, 118 aa, Artificial Sequence; identical to SEQ ID NO: 17236
  Description of Artificial Sequence: Synthetic polypeptide
  VH of XENP021423

SEQ ID NO: 27086 - protein, 5 aa, Artificial Sequence
  Description of Artificial Sequence: Synthetic peptide
  XENP021423 vhCDR1
DYYMH

SEQ ID NO: 27087 - protein, 17 aa, Artificial Sequence
  Description of Artificial Sequence: Synthetic peptide
  XENP021423 vhCDR2
WIDPENGDTEYAPKFQG

SEQ ID NO: 27088 - protein, 9 aa, Artificial Sequence
  Description of Artificial Sequence: Synthetic peptide
  XENP021423 vhCDR3
RGVRQALDY

SEQ ID NO: 27089 - protein, 214 aa, Artificial Sequence
  Description of Artificial Sequence: Synthetic polypeptide
  XENP021423 2A11_H1_L2.72_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNDLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27090 - protein, 107 aa, Artificial Sequence
  Description of Artificial Sequence: Synthetic polypeptide
  VL of XENP021423
DIQMTQSPAFLSVTPGEKVTITCQASQDIGNYLNWFQQKPDQTVKLLIYYTSRLHSGVPSRFSGSGSGTDYTFTISSLEAEDAATYFCQQGNDLPYTFGGGTKVEIK

SEQ ID NO: 27091 - protein, 11 aa, Artificial Sequence
  Description of Artificial Sequence: Synthetic peptide
  XENP021423 vlCDR1
QASQDIGNYLN

SEQ ID NO: 27092 - protein, 7 aa, Artificial Sequence
  Description of Artificial Sequence: Synthetic peptide
  XENP021423 vlCDR2
YTSRLHS

SEQ ID NO: 27093 - protein, 9 aa, Artificial Sequence
  Description of Artificial Sequence: Synthetic peptide
  XENP021423 vlCDR3
QQGNDLPYT

SEQ ID NO: 27094 - protein, 223 aa, Artificial Sequence; identical to SEQ ID NO: 25194
  Description of Artificial Sequence: Synthetic polypeptide
  XENP021424 2A11_H1_L2.73_Fab Heavy Chain

SEQ ID NO: 27095 - protein, 118 aa, Artificial Sequence; identical to SEQ ID NO: 17236
  Description of Artificial Sequence: Synthetic polypeptide
  VH of XENP021424

SEQ ID NO: 27096 - protein, 5 aa, Artificial Sequence
  Description of Artificial Sequence: Synthetic peptide
  XENP021424 vhCDR1
DYYMH

SEQ ID NO: 27097 - protein, 17 aa, Artificial Sequence
  Description of Artificial Sequence: Synthetic peptide
  XENP021424 vhCDR2
WIDPENGDTEYAPKFQG

SEQ ID NO: 27098 - protein, 9 aa, Artificial Sequence
  Description of Artificial Sequence: Synthetic peptide
  XENP021424 vhCDR3
RGVRQALDY

SEQ ID NO: 27099 - protein, 214 aa, Artificial Sequence
  Description of Artificial Sequence: Synthetic polypeptide
  XENP021424 2A11_H1_L2.73_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNKLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27100 - protein, 107 aa, Artificial Sequence
  Description of Artificial Sequence: Synthetic polypeptide
  VL of XENP021424
DIQMTQSPAFLSVTPGEKVTITCQASQDIGNYLNWFQQKPDQTVKLLIYYTSRLHSGVPSRFSGSGSGTDYTFTISSLEAEDAATYFCQQGNKLPYTFGGGTKVEIK

SEQ ID NO: 27101 - protein, 11 aa, Artificial Sequence
  Description of Artificial Sequence: Synthetic peptide
  XENP021424 vlCDR1
QASQDIGNYLN

SEQ ID NO: 27102 - protein, 7 aa, Artificial Sequence
  Description of Artificial Sequence: Synthetic peptide
  XENP021424 vlCDR2
YTSRLHS

SEQ ID NO: 27103 - protein, 9 aa, Artificial Sequence
  Description of Artificial Sequence: Synthetic peptide
  XENP021424 vlCDR3
QQGNKLPYT

SEQ ID NO: 27104 - protein, 223 aa, Artificial Sequence; identical to SEQ ID NO: 25194
  Description of Artificial Sequence: Synthetic polypeptide
  XENP021425 2A11_H1_L2.74_Fab Heavy Chain

SEQ ID NO: 27105 - protein, 118 aa, Artificial Sequence; identical to SEQ ID NO: 17236
  Description of Artificial Sequence: Synthetic polypeptide
  VH of XENP021425

SEQ ID NO: 27106 - protein, 5 aa, Artificial Sequence
  Description of Artificial Sequence: Synthetic peptide
  XENP021425 vhCDR1
DYYMH

SEQ ID NO: 27107 - protein, 17 aa, Artificial Sequence
  Description of Artificial Sequence: Synthetic peptide
  XENP021425 vhCDR2
WIDPENGDTEYAPKFQG

SEQ ID NO: 27108 - protein, 9 aa, Artificial Sequence
  Description of Artificial Sequence: Synthetic peptide
  XENP021425 vhCDR3
RGVRQALDY

SEQ ID NO: 27109 - protein, 214 aa, Artificial Sequence
  Description of Artificial Sequence: Synthetic polypeptide
  XENP021425 2A11_H1_L2.74_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNYLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27110 - protein, 107 aa, Artificial Sequence
  Description of Artificial Sequence: Synthetic polypeptide
  VL of XENP021425
DIQMTQSPAFLSVTPGEKVTITCQASQDIGNYLNWFQQKPDQTVKLLIYYTSRLHSGVPSRFSGSGSGTDYTFTISSLEAEDAATYFCQQGNYLPYTFGGGTKVEIK

SEQ ID NO: 27111 - protein, 11 aa, Artificial Sequence
  Description of Artificial Sequence: Synthetic peptide
  XENP021425 vlCDR1
QASQDIGNYLN

SEQ ID NO: 27112 - protein, 7 aa, Artificial Sequence
  Description of Artificial Sequence: Synthetic peptide
  XENP021425 vlCDR2
YTSRLHS

SEQ ID NO: 27113 - protein, 9 aa, Artificial Sequence
  Description of Artificial Sequence: Synthetic peptide
  XENP021425 vlCDR3
QQGNYLPYT

SEQ ID NO: 27114 - protein, 223 aa, Artificial Sequence; identical to SEQ ID NO: 25194
  Description of Artificial Sequence: Synthetic polypeptide
  XENP021426 2A11_H1_L2.75_Fab Heavy Chain

SEQ ID NO: 27115 - protein, 118 aa, Artificial Sequence; identical to SEQ ID NO: 17236
  Description of Artificial Sequence: Synthetic polypeptide
  VH of XENP021426

SEQ ID NO: 27116 - protein, 5 aa, Artificial Sequence
  Description of Artificial Sequence: Synthetic peptide
  XENP021426 vhCDR1
DYYMH

SEQ ID NO: 27117 - protein, 17 aa, Artificial Sequence
  Description of Artificial Sequence: Synthetic peptide
  XENP021426 vhCDR2
WIDPENGDTEYAPKFQG

SEQ ID NO: 27118 - protein, 9 aa, Artificial Sequence
  Description of Artificial Sequence: Synthetic peptide
  XENP021426 vhCDR3
RGVRQALDY

SEQ ID NO: 27119 - protein, 214 aa, Artificial Sequence
  Description of Artificial Sequence: Synthetic polypeptide
  XENP021426 2A11_H1_L2.75_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTIPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27120 - protein, 107 aa, Artificial Sequence
  Description of Artificial Sequence: Synthetic polypeptide
  VL of XENP021426
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTIPYTFGGGTKVEIK

SEQ ID NO: 27121 - protein, 11 aa, Artificial Sequence
  Description of Artificial Sequence: Synthetic peptide
  XENP021426 vlCDR1
QASQDIGNYLN

SEQ ID NO: 27122 - protein, 7 aa, Artificial Sequence
  Description of Artificial Sequence: Synthetic peptide
  XENP021426 vlCDR2
YTSRLHS

SEQ ID NO: 27123 - protein, 9 aa, Artificial Sequence
  Description of Artificial Sequence: Synthetic peptide
  XENP021426 vlCDR3
QQGNTIPYT

SEQ ID NO: 27124 - protein, 223 aa, Artificial Sequence; identical to SEQ ID NO: 25194
  Description of Artificial Sequence: Synthetic polypeptide
  XENP021427 2A11_H1_L2.76_Fab Heavy Chain

SEQ ID NO: 27125 - protein, 118 aa, Artificial Sequence; identical to SEQ ID NO: 17236
  Description of Artificial Sequence: Synthetic polypeptide
  VH of XENP021427

SEQ ID NO: 27126 - protein, 5 aa, Artificial Sequence
  Description of Artificial Sequence: Synthetic peptide
  XENP021427 vhCDR1
DYYMH

SEQ ID NO: 27127 - protein, 17 aa, Artificial Sequence
  Description of Artificial Sequence: Synthetic peptide
  XENP021427 vhCDR2
WIDPENGDTEYAPKFQG

SEQ ID NO: 27128 - protein, 9 aa, Artificial Sequence
  Description of Artificial Sequence: Synthetic peptide
  XENP021427 vhCDR3
RGVRQALDY

SEQ ID NO: 27129 - protein, 214 aa, Artificial Sequence
  Description of Artificial Sequence: Synthetic polypeptide
  XENP021427 2A11_H1_L2.76_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27130 - protein, 107 aa, Artificial Sequence
  Description of Artificial Sequence: Synthetic polypeptide
  VL of XENP021427
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTFPYTFGGGTKVEIK

SEQ ID NO: 27131 - protein, 11 aa, Artificial Sequence
  Description of Artificial Sequence: Synthetic peptide
  XENP021427 vlCDR1
QASQDIGNYLN

SEQ ID NO: 27132 - protein, 7 aa, Artificial Sequence
  Description of Artificial Sequence: Synthetic peptide
  XENP021427 vlCDR2
YTSRLHS

SEQ ID NO: 27133 - protein, 9 aa, Artificial Sequence
  Description of Artificial Sequence: Synthetic peptide
  XENP021427 vlCDR3
QQGNTFPYT

SEQ ID NO: 27134 - protein, 223 aa, Artificial Sequence; identical to SEQ ID NO: 25194
  Description of Artificial Sequence: Synthetic polypeptide
  XENP021428 2A11_H1_L2.77_Fab Heavy Chain

SEQ ID NO: 27135 - protein, 118 aa, Artificial Sequence; identical to SEQ ID NO: 17236
  Description of Artificial Sequence: Synthetic polypeptide
  VH of XENP021428

SEQ ID NO: 27136 - protein, 5 aa, Artificial Sequence
  Description of Artificial Sequence: Synthetic peptide
  XENP021428 vhCDR1
DYYMH

SEQ ID NO: 27137 - protein, 17 aa, Artificial Sequence
  Description of Artificial Sequence: Synthetic peptide
  XENP021428 vhCDR2
WIDPENGDTEYAPKFQG

SEQ ID NO: 27138 - protein, 9 aa, Artificial Sequence
  Description of Artificial Sequence: Synthetic peptide
  XENP021428 vhCDR3
RGVRQALDY

SEQ ID NO: 27139 - protein, 214 aa, Artificial Sequence
  Description of Artificial Sequence: Synthetic polypeptide
  XENP021428 2A11_H1_L2.77_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27140 - protein, 107 aa, Artificial Sequence
  Description of Artificial Sequence: Synthetic polypeptide
  VL of XENP021428
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTVPYTFGGGTKVEIK

SEQ ID NO: 27141 - protein, 11 aa, Artificial Sequence
  Description of Artificial Sequence: Synthetic peptide
  XENP021428 vlCDR1
QASQDIGNYLN

SEQ ID NO: 27142 - protein, 7 aa, Artificial Sequence
  Description of Artificial Sequence: Synthetic peptide
  XENP021428 vlCDR2
YTSRLHS

SEQ ID NO: 27143 - protein, 9 aa, Artificial Sequence
  Description of Artificial Sequence: Synthetic peptide
  XENP021428 vlCDR3
QQGNTVPYT

SEQ ID NO: 27144 - protein, 223 aa, Artificial Sequence; identical to SEQ ID NO: 25194
  Description of Artificial Sequence: Synthetic polypeptide
  XENP021429 2A11_H1_L2.78_Fab Heavy Chain

SEQ ID NO: 27145 - protein, 118 aa, Artificial Sequence; identical to SEQ ID NO: 17236
  Description of Artificial Sequence: Synthetic polypeptide
  VH of XENP021429

SEQ ID NO: 27146 - protein, 5 aa, Artificial Sequence
  Description of Artificial Sequence: Synthetic peptide
  XENP021429 vhCDR1
DYYMH

SEQ ID NO: 27147 - protein, 17 aa, Artificial Sequence
  Description of Artificial Sequence: Synthetic peptide
  XENP021429 vhCDR2
WIDPENGDTEYAPKFQG

SEQ ID NO: 27148 - protein, 9 aa, Artificial Sequence
  Description of Artificial Sequence: Synthetic peptide
  XENP021429 vhCDR3
RGVRQALDY

SEQ ID NO: 27149 - protein, 214 aa, Artificial Sequence
  Description of Artificial Sequence: Synthetic polypeptide
  XENP021429 2A11_H1_L2.78_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27150 - protein, 107 aa, Artificial Sequence
  Description of Artificial Sequence: Synthetic polypeptide
  VL of XENP021429
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTYPYTFGGGTKVEIK

SEQ ID NO: 27151 - protein, 11 aa, Artificial Sequence
  Description of Artificial Sequence: Synthetic peptide
  XENP021429 vlCDR1
QASQDIGNYLN

SEQ ID NO: 27152 - protein, 7 aa, Artificial Sequence
  Description of Artificial Sequence: Synthetic peptide
  XENP021429 vlCDR2
YTSRLHS

SEQ ID NO: 27153 - protein, 9 aa, Artificial Sequence
  Description of Artificial Sequence: Synthetic peptide
  XENP021429 vlCDR3
QQGNTYPYT

SEQ ID NO: 27154 - protein, 223 aa, Artificial Sequence; identical to SEQ ID NO: 25194
  Description of Artificial Sequence: Synthetic polypeptide
  XENP021430 2A11_H1_L2.79_Fab Heavy Chain

SEQ ID NO: 27155 - protein, 118 aa, Artificial Sequence; identical to SEQ ID NO: 17236
  Description of Artificial Sequence: Synthetic polypeptide
  VH of XENP021430

SEQ ID NO: 27156 - protein, 5 aa, Artificial Sequence
  Description of Artificial Sequence: Synthetic peptide
  XENP021430 vhCDR1
DYYMH

SEQ ID NO: 27157 - protein, 17 aa, Artificial Sequence
  Description of Artificial Sequence: Synthetic peptide
  XENP021430 vhCDR2
WIDPENGDTEYAPKFQG

SEQ ID NO: 27158 - protein, 9 aa, Artificial Sequence
  Description of Artificial Sequence: Synthetic peptide
  XENP021430 vhCDR3
RGVRQALDY

SEQ ID NO: 27159 - protein, 214 aa, Artificial Sequence
  Description of Artificial Sequence: Synthetic polypeptide
  XENP021430 2A11_H1_L2.79_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTWPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27160 - protein, 107 aa, Artificial Sequence
  Description of Artificial Sequence: Synthetic polypeptide
  VL of XENP021430
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTWPYTFGGGTKVEIK

SEQ ID NO: 27161 - protein, 11 aa, Artificial Sequence
  Description of Artificial Sequence: Synthetic peptide
  XENP021430 vlCDR1
QASQDIGNYLN

SEQ ID NO: 27162 - protein, 7 aa, Artificial Sequence
  Description of Artificial Sequence: Synthetic peptide
  XENP021430 vlCDR2
YTSRLHS

SEQ ID NO: 27163 - protein, 9 aa, Artificial Sequence
  Description of Artificial Sequence: Synthetic peptide
  XENP021430 vlCDR3
QQGNTWPYT

SEQ ID NO: 27164 - protein, 223 aa, Artificial Sequence; identical to SEQ ID NO: 25194
  Description of Artificial Sequence: Synthetic polypeptide
  XENP021431 2A11_H1_L2.80_Fab Heavy Chain

SEQ ID NO: 27165 - protein, 118 aa, Artificial Sequence; identical to SEQ ID NO: 17236
  Description of Artificial Sequence: Synthetic polypeptide
  VH of XENP021431

SEQ ID NO: 27166 - protein, 5 aa, Artificial Sequence
  Description of Artificial Sequence: Synthetic peptide
  XENP021431 vhCDR1
DYYMH

SEQ ID NO: 27167 - protein, 17 aa, Artificial Sequence
  Description of Artificial Sequence: Synthetic peptide
  XENP021431 vhCDR2
WIDPENGDTEYAPKFQG

SEQ ID NO: 27168 - protein, 9 aa, Artificial Sequence
  Description of Artificial Sequence: Synthetic peptide
  XENP021431 vhCDR3
RGVRQALDY

SEQ ID NO: 27169 - protein, 214 aa, Artificial Sequence
  Description of Artificial Sequence: Synthetic polypeptide
  XENP021431 2A11_H1_L2.80_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTTPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27170 - protein, 107 aa, Artificial Sequence
  Description of Artificial Sequence: Synthetic polypeptide
  VL of XENP021431
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTTPYTFGGGTKVEIK

SEQ ID NO: 27171 - protein, 11 aa, Artificial Sequence
  Description of Artificial Sequence: Synthetic peptide
  XENP021431 vlCDR1
QASQDIGNYLN

SEQ ID NO: 27172 - protein, 7 aa, Artificial Sequence
  Description of Artificial Sequence: Synthetic peptide
  XENP021431 vlCDR2
YTSRLHS

SEQ ID NO: 27173 - protein, 9 aa, Artificial Sequence
  Description of Artificial Sequence: Synthetic peptide
  XENP021431 vlCDR3
QQGNTTPYT

SEQ ID NO: 27174 - protein, 223 aa, Artificial Sequence; identical to SEQ ID NO: 25194
  Description of Artificial Sequence: Synthetic polypeptide
  XENP021432 2A11_H1_L2.81_Fab Heavy Chain

SEQ ID NO: 27175 - protein, 118 aa, Artificial Sequence; identical to SEQ ID NO: 17236
  Description of Artificial Sequence: Synthetic polypeptide
  VH of XENP021432

SEQ ID NO: 27176 - protein, 5 aa, Artificial Sequence
  Description of Artificial Sequence: Synthetic peptide
  XENP021432 vhCDR1
DYYMH

SEQ ID NO: 27177 - protein, 17 aa, Artificial Sequence
  Description of Artificial Sequence: Synthetic peptide
  XENP021432 vhCDR2
WIDPENGDTEYAPKFQG

SEQ ID NO: 27178 - protein, 9 aa, Artificial Sequence
  Description of Artificial Sequence: Synthetic peptide
  XENP021432 vhCDR3
RGVRQALDY

SEQ ID NO: 27179 - protein, 214 aa, Artificial Sequence
  Description of Artificial Sequence: Synthetic polypeptide
  XENP021432 2A11_H1_L2.81_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTAPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27180 - protein, 107 aa, Artificial Sequence
  Description of Artificial Sequence: Synthetic polypeptide
  VL of XENP021432
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTAPYTFGGGTKVEIK

SEQ ID NO: 27181 - protein, 11 aa, Artificial Sequence
  Description of Artificial Sequence: Synthetic peptide
  XENP021432 vlCDR1
QASQDIGNYLN

SEQ ID NO: 27182 - protein, 7 aa, Artificial Sequence
  Description of Artificial Sequence: Synthetic peptide
  XENP021432 vlCDR2
YTSRLHS

SEQ ID NO: 27183 - protein, 9 aa, Artificial Sequence
  Description of Artificial Sequence: Synthetic peptide
  XENP021432 vlCDR3
QQGNTAPYT

SEQ ID NO: 27184 - protein, 223 aa, Artificial Sequence; identical to SEQ ID NO: 25194
  Description of Artificial Sequence: Synthetic polypeptide
  XENP021433 2A11_H1_L2.82_Fab Heavy Chain

SEQ ID NO: 27185 - protein, 118 aa, Artificial Sequence; identical to SEQ ID NO: 17236
  Description of Artificial Sequence: Synthetic polypeptide
  VH of XENP021433

SEQ ID NO: 27186 - protein, 5 aa, Artificial Sequence
  Description of Artificial Sequence: Synthetic peptide
  XENP021433 vhCDR1
DYYMH

SEQ ID NO: 27187 - protein, 17 aa, Artificial Sequence
  Description of Artificial Sequence: Synthetic peptide
  XENP021433 vhCDR2
WIDPENGDTEYAPKFQG

SEQ ID NO: 27188 - protein, 9 aa, Artificial Sequence
  Description of Artificial Sequence: Synthetic peptide
  XENP021433 vhCDR3
RGVRQALDY

SEQ ID NO: 27189 - protein, 214 aa, Artificial Sequence
  Description of Artificial Sequence: Synthetic polypeptide
  XENP021433 2A11_H1_L2.82_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTQPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27190 - protein, 107 aa, Artificial Sequence
  Description of Artificial Sequence: Synthetic polypeptide
  VL of XENP021433
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTQPYTFGGGTKVEIK

SEQ ID NO: 27191 - protein, 11 aa, Artificial Sequence
  Description of Artificial Sequence: Synthetic peptide
  XENP021433 vlCDR1
QASQDIGNYLN

SEQ ID NO: 27192 - protein, 7 aa, Artificial Sequence
  Description of Artificial Sequence: Synthetic peptide
  XENP021433 vlCDR2
YTSRLHS

SEQ ID NO: 27193 - protein, 9 aa, Artificial Sequence
  Description of Artificial Sequence: Synthetic peptide
  XENP021433 vlCDR3
QQGNTQPYT

SEQ ID NO: 27194 - protein, 223 aa, Artificial Sequence; identical to SEQ ID NO: 25194
  Description of Artificial Sequence: Synthetic polypeptide
  XENP021434 2A11_H1_L2.83_Fab Heavy Chain

SEQ ID NO: 27195 - protein, 118 aa, Artificial Sequence; identical to SEQ ID NO: 17236
  Description of Artificial Sequence: Synthetic polypeptide
  VH of XENP021434

SEQ ID NO: 27196 - protein, 5 aa, Artificial Sequence
  Description of Artificial Sequence: Synthetic peptide
  XENP021434 vhCDR1
DYYMH

SEQ ID NO: 27197 - protein, 17 aa, Artificial Sequence
  Description of Artificial Sequence: Synthetic peptide
  XENP021434 vhCDR2
WIDPENGDTEYAPKFQG

SEQ ID NO: 27198 - protein, 9 aa, Artificial Sequence
  Description of Artificial Sequence: Synthetic peptide
  XENP021434 vhCDR3
RGVRQALDY

SEQ ID NO: 27199 - protein, 214 aa, Artificial Sequence
  Description of Artificial Sequence: Synthetic polypeptide
  XENP021434 2A11_H1_L2.83_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTKPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27200 - protein, 107 aa, Artificial Sequence
  Description of Artificial Sequence: Synthetic polypeptide
  VL of XENP021434
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTKPYTFGGGTKVEIK

SEQ ID NO: 27201 - protein, 11 aa, Artificial Sequence
  Description of Artificial Sequence: Synthetic peptide
  XENP021434 vlCDR1
QASQDIGNYLN

SEQ ID NO: 27202 - protein, 7 aa, Artificial Sequence
  Description of Artificial Sequence: Synthetic peptide
  XENP021434 vlCDR2
YTSRLHS

SEQ ID NO: 27203 - protein, 9 aa, Artificial Sequence
  Description of Artificial Sequence: Synthetic peptide
  XENP021434 vlCDR3
QQGNTKPYT

SEQ ID NO: 27204 - protein, 223 aa, Artificial Sequence; identical to SEQ ID NO: 25194
  Description of Artificial Sequence: Synthetic polypeptide
  XENP021435 2A11_H1_L2.84_Fab Heavy Chain

SEQ ID NO: 27205 - protein, 118 aa, Artificial Sequence; identical to SEQ ID NO: 17236
  Description of Artificial Sequence: Synthetic polypeptide
  VH of XENP021435

SEQ ID NO: 27206 - protein, 5 aa, Artificial Sequence
  Description of Artificial Sequence: Synthetic peptide
  XENP021435 vhCDR1
DYYMH

SEQ ID NO: 27207 - protein, 17 aa, Artificial Sequence
  Description of Artificial Sequence: Synthetic peptide
  XENP021435 vhCDR2
WIDPENGDTEYAPKFQG

SEQ ID NO: 27208 - protein, 9 aa, Artificial Sequence
  Description of Artificial Sequence: Synthetic peptide
  XENP021435 vhCDR3
RGVRQALDY

SEQ ID NO: 27209 - protein, 214 aa, Artificial Sequence
  Description of Artificial Sequence: Synthetic polypeptide
  XENP021435 2A11_H1_L2.84_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27210 - protein, 107 aa, Artificial Sequence
  Description of Artificial Sequence: Synthetic polypeptide
  VL of XENP021435
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPFTFGGGTKVEIK

SEQ ID NO: 27211 - protein, 11 aa, Artificial Sequence
  Description of Artificial Sequence: Synthetic peptide
  XENP021435 vlCDR1
QASQDIGNYLN

SEQ ID NO: 27212 - protein, 7 aa, Artificial Sequence
  Description of Artificial Sequence: Synthetic peptide
  XENP021435 vlCDR2
YTSRLHS

SEQ ID NO: 27213 - protein, 9 aa, Artificial Sequence
  Description of Artificial Sequence: Synthetic peptide
  XENP021435 vlCDR3
QQGNTLPFT

SEQ ID NO: 27214 - protein, 223 aa, Artificial Sequence; identical to SEQ ID NO: 25194
  Description of Artificial Sequence: Synthetic polypeptide
  XENP021436 2A11_H1_L2.85_Fab Heavy Chain

SEQ ID NO: 27215 - protein, 118 aa, Artificial Sequence; identical to SEQ ID NO: 17236
  Description of Artificial Sequence: Synthetic polypeptide
  VH of XENP021436

SEQ ID NO: 27216 - protein, 5 aa, Artificial Sequence
  Description of Artificial Sequence: Synthetic peptide
  XENP021436 vhCDR1
DYYMH

SEQ ID NO: 27217 - protein, 17 aa, Artificial Sequence
  Description of Artificial Sequence: Synthetic peptide
  XENP021436 vhCDR2
WIDPENGDTEYAPKFQG

SEQ ID NO: 27218 - protein, 9 aa, Artificial Sequence
  Description of Artificial Sequence: Synthetic peptide
  XENP021436 vhCDR3
RGVRQALDY

SEQ ID NO: 27219 - protein, 214 aa, Artificial Sequence
  Description of Artificial Sequence: Synthetic polypeptide
  XENP021436 2A11_H1_L2.85_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27220 - protein, 107 aa, Artificial Sequence
  Description of Artificial Sequence: Synthetic polypeptide
  VL of XENP021436
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPHTFGGGTKVEIK

SEQ ID NO: 27221 - protein, 11 aa, Artificial Sequence
  Description of Artificial Sequence: Synthetic peptide
  XENP021436 vlCDR1
QASQDIGNYLN

SEQ ID NO: 27222 - protein, 7 aa, Artificial Sequence
  Description of Artificial Sequence: Synthetic peptide
  XENP021436 vlCDR2
YTSRLHS

SEQ ID NO: 27223 - protein, 9 aa, Artificial Sequence
  Description of Artificial Sequence: Synthetic peptide
  XENP021436 vlCDR3
QQGNTLPHT

SEQ ID NO: 27224 - protein, 223 aa, Artificial Sequence; identical to SEQ ID NO: 25194
  Description of Artificial Sequence: Synthetic polypeptide
  XENP021437 2A11_H1_L2.86_Fab Heavy Chain

SEQ ID NO: 27225 - protein, 118 aa, Artificial Sequence; identical to SEQ ID NO: 17236
  Description of Artificial Sequence: Synthetic polypeptide
  VH of XENP021437

SEQ ID NO: 27226 - protein, 5 aa, Artificial Sequence
  Description of Artificial Sequence: Synthetic peptide
  XENP021437 vhCDR1
DYYMH

SEQ ID NO: 27227 - protein, 17 aa, Artificial Sequence
  Description of Artificial Sequence: Synthetic peptide
  XENP021437 vhCDR2
WIDPENGDTEYAPKFQG

SEQ ID NO: 27228 - protein, 9 aa, Artificial Sequence
  Description of Artificial Sequence: Synthetic peptide
  XENP021437 vhCDR3
RGVRQALDY

SEQ ID NO: 27229 - protein, 214 aa, Artificial Sequence
  Description of Artificial Sequence: Synthetic polypeptide
  XENP021437 2A11_H1_L2.86_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27230 - protein, 107 aa, Artificial Sequence
  Description of Artificial Sequence: Synthetic polypeptide
  VL of XENP021437
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPLTFGGGTKVEIK

SEQ ID NO: 27231 - protein, 11 aa, Artificial Sequence
  Description of Artificial Sequence: Synthetic peptide
  XENP021437 vlCDR1
QASQDIGNYLN

SEQ ID NO: 27232 - protein, 7 aa, Artificial Sequence
  Description of Artificial Sequence: Synthetic peptide
  XENP021437 vlCDR2
YTSRLHS

SEQ ID NO: 27233 - protein, 9 aa, Artificial Sequence
  Description of Artificial Sequence: Synthetic peptide
  XENP021437 vlCDR3
QQGNTLPLT

SEQ ID NO: 27234 - protein, 223 aa, Artificial Sequence; identical to SEQ ID NO: 25194
  Description of Artificial Sequence: Synthetic polypeptide
  XENP021438 2A11_H1_L2.87_Fab Heavy Chain

SEQ ID NO: 27235 - protein, 118 aa, Artificial Sequence; identical to SEQ ID NO: 17236
  Description of Artificial Sequence: Synthetic polypeptide
  VH of XENP021438

SEQ ID NO: 27236 - protein, 5 aa, Artificial Sequence
  Description of Artificial Sequence: Synthetic peptide
  XENP021438 vhCDR1
DYYMH

SEQ ID NO: 27237 - protein, 17 aa, Artificial Sequence
  Description of Artificial Sequence: Synthetic peptide
  XENP021438 vhCDR2
WIDPENGDTEYAPKFQG

SEQ ID NO: 27238 - protein, 9 aa, Artificial Sequence
  Description of Artificial Sequence: Synthetic peptide
  XENP021438 vhCDR3
RGVRQALDY

SEQ ID NO: 27239 - protein, 214 aa, Artificial Sequence
  Description of Artificial Sequence: Synthetic polypeptide
  XENP021438 2A11_H1_L2.87_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27240 - protein, 107 aa, Artificial Sequence
  Description of Artificial Sequence: Synthetic polypeptide
  VL of XENP021438
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPWTFGGGTKVEIK

SEQ ID NO: 27241 - protein, 11 aa, Artificial Sequence
  Description of Artificial Sequence: Synthetic peptide
  XENP021438 vlCDR1
QASQDIGNYLN

SEQ ID NO: 27242 - protein, 7 aa, Artificial Sequence
  Description of Artificial Sequence: Synthetic peptide
  XENP021438 vlCDR2
YTSRLHS

SEQ ID NO: 27243 - protein, 9 aa, Artificial Sequence
  Description of Artificial Sequence: Synthetic peptide
  XENP021438 vlCDR3
QQGNTLPWT

SEQ ID NO: 27244 - protein, 223 aa, Artificial Sequence; identical to SEQ ID NO: 25194
  Description of Artificial Sequence: Synthetic polypeptide
  XENP021439 2A11_H1_L2.88_Fab Heavy Chain

SEQ ID NO: 27245 - protein, 118 aa, Artificial Sequence; identical to SEQ ID NO: 17236
  Description of Artificial Sequence: Synthetic polypeptide
  VH of XENP021439

SEQ ID NO: 27246 - protein, 5 aa, Artificial Sequence
  Description of Artificial Sequence: Synthetic peptide
  XENP021439 vhCDR1
DYYMH

SEQ ID NO: 27247 - protein, 17 aa, Artificial Sequence
  Description of Artificial Sequence: Synthetic peptide
  XENP021439 vhCDR2
WIDPENGDTEYAPKFQG

SEQ ID NO: 27248 - protein, 9 aa, Artificial Sequence
  Description of Artificial Sequence: Synthetic peptide
  XENP021439 vhCDR3
RGVRQALDY

SEQ ID NO: 27249 - protein, 214 aa, Artificial Sequence
  Description of Artificial Sequence: Synthetic polypeptide
  XENP021439 2A11_H1_L2.88_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27250 - protein, 107 aa, Artificial Sequence
  Description of Artificial Sequence: Synthetic polypeptide
  VL of XENP021439
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPRTFGGGTKVEIK

SEQ ID NO: 27251 - protein, 11 aa, Artificial Sequence
  Description of Artificial Sequence: Synthetic peptide
  XENP021439 vlCDR1
QASQDIGNYLN

SEQ ID NO: 27252 - protein, 7 aa, Artificial Sequence
  Description of Artificial Sequence: Synthetic peptide
  XENP021439 vlCDR2
YTSRLHS

SEQ ID NO: 27253 - protein, 9 aa, Artificial Sequence
  Description of Artificial Sequence: Synthetic peptide
  XENP021439 vlCDR3
QQGNTLPRT

SEQ ID NO: 27254 - protein, 223 aa, Artificial Sequence; identical to SEQ ID NO: 25194
  Description of Artificial Sequence: Synthetic polypeptide
  XENP021440 2A11_H1_L2.89_Fab Heavy Chain

SEQ ID NO: 27255 - protein, 118 aa, Artificial Sequence; identical to SEQ ID NO: 17236
  Description of Artificial Sequence: Synthetic polypeptide
  VH of XENP021440

SEQ ID NO: 27256 - protein, 5 aa, Artificial Sequence
  Description of Artificial Sequence: Synthetic peptide
  XENP021440 vhCDR1
DYYMH

SEQ ID NO: 27257 - protein, 17 aa, Artificial Sequence
  Description of Artificial Sequence: Synthetic peptide
  XENP021440 vhCDR2
WIDPENGDTEYAPKFQG

SEQ ID NO: 27258 - protein, 9 aa, Artificial Sequence
  Description of Artificial Sequence: Synthetic peptide
  XENP021440 vhCDR3
RGVRQALDY

SEQ ID NO: 27259 - protein, 214 aa, Artificial Sequence
  Description of Artificial Sequence: Synthetic polypeptide
  XENP021440 2A11_H1_L2.89_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPATFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27260 - protein, 107 aa, Artificial Sequence
  Description of Artificial Sequence: Synthetic polypeptide
  VL of XENP021440
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPATFGGGTKVEIK

SEQ ID NO: 27261 - protein, 11 aa, Artificial Sequence
  Description of Artificial Sequence: Synthetic peptide
  XENP021440 vlCDR1
QASQDIGNYLN

SEQ ID NO: 27262 - protein, 7 aa, Artificial Sequence
  Description of Artificial Sequence: Synthetic peptide
  XENP021440 vlCDR2
YTSRLHS

SEQ ID NO: 27263 - protein, 9 aa, Artificial Sequence
  Description of Artificial Sequence: Synthetic peptide
  XENP021440 vlCDR3
QQGNTLPAT

SEQ ID NO: 27264 - protein, 223 aa, Artificial Sequence; identical to SEQ ID NO: 25574
  Description of Artificial Sequence: Synthetic polypeptide
  XENP021606 2A11_H1.37_L2.35_Fab Heavy Chain

SEQ ID NO: 27265 - protein, 118 aa, Artificial Sequence; identical to SEQ ID NO: 25575
  Description of Artificial Sequence: Synthetic polypeptide
  VH of XENP021606

SEQ ID NO: 27266 - protein, 5 aa, Artificial Sequence
  Description of Artificial Sequence: Synthetic peptide
  XENP021606 vhCDR1
DYFMH

SEQ ID NO: 27267 - protein, 17 aa, Artificial Sequence
  Description of Artificial Sequence: Synthetic peptide
  XENP021606 vhCDR2
WIDPENGDTEYAPKFQG

SEQ ID NO: 27268 - protein, 9 aa, Artificial Sequence
  Description of Artificial Sequence: Synthetic peptide
  XENP021606 vhCDR3
RGVRQALDY

SEQ ID NO: 27269 - protein, 214 aa, Artificial Sequence; identical to SEQ ID NO: 26719
  Description of Artificial Sequence: Synthetic polypeptide
  XENP021606 2A11_H1.37_L2.35_Fab Light Chain

SEQ ID NO: 27270 - protein, 107 aa, Artificial Sequence; identical to SEQ ID NO: 26720
  Description of Artificial Sequence: Synthetic polypeptide
  VL of XENP021606

SEQ ID NO: 27271 - protein, 11 aa, Artificial Sequence
  Description of Artificial Sequence: Synthetic peptide
  XENP021606 vlCDR1
QASQDIGNYLN

SEQ ID NO: 27272 - protein, 7 aa, Artificial Sequence
  Description of Artificial Sequence: Synthetic peptide
  XENP021606 vlCDR2
FTSRLHS

SEQ ID NO: 27273 - protein, 9 aa, Artificial Sequence
  Description of Artificial Sequence: Synthetic peptide
  XENP021606 vlCDR3
QQGNTLPYT

SEQ ID NO: 27274 - protein, 223 aa, Artificial Sequence; identical to SEQ ID NO: 25574
  Description of Artificial Sequence: Synthetic polypeptide
  XENP021607 2A11_H1.37_L2.47_Fab Heavy Chain

SEQ ID NO: 27275 - protein, 118 aa, Artificial Sequence; identical to SEQ ID NO: 25575
  Description of Artificial Sequence: Synthetic polypeptide
  VH of XENP021607

SEQ ID NO: 27276 - protein, 5 aa, Artificial Sequence
  Description of Artificial Sequence: Synthetic peptide
  XENP021607 vhCDR1
DYFMH

SEQ ID NO: 27277 - protein, 17 aa, Artificial Sequence
  Description of Artificial Sequence: Synthetic peptide
  XENP021607 vhCDR2
WIDPENGDTEYAPKFQG

SEQ ID NO: 27278 - protein, 9 aa, Artificial Sequence
  Description of Artificial Sequence: Synthetic peptide
  XENP021607 vhCDR3
RGVRQALDY

SEQ ID NO: 27279 - protein, 214 aa, Artificial Sequence; identical to SEQ ID NO: 22039
  Description of Artificial Sequence: Synthetic polypeptide
  XENP021607 2A11_H1.37_L2.47_Fab Light Chain

SEQ ID NO: 27280 - protein, 107 aa, Artificial Sequence; identical to SEQ ID NO: 22040
  Description of Artificial Sequence: Synthetic polypeptide
  VL of XENP021607

SEQ ID NO: 27281 - protein, 11 aa, Artificial Sequence
  Description of Artificial Sequence: Synthetic peptide
  XENP021607 vlCDR1
QASQDIGNYLN

SEQ ID NO: 27282 - protein, 7 aa, Artificial Sequence
  Description of Artificial Sequence: Synthetic peptide
  XENP021607 vlCDR2
YTSHLHS

SEQ ID NO: 27283 - protein, 9 aa, Artificial Sequence
  Description of Artificial Sequence: Synthetic peptide
  XENP021607 vlCDR3
QQGNTLPYT

SEQ ID NO: 27284 - protein, 223 aa, Artificial Sequence; identical to SEQ ID NO: 25574
  Description of Artificial Sequence: Synthetic polypeptide
  XENP021608 2A11_H1.37_L2.50_Fab Heavy Chain

SEQ ID NO: 27285 - protein, 118 aa, Artificial Sequence; identical to SEQ ID NO: 25575
  Description of Artificial Sequence: Synthetic polypeptide
  VH of XENP021608

SEQ ID NO: 27286 - protein, 5 aa, Artificial Sequence
  Description of Artificial Sequence: Synthetic peptide
  XENP021608 vhCDR1
DYFMH

SEQ ID NO: 27287 - protein, 17 aa, Artificial Sequence
  Description of Artificial Sequence: Synthetic peptide
  XENP021608 vhCDR2
WIDPENGDTEYAPKFQG

SEQ ID NO: 27288 - protein, 9 aa, Artificial Sequence
  Description of Artificial Sequence: Synthetic peptide
  XENP021608 vhCDR3
RGVRQALDY

SEQ ID NO: 27289 - protein, 214 aa, Artificial Sequence; identical to SEQ ID NO: 22059
  Description of Artificial Sequence: Synthetic polypeptide
  XENP021608 2A11_H1.37_L2.50_Fab Light Chain

SEQ ID NO: 27290 - protein, 107 aa, Artificial Sequence; identical to SEQ ID NO: 22060
  Description of Artificial Sequence: Synthetic polypeptide
  VL of XENP021608

SEQ ID NO: 27291 - protein, 11 aa, Artificial Sequence
  Description of Artificial Sequence: Synthetic peptide
  XENP021608 vlCDR1
QASQDIGNYLN

SEQ ID NO: 27292 - protein, 7 aa, Artificial Sequence
  Description of Artificial Sequence: Synthetic peptide
  XENP021608 vlCDR2
YTSYLHS

SEQ ID NO: 27293 - protein, 9 aa, Artificial Sequence
  Description of Artificial Sequence: Synthetic peptide
  XENP021608 vlCDR3
QQGNTLPYT

SEQ ID NO: 27294 - protein, 223 aa, Artificial Sequence; identical to SEQ ID NO: 25844
  Description of Artificial Sequence: Synthetic polypeptide
  XENP021609 2A11_H1.64_L2.35_Fab Heavy Chain

SEQ ID NO: 27295 - protein, 118 aa, Artificial Sequence; identical to SEQ ID NO: 25845
  Description of Artificial Sequence: Synthetic polypeptide
  VH of XENP021609

SEQ ID NO: 27296 - protein, 5 aa, Artificial Sequence
  Description of Artificial Sequence: Synthetic peptide
  XENP021609 vhCDR1
DYYMH

SEQ ID NO: 27297 - protein, 17 aa, Artificial Sequence
  Description of Artificial Sequence: Synthetic peptide
  XENP021609 vhCDR2
WIDPYNGDTEYAPKFQG

SEQ ID NO: 27298 - protein, 9 aa, Artificial Sequence
  Description of Artificial Sequence: Synthetic peptide
  XENP021609 vhCDR3
RGVRQALDY

SEQ ID NO: 27299 - protein, 214 aa, Artificial Sequence; identical to SEQ ID NO: 26719
  Description of Artificial Sequence: Synthetic polypeptide
  XENP021609 2A11_H1.64_L2.35_Fab Light Chain

SEQ ID NO: 27300 - protein, 107 aa, Artificial Sequence; identical to SEQ ID NO: 26720
  Description of Artificial Sequence: Synthetic polypeptide
  VL of XENP021609

SEQ ID NO: 27301 - protein, 11 aa, Artificial Sequence
  Description of Artificial Sequence: Synthetic peptide
  XENP021609 vlCDR1
QASQDIGNYLN

SEQ ID NO: 27302 - protein, 7 aa, Artificial Sequence
  Description of Artificial Sequence: Synthetic peptide
  XENP021609 vlCDR2
FTSRLHS

SEQ ID NO: 27303 - protein, 9 aa, Artificial Sequence
  Description of Artificial Sequence: Synthetic peptide
  XENP021609 vlCDR3
QQGNTLPYT

SEQ ID NO: 27304 - protein, 223 aa, Artificial Sequence; identical to SEQ ID NO: 25844
  Description of Artificial Sequence: Synthetic polypeptide
  XENP021610 2A11_H1.64_L2.47_Fab Heavy Chain

SEQ ID NO: 27305 - protein, 118 aa, Artificial Sequence; identical to SEQ ID NO: 25845
  Description of Artificial Sequence: Synthetic polypeptide
  VH of XENP021610

SEQ ID NO: 27306 - protein, 5 aa, Artificial Sequence
  Description of Artificial Sequence: Synthetic peptide
  XENP021610 vhCDR1
DYYMH

SEQ ID NO: 27307 - protein, 17 aa, Artificial Sequence
  Description of Artificial Sequence: Synthetic peptide
  XENP021610 vhCDR2
WIDPYNGDTEYAPKFQG

SEQ ID NO: 27308 - protein, 9 aa, Artificial Sequence
  Description of Artificial Sequence: Synthetic peptide
  XENP021610 vhCDR3
RGVRQALDY

SEQ ID NO: 27309 - protein, 214 aa, Artificial Sequence; identical to SEQ ID NO: 22039
  Description of Artificial Sequence: Synthetic polypeptide
  XENP021610 2A11_H1.64_L2.47_Fab Light Chain

SEQ ID NO: 27310 - protein, 107 aa, Artificial Sequence; identical to SEQ ID NO: 22040
  Description of Artificial Sequence: Synthetic polypeptide
  VL of XENP021610

SEQ ID NO: 27311 - protein, 11 aa, Artificial Sequence
  Description of Artificial Sequence: Synthetic peptide
  XENP021610 vlCDR1
QASQDIGNYLN

SEQ ID NO: 27312 - protein, 7 aa, Artificial Sequence
  Description of Artificial Sequence: Synthetic peptide
  XENP021610 vlCDR2
YTSHLHS

SEQ ID NO: 27313 - protein, 9 aa, Artificial Sequence
  Description of Artificial Sequence: Synthetic peptide
  XENP021610 vlCDR3
QQGNTLPYT

SEQ ID NO: 27314 - protein, 223 aa, Artificial Sequence; identical to SEQ ID NO: 25844
  Description of Artificial Sequence: Synthetic polypeptide
  XENP021611 2A11_H1.64_L2.50_Fab Heavy Chain

SEQ ID NO: 27315 - protein, 118 aa, Artificial Sequence; identical to SEQ ID NO: 25845
  Description of Artificial Sequence: Synthetic polypeptide
  VH of XENP021611

SEQ ID NO: 27316 - protein, 5 aa, Artificial Sequence
  Description of Artificial Sequence: Synthetic peptide
  XENP021611 vhCDR1
DYYMH

SEQ ID NO: 27317 - protein, 17 aa, Artificial Sequence
  Description of Artificial Sequence: Synthetic peptide
  XENP021611 vhCDR2
WIDPYNGDTEYAPKFQG

SEQ ID NO: 27318 - protein, 9 aa, Artificial Sequence
  Description of Artificial Sequence: Synthetic peptide
  XENP021611 vhCDR3
RGVRQALDY

SEQ ID NO: 27319 - protein, 214 aa, Artificial Sequence; identical to SEQ ID NO: 22059
  Description of Artificial Sequence: Synthetic polypeptide
  XENP021611 2A11_H1.64_L2.50_Fab Light Chain

SEQ ID NO: 27320 - protein, 107 aa, Artificial Sequence; identical to SEQ ID NO: 22060
  Description of Artificial Sequence: Synthetic polypeptide
  VL of XENP021611

SEQ ID NO: 27321 - protein, 11 aa, Artificial Sequence
  Description of Artificial Sequence: Synthetic peptide
  XENP021611 vlCDR1
QASQDIGNYLN

SEQ ID NO: 27322 - protein, 7 aa, Artificial Sequence
  Description of Artificial Sequence: Synthetic peptide
  XENP021611 vlCDR2
YTSYLHS

SEQ ID NO: 27323 - protein, 9 aa, Artificial Sequence
  Description of Artificial Sequence: Synthetic peptide
  XENP021611 vlCDR3
QQGNTLPYT

SEQ ID NO: 27324 - protein, 223 aa, Artificial Sequence; identical to SEQ ID NO: 25904
  Description of Artificial Sequence: Synthetic polypeptide
  XENP021612 2A11_H1.70_L2.35_Fab Heavy Chain

SEQ ID NO: 27325 - protein, 118 aa, Artificial Sequence; identical to SEQ ID NO: 25905
  Description of Artificial Sequence: Synthetic polypeptide
  VH of XENP021612

SEQ ID NO: 27326 - protein, 5 aa, Artificial Sequence
  Description of Artificial Sequence: Synthetic peptide
  XENP021612 vhCDR1
DYYMH

SEQ ID NO: 27327 - protein, 17 aa, Artificial Sequence
  Description of Artificial Sequence: Synthetic peptide
  XENP021612 vhCDR2
WIDPELGDTEYAPKFQG

SEQ ID NO: 27328 - protein, 9 aa, Artificial Sequence
  Description of Artificial Sequence: Synthetic peptide
  XENP021612 vhCDR3
RGVRQALDY

SEQ ID NO: 27329 - protein, 214 aa, Artificial Sequence; identical to SEQ ID NO: 26719
  Description of Artificial Sequence: Synthetic polypeptide
  XENP021612 2A11_H1.70_L2.35_Fab Light Chain

SEQ ID NO: 27330 - protein, 107 aa, Artificial Sequence; identical to SEQ ID NO: 26720
  Description of Artificial Sequence: Synthetic polypeptide
  VL of XENP021612

SEQ ID NO: 27331 - protein, 11 aa, Artificial Sequence
  Description of Artificial Sequence: Synthetic peptide
  XENP021612 vlCDR1
QASQDIGNYLN

SEQ ID NO: 27332 - protein, 7 aa, Artificial Sequence
  Description of Artificial Sequence: Synthetic peptide
  XENP021612 vlCDR2
FTSRLHS

SEQ ID NO: 27333 - protein, 9 aa, Artificial Sequence
  Description of Artificial Sequence: Synthetic peptide
  XENP021612 vlCDR3
QQGNTLPYT

SEQ ID NO: 27334 - protein, 223 aa, Artificial Sequence; identical to SEQ ID NO: 25904
  Description of Artificial Sequence: Synthetic polypeptide
  XENP021613 2A11_H1.70_L2.47_Fab Heavy Chain

SEQ ID NO: 27335 - protein, 118 aa, Artificial Sequence; identical to SEQ ID NO: 25905
  Description of Artificial Sequence: Synthetic polypeptide
  VH of XENP021613

SEQ ID NO: 27336 - protein, 5 aa, Artificial Sequence
  Description of Artificial Sequence: Synthetic peptide
  XENP021613 vhCDR1
DYYMH

SEQ ID NO: 27337 - protein, 17 aa, Artificial Sequence
  Description of Artificial Sequence: Synthetic peptide
  XENP021613 vhCDR2
WIDPELGDTEYAPKFQG

SEQ ID NO: 27338 - protein, 9 aa, Artificial Sequence
  Description of Artificial Sequence: Synthetic peptide
  XENP021613 vhCDR3
RGVRQALDY

SEQ ID NO: 27339 - protein, 214 aa, Artificial Sequence; identical to SEQ ID NO: 22039
  Description of Artificial Sequence: Synthetic polypeptide
  XENP021613 2A11_H1.70_L2.47_Fab Light Chain

SEQ ID NO: 27340 - protein, 107 aa, Artificial Sequence; identical to SEQ ID NO: 22040
  Description of Artificial Sequence: Synthetic polypeptide
  VL of XENP021613

SEQ ID NO: 27341 - protein, 11 aa, Artificial Sequence
  Description of Artificial Sequence: Synthetic peptide
  XENP021613 vlCDR1
QASQDIGNYLN

SEQ ID NO: 27342 - protein, 7 aa, Artificial Sequence
  Description of Artificial Sequence: Synthetic peptide
  XENP021613 vlCDR2
YTSHLHS

SEQ ID NO: 27343 - protein, 9 aa, Artificial Sequence
  Description of Artificial Sequence: Synthetic peptide
  XENP021613 vlCDR3
QQGNTLPYT

SEQ ID NO: 27344 - protein, 223 aa, Artificial Sequence; identical to SEQ ID NO: 25904
  Description of Artificial Sequence: Synthetic polypeptide
  XENP021614 2A11_H1.70_L2.50_Fab Heavy Chain

SEQ ID NO: 27345 - protein, 118 aa, Artificial Sequence; identical to SEQ ID NO: 25905
  Description of Artificial Sequence: Synthetic polypeptide
  VH of XENP021614

SEQ ID NO: 27346 - protein, 5 aa, Artificial Sequence
  Description of Artificial Sequence: Synthetic peptide
  XENP021614 vhCDR1
DYYMH

SEQ ID NO: 27347 - protein, 17 aa, Artificial Sequence
  Description of Artificial Sequence: Synthetic peptide
  XENP021614 vhCDR2
WIDPELGDTEYAPKFQG

SEQ ID NO: 27348 - protein, 9 aa, Artificial Sequence
  Description of Artificial Sequence: Synthetic peptide
  XENP021614 vhCDR3
RGVRQALDY

SEQ ID NO: 27349 - protein, 214 aa, Artificial Sequence; identical to SEQ ID NO: 22059
  Description of Artificial Sequence: Synthetic polypeptide
  XENP021614 2A11_H1.70_L2.50_Fab Light Chain

SEQ ID NO: 27350 - protein, 107 aa, Artificial Sequence; identical to SEQ ID NO: 22060
  Description of Artificial Sequence: Synthetic polypeptide
  VL of XENP021614

SEQ ID NO: 27351 - protein, 11 aa, Artificial Sequence
  Description of Artificial Sequence: Synthetic peptide
  XENP021614 vlCDR1
QASQDIGNYLN

SEQ ID NO: 27352 - protein, 7 aa, Artificial Sequence
  Description of Artificial Sequence: Synthetic peptide
  XENP021614 vlCDR2
YTSYLHS

SEQ ID NO: 27353 - protein, 9 aa, Artificial Sequence
  Description of Artificial Sequence: Synthetic peptide
  XENP021614 vlCDR3
QQGNTLPYT

SEQ ID NO: 27354 - protein, 223 aa, Artificial Sequence; identical to SEQ ID NO: 26254
  Description of Artificial Sequence: Synthetic polypeptide
  XENP021615 2A11_H1.105_L2.35_Fab Heavy Chain

SEQ ID NO: 27355 - protein, 118 aa, Artificial Sequence; identical to SEQ ID NO: 26255
  Description of Artificial Sequence: Synthetic polypeptide
  VH of XENP021615

SEQ ID NO: 27356 - protein, 5 aa, Artificial Sequence
  Description of Artificial Sequence: Synthetic peptide
  XENP021615 vhCDR1
DYYMH

SEQ ID NO: 27357 - protein, 17 aa, Artificial Sequence
  Description of Artificial Sequence: Synthetic peptide
  XENP021615 vhCDR2
WIDPENGDTEYAPKFQG

SEQ ID NO: 27358 - protein, 9 aa, Artificial Sequence
  Description of Artificial Sequence: Synthetic peptide
  XENP021615 vhCDR3
RGVYQALDY

SEQ ID NO: 27359 - protein, 214 aa, Artificial Sequence; identical to SEQ ID NO: 26719
  Description of Artificial Sequence: Synthetic polypeptide
  XENP021615 2A11_H1.105_L2.35_Fab Light Chain

SEQ ID NO: 27360 - protein, 107 aa, Artificial Sequence; identical to SEQ ID NO: 26720
  Description of Artificial Sequence: Synthetic polypeptide
  VL of XENP021615

SEQ ID NO: 27361 - protein, 11 aa, Artificial Sequence
  Description of Artificial Sequence: Synthetic peptide
  XENP021615 vlCDR1
QASQDIGNYLN

SEQ ID NO: 27362 - protein, 7 aa, Artificial Sequence
  Description of Artificial Sequence: Synthetic peptide
  XENP021615 vlCDR2
FTSRLHS

SEQ ID NO: 27363 - protein, 9 aa, Artificial Sequence
  Description of Artificial Sequence: Synthetic peptide
  XENP021615 vlCDR3
QQGNTLPYT

SEQ ID NO: 27364 - protein, 223 aa, Artificial Sequence; identical to SEQ ID NO: 26254
  Description of Artificial Sequence: Synthetic polypeptide
  XENP021616 2A11_H1.105_L2.47_Fab Heavy Chain

SEQ ID NO: 27365 - protein, 118 aa, Artificial Sequence; identical to SEQ ID NO: 26255
  Description of Artificial Sequence: Synthetic polypeptide
  VH of XENP021616

SEQ ID NO: 27366 - protein, 5 aa, Artificial Sequence
  Description of Artificial Sequence: Synthetic peptide
  XENP021616 vhCDR1
DYYMH

SEQ ID NO: 27367 - protein, 17 aa, Artificial Sequence
  Description of Artificial Sequence: Synthetic peptide
  XENP021616 vhCDR2
WIDPENGDTEYAPKFQG

SEQ ID NO: 27368 - protein, 9 aa, Artificial Sequence
  Description of Artificial Sequence: Synthetic peptide
  XENP021616 vhCDR3
RGVYQALDY

SEQ ID NO: 27369 - protein, 214 aa, Artificial Sequence; identical to SEQ ID NO: 22039
  Description of Artificial Sequence: Synthetic polypeptide
  XENP021616 2A11_H1.105_L2.47_Fab Light Chain

SEQ ID NO: 27370 - protein, 107 aa, Artificial Sequence; identical to SEQ ID NO: 22040
  Description of Artificial Sequence: Synthetic polypeptide
  VL of XENP021616

SEQ ID NO: 27371 - protein, 11 aa, Artificial Sequence
  Description of Artificial Sequence: Synthetic peptide
  XENP021616 vlCDR1
QASQDIGNYLN

SEQ ID NO: 27372 - protein, 7 aa, Artificial Sequence
  Description of Artificial Sequence: Synthetic peptide
  XENP021616 vlCDR2
YTSHLHS

SEQ ID NO: 27373 - protein, 9 aa, Artificial Sequence
  Description of Artificial Sequence: Synthetic peptide
  XENP021616 vlCDR3
QQGNTLPYT

SEQ ID NO: 27374 - protein, 223 aa, Artificial Sequence; identical to SEQ ID NO: 26254
  Description of Artificial Sequence: Synthetic polypeptide
  XENP021617 2A11_H1.105_L2.50_Fab Heavy Chain

SEQ ID NO: 27375 - protein, 118 aa, Artificial Sequence; identical to SEQ ID NO: 26255
  Description of Artificial Sequence: Synthetic polypeptide
  VH of XENP021617

SEQ ID NO: 27376 - protein, 5 aa, Artificial Sequence
  Description of Artificial Sequence: Synthetic peptide
  XENP021617 vhCDR1
DYYMH

SEQ ID NO: 27377 - protein, 17 aa, Artificial Sequence
  Description of Artificial Sequence: Synthetic peptide
  XENP021617 vhCDR2
WIDPENGDTEYAPKFQG

SEQ ID NO: 27378 - protein, 9 aa, Artificial Sequence
  Description of Artificial Sequence: Synthetic peptide
  XENP021617 vhCDR3
RGVYQALDY

SEQ ID NO: 27379 - protein, 214 aa, Artificial Sequence; identical to SEQ ID NO: 22059
  Description of Artificial Sequence: Synthetic polypeptide
  XENP021617 2A11_H1.105_L2.50_Fab Light Chain

SEQ ID NO: 27380 - protein, 107 aa, Artificial Sequence; identical to SEQ ID NO: 22060
  Description of Artificial Sequence: Synthetic polypeptide
  VL of XENP021617

SEQ ID NO: 27381 - protein, 11 aa, Artificial Sequence
  Description of Artificial Sequence: Synthetic peptide
  XENP021617 vlCDR1
QASQDIGNYLN

SEQ ID NO: 27382 - protein, 7 aa, Artificial Sequence
  Description of Artificial Sequence: Synthetic peptide
  XENP021617 vlCDR2
YTSYLHS

SEQ ID NO: 27383 - protein, 9 aa, Artificial Sequence
  Description of Artificial Sequence: Synthetic peptide
  XENP021617 vlCDR3
QQGNTLPYT

SEQ ID NO: 27384 - protein, 223 aa, Artificial Sequence
  Description of Artificial Sequence: Synthetic polypeptide
  XENP021705 2A11_H1.117_L2_Fab Heavy Chain
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27385 - protein, 118 aa, Artificial Sequence; identical to SEQ ID NO: 22105
  Description of Artificial Sequence: Synthetic polypeptide
  VH of XENP021705

SEQ ID NO: 27386 - protein, 5 aa, Artificial Sequence
  Description of Artificial Sequence: Synthetic peptide
  XENP021705 vhCDR1
HYFMH

SEQ ID NO: 27387 - protein, 17 aa, Artificial Sequence
  Description of Artificial Sequence: Synthetic peptide
  XENP021705 vhCDR2
WIDPYLGDTEYAPKFQG

SEQ ID NO: 27388 - protein, 9 aa, Artificial Sequence
  Description of Artificial Sequence: Synthetic peptide
  XENP021705 vhCDR3
RGVRQALDY

SEQ ID NO: 27389 - protein, 214 aa, Artificial Sequence; identical to SEQ ID NO: 17250
  Description of Artificial Sequence: Synthetic polypeptide
  XENP021705 2A11_H1.117_L2_Fab Light Chain

SEQ ID NO: 27390 - protein, 107 aa, Artificial Sequence; identical to SEQ ID NO: 17251
  Description of Artificial Sequence: Synthetic polypeptide
  VL of XENP021705

SEQ ID NO: 27391 - protein, 11 aa, Artificial Sequence
  Description of Artificial Sequence: Synthetic peptide
  XENP021705 vlCDR1
QASQDIGNYLN

SEQ ID NO: 27392 - protein, 7 aa, Artificial Sequence
  Description of Artificial Sequence: Synthetic peptide
  XENP021705 vlCDR2
YTSRLHS

SEQ ID NO: 27393 - protein, 9 aa, Artificial Sequence
  Description of Artificial Sequence: Synthetic peptide
  XENP021705 vlCDR3
QQGNTLPYT

SEQ ID NO: 27394 - protein, 223 aa, Artificial Sequence
  Description of Artificial Sequence: Synthetic polypeptide
  XENP021706 2A11_H1.118_L2_Fab Heavy Chain
EVQLVQSGAEVKKPGATVKISCKASGFNIKHYFMHWVQQAPGKGLEWMGWIDPYTGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27395 - protein, 118 aa, Artificial Sequence
  Description of Artificial Sequence: Synthetic polypeptide
  VH of XENP021706
EVQLVQSGAEVKKPGATVKISCKASGFNIKHYFMHWVQQAPGKGLEWMGWIDPYTGDTEYAPKFQGRVTITADTSTNTAYMELSSLRSEDTAVYYCYARGVRQALDYWGQGTLVTVSS

SEQ ID NO: 27396 - protein, 5 aa, Artificial Sequence
  Description of Artificial Sequence: Synthetic peptide
  XENP021706 vhCDR1
HYFMH

SEQ ID NO: 27397 - protein, 17 aa, Artificial Sequence
  Description of Artificial Sequence: Synthetic peptide
  XENP021706 vhCDR2
WIDPYTGDTEYAPKFQG

SEQ ID NO: 27398 - protein, 9 aa, Artificial Sequence
  Description of Artificial Sequence: Synthetic peptide
  XENP021706 vhCDR3
RGVRQALDY

SEQ ID NO: 27399 - protein, 214 aa, Artificial Sequence; identical to SEQ ID NO: 17250
  Description of Artificial Sequence: Synthetic polypeptide
  XENP021706 2A11_H1.118_L2_Fab Light Chain

SEQ ID NO: 27400 - protein, 107 aa, Artificial Sequence; identical to SEQ ID NO: 17251
  Description of Artificial Sequence: Synthetic polypeptide
  VL of XENP021706

SEQ ID NO: 27401 - protein, 11 aa, Artificial Sequence
  Description of Artificial Sequence: Synthetic peptide
  XENP021706 vlCDR1
QASQDIGNYLN

SEQ ID NO: 27402 - protein, 7 aa, Artificial Sequence
  Description of Artificial Sequence: Synthetic peptide
  XENP021706 vlCDR2
YTSRLHS

SEQ ID NO: 27403 - protein, 9 aa, Artificial Sequence
  Description of Artificial Sequence: Synthetic peptide
  XENP021706 vlCDR3
QQGNTLPYT

SEQ ID NO: 27404 - protein, 223 aa, Artificial Sequence
  Description of Artificial Sequence: Synthetic polypeptide
  XENP021707 2A11_H1.119_L2_Fab Heavy Chain
EVQLVQSGAEVKKPGATVKISCKASGFNIKHYFMHWVQQAPGKGLEWMGWIDPELGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27405 - protein, 118 aa, Artificial Sequence
  Description of Artificial Sequence: Synthetic polypeptide
  VH of XENP021707
EVQLVQSGAEVKKPGATVKISCKASGFNIKHYFMHWVQQAPGKGLEWMGWIDPELGDTEYAPKFQGRVTITADTSTNTAYMELSSLRSEDTAVYYCYARGVRQALDYWGQGTLVTVSS

SEQ ID NO: 27406 - protein, 5 aa, Artificial Sequence
  Description of Artificial Sequence: Synthetic peptide
  XENP021707 vhCDR1
HYFMH

SEQ ID NO: 27407 - protein, 17 aa, Artificial Sequence
  Description of Artificial Sequence: Synthetic peptide
  XENP021707 vhCDR2
WIDPELGDTEYAPKFQG

SEQ ID NO: 27408 - protein, 9 aa, Artificial Sequence
  Description of Artificial Sequence: Synthetic peptide
  XENP021707 vhCDR3
RGVRQALDY

SEQ ID NO: 27409 - protein, 214 aa, Artificial Sequence; identical to SEQ ID NO: 17250
  Description of Artificial Sequence: Synthetic polypeptide
  XENP021707 2A11_H1.119_L2_Fab Light Chain

SEQ ID NO: 27410 - protein, 107 aa, Artificial Sequence; identical to SEQ ID NO: 17251
  Description of Artificial Sequence: Synthetic polypeptide
  VL of XENP021707

SEQ ID NO: 27411 - protein, 11 aa, Artificial Sequence
  Description of Artificial Sequence: Synthetic peptide
  XENP021707 vlCDR1
QASQDIGNYLN

SEQ ID NO: 27412 - protein, 7 aa, Artificial Sequence
  Description of Artificial Sequence: Synthetic peptide
  XENP021707 vlCDR2
YTSRLHS

SEQ ID NO: 27413 - protein, 9 aa, Artificial Sequence
  Description of Artificial Sequence: Synthetic peptide
  XENP021707 vlCDR3
QQGNTLPYT

SEQ ID NO: 27414 - protein, 223 aa, Artificial Sequence
  Description of Artificial Sequence: Synthetic polypeptide
  XENP021708 2A11_H1.120_L2_Fab Heavy Chain
EVQLVQSGAEVKKPGATVKISCKASGFNIKHYFMHWVQQAPGKGLEWMGWIDPETGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27415 - protein, 118 aa, Artificial Sequence
  Description of Artificial Sequence: Synthetic polypeptide
  VH of XENP021708
EVQLVQSGAEVKKPGATVKISCKASGFNIKHYFMHWVQQAPGKGLEWMGWIDPETGDTEYAPKFQGRVTITADTSTNTAYMELSSLRSEDTAVYYCYARGVRQALDYWGQGTLVTVSS

SEQ ID NO: 27416 - protein, 5 aa, Artificial Sequence
  Description of Artificial Sequence: Synthetic peptide
  XENP021708 vhCDR1
HYFMH

SEQ ID NO: 27417 - protein, 17 aa, Artificial Sequence
  Description of Artificial Sequence: Synthetic peptide
  XENP021708 vhCDR2
WIDPETGDTEYAPKFQG

SEQ ID NO: 27418 - protein, 9 aa, Artificial Sequence
  Description of Artificial Sequence: Synthetic peptide
  XENP021708 vhCDR3
RGVRQALDY

SEQ ID NO: 27419 - protein, 214 aa, Artificial Sequence; identical to SEQ ID NO: 17250
  Description of Artificial Sequence: Synthetic polypeptide
  XENP021708 2A11_H1.120_L2_Fab Light Chain

SEQ ID NO: 27420 - protein, 107 aa, Artificial Sequence; identical to SEQ ID NO: 17251
  Description of Artificial Sequence: Synthetic polypeptide
  VL of XENP021708

SEQ ID NO: 27421 - protein, 11 aa, Artificial Sequence
  Description of Artificial Sequence: Synthetic peptide
  XENP021708 vlCDR1
QASQDIGNYLN

SEQ ID NO: 27422 - protein, 7 aa, Artificial Sequence
  Description of Artificial Sequence: Synthetic peptide
  XENP021708 vlCDR2
YTSRLHS

SEQ ID NO: 27423 - protein, 9 aa, Artificial Sequence
  Description of Artificial Sequence: Synthetic peptide
  XENP021708 vlCDR3
QQGNTLPYT

SEQ ID NO: 27424 - protein, 223 aa, Artificial Sequence
  Description of Artificial Sequence: Synthetic polypeptide
  XENP021709 2A11_H1.121_L2_Fab Heavy Chain
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27425 - protein, 118 aa, Artificial Sequence
  Description of Artificial Sequence: Synthetic polypeptide
  VH of XENP021709
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVKQALDYWGQGTLVTVSS

SEQ ID NO: 27426 - protein, 5 aa, Artificial Sequence
  Description of Artificial Sequence: Synthetic peptide
  XENP021709 vhCDR1
HYFMH

SEQ ID NO: 27427 - protein, 17 aa, Artificial Sequence
  Description of Artificial Sequence: Synthetic peptide
  XENP021709 vhCDR2
WIDPYLGDTEYAPKFQG

SEQ ID NO: 27428 - protein, 9 aa, Artificial Sequence
  Description of Artificial Sequence: Synthetic peptide
  XENP021709 vhCDR3
RGVKQALDY

SEQ ID NO: 27429 - protein, 214 aa, Artificial Sequence; identical to SEQ ID NO: 17250
  Description of Artificial Sequence: Synthetic polypeptide
  XENP021709 2A11_H1.121_L2_Fab Light Chain

SEQ ID NO: 27430 - protein, 107 aa, Artificial Sequence; identical to SEQ ID NO: 17251
  Description of Artificial Sequence: Synthetic polypeptide
  VL of XENP021709

SEQ ID NO: 27431 - protein, 11 aa, Artificial Sequence
  Description of Artificial Sequence: Synthetic peptide
  XENP021709 vlCDR1
QASQDIGNYLN

SEQ ID NO: 27432 - protein, 7 aa, Artificial Sequence
  Description of Artificial Sequence: Synthetic peptide
  XENP021709 vlCDR2
YTSRLHS

SEQ ID NO: 27433 - protein, 9 aa, Artificial Sequence
  Description of Artificial Sequence: Synthetic peptide
  XENP021709 vlCDR3
QQGNTLPYT

SEQ ID NO: 27434 - protein, 223 aa, Artificial Sequence
  Description of Artificial Sequence: Synthetic polypeptide
  XENP021710 2A11_H1.122_L2_Fab Heavy Chain
EVQLVQSGAEVKKPGATVKISCKASGFNIKHYFMHWVQQAPGKGLEWMGWIDPYTGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27435 - protein, 118 aa, Artificial Sequence
  Description of Artificial Sequence: Synthetic polypeptide
  VH of XENP021710
EVQLVQSGAEVKKPGATVKISCKASGFNIKHYFMHWVQQAPGKGLEWMGWIDPYTGDTEYAPKFQGRVTITADTSTNTAYMELSSLRSEDTAVYYCYARGVKQALDYWGQGTLVTVSS

SEQ ID NO: 27436 - protein, 5 aa, Artificial Sequence
  Description of Artificial Sequence: Synthetic peptide
  XENP021710 vhCDR1
HYFMH

SEQ ID NO: 27437 - protein, 17 aa, Artificial Sequence
  Description of Artificial Sequence: Synthetic peptide
  XENP021710 vhCDR2
WIDPYTGDTEYAPKFQG

SEQ ID NO: 27438 - protein, 9 aa, Artificial Sequence
  Description of Artificial Sequence: Synthetic peptide
  XENP021710 vhCDR3
RGVKQALDY

SEQ ID NO: 27439 - protein, 214 aa, Artificial Sequence; identical to SEQ ID NO: 17250
  Description of Artificial Sequence: Synthetic polypeptide
  XENP021710 2A11_H1.122_L2_Fab Light Chain

SEQ ID NO: 27440 - protein, 107 aa, Artificial Sequence; identical to SEQ ID NO: 17251
  Description of Artificial Sequence: Synthetic polypeptide
  VL of XENP021710

SEQ ID NO: 27441 - protein, 11 aa, Artificial Sequence
  Description of Artificial Sequence: Synthetic peptide
  XENP021710 vlCDR1
QASQDIGNYLN

SEQ ID NO: 27442 - protein, 7 aa, Artificial Sequence
  Description of Artificial Sequence: Synthetic peptide
  XENP021710 vlCDR2
YTSRLHS

SEQ ID NO: 27443 - protein, 9 aa, Artificial Sequence
  Description of Artificial Sequence: Synthetic peptide
  XENP021710 vlCDR3
QQGNTLPYT

SEQ ID NO: 27444 - protein, 223 aa, Artificial Sequence
  Description of Artificial Sequence: Synthetic polypeptide
  XENP021711 2A11_H1.123_L2_Fab Heavy Chain
EVQLVQSGAEVKKPGATVKISCKASGFNIKHYFMHWVQQAPGKGLEWMGWIDPELGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27445 - protein, 118 aa, Artificial Sequence
  Description of Artificial Sequence: Synthetic polypeptide
  VH of XENP021711
EVQLVQSGAEVKKPGATVKISCKASGFNIKHYFMHWVQQAPGKGLEWMGWIDPELGDTEYAPKFQGRVTITADTSTNTAYMELSSLRSEDTAVYYCYARGVKQALDYWGQGTLVTVSS

SEQ ID NO: 27446 - protein, 5 aa, Artificial Sequence
  Description of Artificial Sequence: Synthetic peptide
  XENP021711 vhCDR1
HYFMH

SEQ ID NO: 27447 - protein, 17 aa, Artificial Sequence
  Description of Artificial Sequence: Synthetic peptide
  XENP021711 vhCDR2
WIDPELGDTEYAPKFQG

SEQ ID NO: 27448 - protein, 9 aa, Artificial Sequence
  Description of Artificial Sequence: Synthetic peptide
  XENP021711 vhCDR3
RGVKQALDY

SEQ ID NO: 27449 - protein, 214 aa, Artificial Sequence; identical to SEQ ID NO: 17250
  Description of Artificial Sequence: Synthetic polypeptide
  XENP021711 2A11_H1.123_L2_Fab Light Chain

SEQ ID NO: 27450 - protein, 107 aa, Artificial Sequence; identical to SEQ ID NO: 17251
  Description of Artificial Sequence: Synthetic polypeptide
  VL of XENP021711

SEQ ID NO: 27451 - protein, 11 aa, Artificial Sequence
  Description of Artificial Sequence: Synthetic peptide
  XENP021711 vlCDR1
QASQDIGNYLN

SEQ ID NO: 27452 - protein, 7 aa, Artificial Sequence
  Description of Artificial Sequence: Synthetic peptide
  XENP021711 vlCDR2
YTSRLHS

SEQ ID NO: 27453 - protein, 9 aa, Artificial Sequence
  Description of Artificial Sequence: Synthetic peptide
  XENP021711 vlCDR3
QQGNTLPYT

SEQ ID NO: 27454 - protein, 223 aa, Artificial Sequence
  Description of Artificial Sequence: Synthetic polypeptide
  XENP021712 2A11_H1.124_L2_Fab Heavy Chain
EVQLVQSGAEVKKPGATVKISCKASGFNIKHYFMHWVQQAPGKGLEWMGWIDPETGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27455 - protein, 118 aa, Artificial Sequence
  Description of Artificial Sequence: Synthetic polypeptide
  VH of XENP021712
EVQLVQSGAEVKKPGATVKISCKASGFNIKHYFMHWVQQAPGKGLEWMGWIDPETGDTEYAPKFQGRVTITADTSTNTAYMELSSLRSEDTAVYYCYARGVKQALDYWGQGTLVTVSS

SEQ ID NO: 27456 - protein, 5 aa, Artificial Sequence
  Description of Artificial Sequence: Synthetic peptide
  XENP021712 vhCDR1
HYFMH

SEQ ID NO: 27457 - protein, 17 aa, Artificial Sequence
  Description of Artificial Sequence: Synthetic peptide
  XENP021712 vhCDR2
WIDPETGDTEYAPKFQG

SEQ ID NO: 27458 - protein, 9 aa, Artificial Sequence
  Description of Artificial Sequence: Synthetic peptide
  XENP021712 vhCDR3
RGVKQALDY

SEQ ID NO: 27459 - protein, 214 aa, Artificial Sequence; identical to SEQ ID NO: 17250
  Description of Artificial Sequence: Synthetic polypeptide
  XENP021712 2A11_H1.124_L2_Fab Light Chain

SEQ ID NO: 27460 - protein, 107 aa, Artificial Sequence; identical to SEQ ID NO: 17251
  Description of Artificial Sequence: Synthetic polypeptide
  VL of XENP021712

SEQ ID NO: 27461 - protein, 11 aa, Artificial Sequence
  Description of Artificial Sequence: Synthetic peptide
  XENP021712 vlCDR1
QASQDIGNYLN

SEQ ID NO: 27462 - protein, 7 aa, Artificial Sequence
  Description of Artificial Sequence: Synthetic peptide
  XENP021712 vlCDR2
YTSRLHS

SEQ ID NO: 27463 - protein, 9 aa, Artificial Sequence
  Description of Artificial Sequence: Synthetic peptide
  XENP021712 vlCDR3
QQGNTLPYT

SEQ ID NO: 27464 - protein, 223 aa, Artificial Sequence
  Description of Artificial Sequence: Synthetic polypeptide
  XENP021713 2A11_H1.126_L2_Fab Heavy Chain
EVQLVQSGAEVKKPGATVKISCKASGFNIKHYFMHWVQQAPGKGLEWMGWIDPYTGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27465 - protein, 118 aa, Artificial Sequence
  Description of Artificial Sequence: Synthetic polypeptide
  VH of XENP021713
EVQLVQSGAEVKKPGATVKISCKASGFNIKHYFMHWVQQAPGKGLEWMGWIDPYTGDTEYAPKFQGRVTITADTSTNTAYMELSSLRSEDTAVYYCYARGVYQALDYWGQGTLVTVSS

SEQ ID NO: 27466 - protein, 5 aa, Artificial Sequence
  Description of Artificial Sequence: Synthetic peptide
  XENP021713 vhCDR1
HYFMH

SEQ ID NO: 27467 - protein, 17 aa, Artificial Sequence
  Description of Artificial Sequence: Synthetic peptide
  XENP021713 vhCDR2
WIDPYTGDTEYAPKFQG

SEQ ID NO: 27468 - protein, 9 aa, Artificial Sequence
  Description of Artificial Sequence: Synthetic peptide
  XENP021713 vhCDR3
RGVYQALDY

SEQ ID NO: 27469 - protein, 214 aa, Artificial Sequence; identical to SEQ ID NO: 17250
  Description of Artificial Sequence: Synthetic polypeptide
  XENP021713 2A11_H1.126_L2_Fab Light Chain

SEQ ID NO: 27470 - protein, 107 aa, Artificial Sequence; identical to SEQ ID NO: 17251
  Description of Artificial Sequence: Synthetic polypeptide
  VL of XENP021713

SEQ ID NO: 27471 - protein, 11 aa, Artificial Sequence
  Description of Artificial Sequence: Synthetic peptide
  XENP021713 vlCDR1
QASQDIGNYLN

SEQ ID NO: 27472 - protein, 7 aa, Artificial Sequence
  Description of Artificial Sequence: Synthetic peptide
  XENP021713 vlCDR2
YTSRLHS

SEQ ID NO: 27473 - protein, 9 aa, Artificial Sequence
  Description of Artificial Sequence: Synthetic peptide
  XENP021713 vlCDR3
QQGNTLPYT

SEQ ID NO: 27474 - protein, 223 aa, Artificial Sequence
  Description of Artificial Sequence: Synthetic polypeptide
  XENP021714 2A11_H1.128_L2_Fab Heavy Chain
EVQLVQSGAEVKKPGATVKISCKASGFNIKHYFMHWVQQAPGKGLEWMGWIDPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27475 - protein, 118 aa, Artificial Sequence
  Description of Artificial Sequence: Synthetic polypeptide
  VH of XENP021714
EVQLVQSGAEVKKPGATVKISCKASGFNIKHYFMHWVQQAPGKGLEWMGWIDPELGDTEYAPKFQGRVTITADTSTNTAYMELSSLRSEDTAVYYCYARGVYQALDYWGQGTLVTVSS

SEQ ID NO: 27476 - protein, 5 aa, Artificial Sequence
  Description of Artificial Sequence: Synthetic peptide
  XENP021714 vhCDR1
HYFMH

SEQ ID NO: 27477 - protein, 17 aa, Artificial Sequence
  Description of Artificial Sequence: Synthetic peptide
  XENP021714 vhCDR2
WIDPELGDTEYAPKFQG

SEQ ID NO: 27478 - protein, 9 aa, Artificial Sequence
  Description of Artificial Sequence: Synthetic peptide
  XENP021714 vhCDR3
RGVYQALDY

SEQ ID NO: 27479 - protein, 214 aa, Artificial Sequence; identical to SEQ ID NO: 17250
  Description of Artificial Sequence: Synthetic polypeptide
  XENP021714 2A11_H1.128_L2_Fab Light Chain

SEQ ID NO: 27480 - protein, 107 aa, Artificial Sequence; identical to SEQ ID NO: 17251
  Description of Artificial Sequence: Synthetic polypeptide
  VL of XENP021714

SEQ ID NO: 27481 - protein, 11 aa, Artificial Sequence
  Description of Artificial Sequence: Synthetic peptide
  XENP021714 vlCDR1
QASQDIGNYLN

SEQ ID NO: 27482 - protein, 7 aa, Artificial Sequence
  Description of Artificial Sequence: Synthetic peptide
  XENP021714 vlCDR2
YTSRLHS

SEQ ID NO: 27483 - protein, 9 aa, Artificial Sequence
  Description of Artificial Sequence: Synthetic peptide
  XENP021714 vlCDR3
QQGNTLPYT

SEQ ID NO: 27484 - protein, 223 aa, Artificial Sequence
  Description of Artificial Sequence: Synthetic polypeptide
  XENP021715 2A11_H1.129_L2_Fab Heavy Chain
EVQLVQSGAEVKKPGATVKISCKASGFNIKHYYMHWVQQAPGKGLEWMGWIDPELGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27485 - protein, 118 aa, Artificial Sequence
  Description of Artificial Sequence: Synthetic polypeptide
  VH of XENP021715
EVQLVQSGAEVKKPGATVKISCKASGFNIKHYYMHWVQQAPGKGLEWMGWIDPELGDTEYAPKFQGRVTITADTSTNTAYMELSSLRSEDTAVYYCYARGVRQALDYWGQGTLVTVSS

SEQ ID NO: 27486 - protein, 5 aa, Artificial Sequence
  Description of Artificial Sequence: Synthetic peptide
  XENP021715 vhCDR1
HYYMH

SEQ ID NO: 27487 - protein, 17 aa, Artificial Sequence
  Description of Artificial Sequence: Synthetic peptide
  XENP021715 vhCDR2
WIDPELGDTEYAPKFQG

SEQ ID NO: 27488 - protein, 9 aa, Artificial Sequence
  Description of Artificial Sequence: Synthetic peptide
  XENP021715 vhCDR3
RGVRQALDY

SEQ ID NO: 27489 - protein, 214 aa, Artificial Sequence; identical to SEQ ID NO: 17250
  Description of Artificial Sequence: Synthetic polypeptide
  XENP021715 2A11_H1.129_L2_Fab Light Chain

SEQ ID NO: 27490 - protein, 107 aa, Artificial Sequence; identical to SEQ ID NO: 17251
  Description of Artificial Sequence: Synthetic polypeptide
  VL of XENP021715

SEQ ID NO: 27491 - protein, 11 aa, Artificial Sequence
  Description of Artificial Sequence: Synthetic peptide
  XENP021715 vlCDR1
QASQDIGNYLN

SEQ ID NO: 27492 - protein, 7 aa, Artificial Sequence
  Description of Artificial Sequence: Synthetic peptide
  XENP021715 vlCDR2
YTSRLHS

SEQ ID NO: 27493 - protein, 9 aa, Artificial Sequence
  Description of Artificial Sequence: Synthetic peptide
  XENP021715 vlCDR3
QQGNTLPYT

SEQ ID NO: 27494 - protein, 223 aa, Artificial Sequence
  Description of Artificial Sequence: Synthetic polypeptide
  XENP021716 2A11_H1.130_L2_Fab Heavy Chain
EVQLVQSGAEVKKPGATVKISCKASGFNIKHYYMHWVQQAPGKGLEWMGWIDPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27495 - protein, 118 aa, Artificial Sequence
  Description of Artificial Sequence: Synthetic polypeptide
  VH of XENP021716
EVQLVQSGAEVKKPGATVKISCKASGFNIKHYYMHWVQQAPGKGLEWMGWIDPELGDTEYAPKFQGRVTITADTSTNTAYMELSSLRSEDTAVYYCYARGVYQALDYWGQGTLVTVSS

SEQ ID NO: 27496 - protein, 5 aa, Artificial Sequence
  Description of Artificial Sequence: Synthetic peptide
  XENP021716 vhCDR1
HYYMH

SEQ ID NO: 27497 - protein, 17 aa, Artificial Sequence
  Description of Artificial Sequence: Synthetic peptide
  XENP021716 vhCDR2
WIDPELGDTEYAPKFQG

SEQ ID NO: 27498 - protein, 9 aa, Artificial Sequence
  Description of Artificial Sequence: Synthetic peptide
  XENP021716 vhCDR3
RGVYQALDY

SEQ ID NO: 27499 - protein, 214 aa, Artificial Sequence; identical to SEQ ID NO: 17250
  Description of Artificial Sequence: Synthetic polypeptide
  XENP021716 2A11_H1.130_L2_Fab Light Chain

SEQ ID NO: 27500 - protein, 107 aa, Artificial Sequence; identical to SEQ ID NO: 17251
  Description of Artificial Sequence: Synthetic polypeptide
  VL of XENP021716

SEQ ID NO: 27501 - protein, 11 aa, Artificial Sequence
  Description of Artificial Sequence: Synthetic peptide
  XENP021716 vlCDR1
QASQDIGNYLN

SEQ ID NO: 27502 - protein, 7 aa, Artificial Sequence
  Description of Artificial Sequence: Synthetic peptide
  XENP021716 vlCDR2
YTSRLHS

SEQ ID NO: 27503 - protein, 9 aa, Artificial Sequence
  Description of Artificial Sequence: Synthetic peptide
  XENP021716 vlCDR3
QQGNTLPYT

SEQ ID NO: 27504 - protein, 223 aa, Artificial Sequence
  Description of Artificial Sequence: Synthetic polypeptide
  XENP021717 2A11_H1.131_L2_Fab Heavy Chain
EVQLVQSGAEVKKPGATVKISCKASGFNIKHYYMHWVQQAPGKGLEWMGWIDPELGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27505 - protein, 118 aa, Artificial Sequence
  Description of Artificial Sequence: Synthetic polypeptide
  VH of XENP021717
EVQLVQSGAEVKKPGATVKISCKASGFNIKHYYMHWVQQAPGKGLEWMGWIDPELGDTEYAPKFQGRVTITADTSTNTAYMELSSLRSEDTAVYYCYARGVKQALDYWGQGTLVTVSS

SEQ ID NO: 27506 - protein, 5 aa, Artificial Sequence
  Description of Artificial Sequence: Synthetic peptide
  XENP021717 vhCDR1
HYYMH

SEQ ID NO: 27507 - protein, 17 aa, Artificial Sequence
  Description of Artificial Sequence: Synthetic peptide
  XENP021717 vhCDR2
WIDPELGDTEYAPKFQG

SEQ ID NO: 27508 - protein, 9 aa, Artificial Sequence
  Description of Artificial Sequence: Synthetic peptide
  XENP021717 vhCDR3
RGVKQALDY

SEQ ID NO: 27509 - protein, 214 aa, Artificial Sequence; identical to SEQ ID NO: 17250
  Description of Artificial Sequence: Synthetic polypeptide
  XENP021717 2A11_H1.131_L2_Fab Light Chain

SEQ ID NO: 27510 - protein, 107 aa, Artificial Sequence; identical to SEQ ID NO: 17251
  Description of Artificial Sequence: Synthetic polypeptide
  VL of XENP021717

SEQ ID NO: 27511 - protein, 11 aa, Artificial Sequence
  Description of Artificial Sequence: Synthetic peptide
  XENP021717 vlCDR1
QASQDIGNYLN

SEQ ID NO: 27512 - protein, 7 aa, Artificial Sequence
  Description of Artificial Sequence: Synthetic peptide
  XENP021717 vlCDR2
YTSRLHS

SEQ ID NO: 27513 - protein, 9 aa, Artificial Sequence
  Description of Artificial Sequence: Synthetic peptide
  XENP021717 vlCDR3
QQGNTLPYT

SEQ ID NO: 27514 - protein, 223 aa, Artificial Sequence
  Description of Artificial Sequence: Synthetic polypeptide
  XENP021718 2A11_H1.132_L2_Fab Heavy Chain
EVQLVQSGAEVKKPGATVKISCKASGFNIKHYYMHWVQQAPGKGLEWMGWIDPETGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27515 - protein, 118 aa, Artificial Sequence
  Description of Artificial Sequence: Synthetic polypeptide
  VH of XENP021718
EVQLVQSGAEVKKPGATVKISCKASGFNIKHYYMHWVQQAPGKGLEWMGWIDPETGDTEYAPKFQGRVTITADTSTNTAYMELSSLRSEDTAVYYCYARGVRQALDYWGQGTLVTVSS

SEQ ID NO: 27516 - protein, 5 aa, Artificial Sequence
  Description of Artificial Sequence: Synthetic peptide
  XENP021718 vhCDR1
HYYMH

SEQ ID NO: 27517 - protein, 17 aa, Artificial Sequence
  Description of Artificial Sequence: Synthetic peptide
  XENP021718 vhCDR2
WIDPETGDTEYAPKFQG

SEQ ID NO: 27518 - protein, 9 aa, Artificial Sequence
  Description of Artificial Sequence: Synthetic peptide
  XENP021718 vhCDR3
RGVRQALDY

SEQ ID NO: 27519 - protein, 214 aa, Artificial Sequence; identical to SEQ ID NO: 17250
  Description of Artificial Sequence: Synthetic polypeptide
  XENP021718 2A11_H1.132_L2_Fab Light Chain

SEQ ID NO: 27520 - protein, 107 aa, Artificial Sequence; identical to SEQ ID NO: 17251
  Description of Artificial Sequence: Synthetic polypeptide
  VL of XENP021718

SEQ ID NO: 27521 - protein, 11 aa, Artificial Sequence
  Description of Artificial Sequence: Synthetic peptide
  XENP021718 vlCDR1
QASQDIGNYLN

SEQ ID NO: 27522 - protein, 7 aa, Artificial Sequence
  Description of Artificial Sequence: Synthetic peptide
  XENP021718 vlCDR2
YTSRLHS

SEQ ID NO: 27523 - protein, 9 aa, Artificial Sequence
  Description of Artificial Sequence: Synthetic peptide
  XENP021718 vlCDR3
QQGNTLPYT

SEQ ID NO: 27524 - protein, 223 aa, Artificial Sequence
  Description of Artificial Sequence: Synthetic polypeptide
  XENP021719 2A11_H1.133_L2_Fab Heavy Chain
EVQLVQSGAEVKKPGATVKISCKASGFNIKHYYMHWVQQAPGKGLEWMGWIDPETGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27525 - protein, 118 aa, Artificial Sequence
  Description of Artificial Sequence: Synthetic polypeptide
  VH of XENP021719
EVQLVQSGAEVKKPGATVKISCKASGFNIKHYYMHWVQQAPGKGLEWMGWIDPETGDTEYAPKFQGRVTITADTSTNTAYMELSSLRSEDTAVYYCYARGVYQALDYWGQGTLVTVSS

SEQ ID NO: 27526 - protein, 5 aa, Artificial Sequence
  Description of Artificial Sequence: Synthetic peptide
  XENP021719 vhCDR1
HYYMH

SEQ ID NO: 27527 - protein, 17 aa, Artificial Sequence
  Description of Artificial Sequence: Synthetic peptide
  XENP021719 vhCDR2
WIDPETGDTEYAPKFQG

SEQ ID NO: 27528 - protein, 9 aa, Artificial Sequence
  Description of Artificial Sequence: Synthetic peptide
  XENP021719 vhCDR3
RGVYQALDY

SEQ ID NO: 27529 - protein, 214 aa, Artificial Sequence; identical to SEQ ID NO: 17250
  Description of Artificial Sequence: Synthetic polypeptide
  XENP021719 2A11_H1.133_L2_Fab Light Chain

SEQ ID NO: 27530 - protein, 107 aa, Artificial Sequence; identical to SEQ ID NO: 17251
  Description of Artificial Sequence: Synthetic polypeptide
  VL of XENP021719

SEQ ID NO: 27531 - protein, 11 aa, Artificial Sequence
  Description of Artificial Sequence: Synthetic peptide
  XENP021719 vlCDR1
QASQDIGNYLN

SEQ ID NO: 27532 - protein, 7 aa, Artificial Sequence
  Description of Artificial Sequence: Synthetic peptide
  XENP021719 vlCDR2
YTSRLHS

SEQ ID NO: 27533 - protein, 9 aa, Artificial Sequence
  Description of Artificial Sequence: Synthetic peptide
  XENP021719 vlCDR3
QQGNTLPYT

SEQ ID NO: 27534 - protein, 223 aa, Artificial Sequence
  Description of Artificial Sequence: Synthetic polypeptide
  XENP021720 2A11_H1.134_L2_Fab Heavy Chain
EVQLVQSGAEVKKPGATVKISCKASGFNIKHYYMHWVQQAPGKGLEWMGWIDPETGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27535 - protein, 118 aa, Artificial Sequence
  Description of Artificial Sequence: Synthetic polypeptide
  VH of XENP021720
EVQLVQSGAEVKKPGATVKISCKASGFNIKHYYMHWVQQAPGKGLEWMGWIDPETGDTEYAPKFQGRVTITADTSTNTAYMELSSLRSEDTAVYYCYARGVKQALDYWGQGTLVTVSS

SEQ ID NO: 27536 - protein, 5 aa, Artificial Sequence
  Description of Artificial Sequence: Synthetic peptide
  XENP021720 vhCDR1
HYYMH

SEQ ID NO: 27537 - protein, 17 aa, Artificial Sequence
  Description of Artificial Sequence: Synthetic peptide
  XENP021720 vhCDR2
WIDPETGDTEYAPKFQG

SEQ ID NO: 27538 - protein, 9 aa, Artificial Sequence
  Description of Artificial Sequence: Synthetic peptide
  XENP021720 vhCDR3
RGVKQALDY

SEQ ID NO: 27539 - protein, 214 aa, Artificial Sequence; identical to SEQ ID NO: 17250
  Description of Artificial Sequence: Synthetic polypeptide
  XENP021720 2A11_H1.134_L2_Fab Light Chain

SEQ ID NO: 27540 - protein, 107 aa, Artificial Sequence; identical to SEQ ID NO: 17251
  Description of Artificial Sequence: Synthetic polypeptide
  VL of XENP021720

SEQ ID NO: 27541 - protein, 11 aa, Artificial Sequence
  Description of Artificial Sequence: Synthetic peptide
  XENP021720 vlCDR1
QASQDIGNYLN

SEQ ID NO: 27542 - protein, 7 aa, Artificial Sequence
  Description of Artificial Sequence: Synthetic peptide
  XENP021720 vlCDR2
YTSRLHS

SEQ ID NO: 27543 - protein, 9 aa, Artificial Sequence
  Description of Artificial Sequence: Synthetic peptide
  XENP021720 vlCDR3
QQGNTLPYT

SEQ ID NO: 27544 - protein, 223 aa, Artificial Sequence
  Description of Artificial Sequence: Synthetic polypeptide
  XENP021721 2A11_H1.135_L2_Fab Heavy Chain
EVQLVQSGAEVKKPGATVKISCKASGFNIKHYYMHWVQQAPGKGLEWMGWIDPYLGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27545 - protein, 118 aa, Artificial Sequence
  Description of Artificial Sequence: Synthetic polypeptide
  VH of XENP021721
EVQLVQSGAEVKKPGATVKISCKASGFNIKHYYMHWVQQAPGKGLEWMGWIDPYLGDTEYAPKFQGRVTITADTSTNTAYMELSSLRSEDTAVYYCYARGVRQALDYWGQGTLVTVSS

SEQ ID NO: 27546 - protein, 5 aa, Artificial Sequence
  Description of Artificial Sequence: Synthetic peptide
  XENP021721 vhCDR1
HYYMH

SEQ ID NO: 27547 - protein, 17 aa, Artificial Sequence
  Description of Artificial Sequence: Synthetic peptide
  XENP021721 vhCDR2
WIDPYLGDTEYAPKFQG

SEQ ID NO: 27548 - protein, 9 aa, Artificial Sequence
  Description of Artificial Sequence: Synthetic peptide
  XENP021721 vhCDR3
RGVRQALDY

SEQ ID NO: 27549 - protein, 214 aa, Artificial Sequence; identical to SEQ ID NO: 17250
  Description of Artificial Sequence: Synthetic polypeptide
  XENP021721 2A11_H1.135_L2_Fab Light Chain

SEQ ID NO: 27550 - protein, 107 aa, Artificial Sequence; identical to SEQ ID NO: 17251
  Description of Artificial Sequence: Synthetic polypeptide
  VL of XENP021721

SEQ ID NO: 27551 - protein, 11 aa, Artificial Sequence
  Description of Artificial Sequence: Synthetic peptide
  XENP021721 vlCDR1
QASQDIGNYLN

SEQ ID NO: 27552 - protein, 7 aa, Artificial Sequence
  Description of Artificial Sequence: Synthetic peptide
  XENP021721 vlCDR2
YTSRLHS

SEQ ID NO: 27553 - protein, 9 aa, Artificial Sequence
  Description of Artificial Sequence: Synthetic peptide
  XENP021721 vlCDR3
QQGNTLPYT

SEQ ID NO: 27554 - protein, 223 aa, Artificial Sequence
  Description of Artificial Sequence: Synthetic polypeptide
  XENP021722 2A11_H1.136_L2_Fab Heavy Chain
EVQLVQSGAEVKKPGATVKISCKASGFNIKHYYMHWVQQAPGKGLEWMGWIDPYLGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27555 - protein, 118 aa, Artificial Sequence
  Description of Artificial Sequence: Synthetic polypeptide
  VH of XENP021722
EVQLVQSGAEVKKPGATVKISCKASGFNIKHYYMHWVQQAPGKGLEWMGWIDPYLGDTEYAPKFQGRVTITADTSTNTAYMELSSLRSEDTAVYYCYARGVYQALDYWGQGTLVTVSS

SEQ ID NO: 27556 - protein, 5 aa, Artificial Sequence
  Description of Artificial Sequence: Synthetic peptide
  XENP021722 vhCDR1
HYYMH

SEQ ID NO: 27557 - protein, 17 aa, Artificial Sequence
  Description of Artificial Sequence: Synthetic peptide
  XENP021722 vhCDR2
WIDPYLGDTEYAPKFQG

SEQ ID NO: 27558 - protein, 9 aa, Artificial Sequence
  Description of Artificial Sequence: Synthetic peptide
  XENP021722 vhCDR3
RGVYQALDY

SEQ ID NO: 27559 - protein, 214 aa, Artificial Sequence; identical to SEQ ID NO: 17250
  Description of Artificial Sequence: Synthetic polypeptide
  XENP021722 2A11_H1.136_L2_Fab Light Chain

SEQ ID NO: 27560 - protein, 107 aa, Artificial Sequence; identical to SEQ ID NO: 17251
  Description of Artificial Sequence: Synthetic polypeptide
  VL of XENP021722

SEQ ID NO: 27561 - protein, 11 aa, Artificial Sequence
  Description of Artificial Sequence: Synthetic peptide
  XENP021722 vlCDR1
QASQDIGNYLN

SEQ ID NO: 27562 - protein, 7 aa, Artificial Sequence
  Description of Artificial Sequence: Synthetic peptide
  XENP021722 vlCDR2
YTSRLHS

SEQ ID NO: 27563 - protein, 9 aa, Artificial Sequence
  Description of Artificial Sequence: Synthetic peptide
  XENP021722 vlCDR3
QQGNTLPYT

SEQ ID NO: 27564 - protein, 223 aa, Artificial Sequence
  Description of Artificial Sequence: Synthetic polypeptide
  XENP021723 2A11_H1.137_L2_Fab Heavy Chain
EVQLVQSGAEVKKPGATVKISCKASGFNIKHYYMHWVQQAPGKGLEWMGWIDPYLGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27565 - protein, 118 aa, Artificial Sequence
  Description of Artificial Sequence: Synthetic polypeptide
  VH of XENP021723
EVQLVQSGAEVKKPGATVKISCKASGFNIKHYYMHWVQQAPGKGLEWMGWIDPYLGDTEYAPKFQGRVTITADTSTNTAYMELSSLRSEDTAVYYCYARGVKQALDYWGQGTLVTVSS

SEQ ID NO: 27566 - protein, 5 aa, Artificial Sequence
  Description of Artificial Sequence: Synthetic peptide
  XENP021723 vhCDR1
HYYMH

SEQ ID NO: 27567 - protein, 17 aa, Artificial Sequence
  Description of Artificial Sequence: Synthetic peptide
  XENP021723 vhCDR2
WIDPYLGDTEYAPKFQG

SEQ ID NO: 27568 - protein, 9 aa, Artificial Sequence
  Description of Artificial Sequence: Synthetic peptide
  XENP021723 vhCDR3
RGVKQALDY

SEQ ID NO: 27569 - protein, 214 aa, Artificial Sequence; identical to SEQ ID NO: 17250
  Description of Artificial Sequence: Synthetic polypeptide
  XENP021723 2A11_H1.137_L2_Fab Light Chain

SEQ ID NO: 27570 - protein, 107 aa, Artificial Sequence; identical to SEQ ID NO: 17251
  Description of Artificial Sequence: Synthetic polypeptide
  VL of XENP021723

SEQ ID NO: 27571 - protein, 11 aa, Artificial Sequence
  Description of Artificial Sequence: Synthetic peptide
  XENP021723 vlCDR1
QASQDIGNYLN

SEQ ID NO: 27572 - protein, 7 aa, Artificial Sequence
  Description of Artificial Sequence: Synthetic peptide
  XENP021723 vlCDR2
YTSRLHS

SEQ ID NO: 27573 - protein, 9 aa, Artificial Sequence
  Description of Artificial Sequence: Synthetic peptide
  XENP021723 vlCDR3
QQGNTLPYT

SEQ ID NO: 27574 - protein, 223 aa, Artificial Sequence
  Description of Artificial Sequence: Synthetic polypeptide
  XENP021724 2A11_H1.138_L2_Fab Heavy Chain
EVQLVQSGAEVKKPGATVKISCKASGFNIKHYYMHWVQQAPGKGLEWMGWIDPYTGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27575 - protein, 118 aa, Artificial Sequence
  Description of Artificial Sequence: Synthetic polypeptide
  VH of XENP021724
EVQLVQSGAEVKKPGATVKISCKASGFNIKHYYMHWVQQAPGKGLEWMGWIDPYTGDTEYAPKFQGRVTITADTSTNTAYMELSSLRSEDTAVYYCYARGVRQALDYWGQGTLVTVSS

SEQ ID NO: 27576 - protein, 5 aa, Artificial Sequence
  Description of Artificial Sequence: Synthetic peptide
  XENP021724 vhCDR1
HYYMH

SEQ ID NO: 27577 - protein, 17 aa, Artificial Sequence
  Description of Artificial Sequence: Synthetic peptide
  XENP021724 vhCDR2
WIDPYTGDTEYAPKFQG

SEQ ID NO: 27578 - protein, 9 aa, Artificial Sequence
  Description of Artificial Sequence: Synthetic peptide
  XENP021724 vhCDR3
RGVRQALDY

SEQ ID NO: 27579 - protein, 214 aa, Artificial Sequence; identical to SEQ ID NO: 17250
  Description of Artificial Sequence: Synthetic polypeptide
  XENP021724 2A11_H1.138_L2_Fab Light Chain

SEQ ID NO: 27580 - protein, 107 aa, Artificial Sequence; identical to SEQ ID NO: 17251
  Description of Artificial Sequence: Synthetic polypeptide
  VL of XENP021724

SEQ ID NO: 27581 - protein, 11 aa, Artificial Sequence
  Description of Artificial Sequence: Synthetic peptide
  XENP021724 vlCDR1
QASQDIGNYLN

SEQ ID NO: 27582 - protein, 7 aa, Artificial Sequence
  Description of Artificial Sequence: Synthetic peptide
  XENP021724 vlCDR2
YTSRLHS

SEQ ID NO: 27583 - protein, 9 aa, Artificial Sequence
  Description of Artificial Sequence: Synthetic peptide
  XENP021724 vlCDR3
QQGNTLPYT

SEQ ID NO: 27584 - protein, 223 aa, Artificial Sequence
  Description of Artificial Sequence: Synthetic polypeptide
  XENP021725 2A11_H1.139_L2_Fab Heavy Chain
EVQLVQSGAEVKKPGATVKISCKASGFNIKHYYMHWVQQAPGKGLEWMGWIDPYTGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27585 - protein, 118 aa, Artificial Sequence
  Description of Artificial Sequence: Synthetic polypeptide
  VH of XENP021725
EVQLVQSGAEVKKPGATVKISCKASGFNIKHYYMHWVQQAPGKGLEWMGWIDPYTGDTEYAPKFQGRVTITADTSTNTAYMELSSLRSEDTAVYYCYARGVYQALDYWGQGTLVTVSS

SEQ ID NO: 27586 - protein, 5 aa, Artificial Sequence
  Description of Artificial Sequence: Synthetic peptide
  XENP021725 vhCDR1
HYYMH

SEQ ID NO: 27587 - protein, 17 aa, Artificial Sequence
  Description of Artificial Sequence: Synthetic peptide
  XENP021725 vhCDR2
WIDPYTGDTEYAPKFQG

SEQ ID NO: 27588 - protein, 9 aa, Artificial Sequence
  Description of Artificial Sequence: Synthetic peptide
  XENP021725 vhCDR3
RGVYQALDY

SEQ ID NO: 27589 - protein, 214 aa, Artificial Sequence; identical to SEQ ID NO: 17250
  Description of Artificial Sequence: Synthetic polypeptide
  XENP021725 2A11_H1.139_L2_Fab Light Chain

SEQ ID NO: 27590 - protein, 107 aa, Artificial Sequence; identical to SEQ ID NO: 17251
  Description of Artificial Sequence: Synthetic polypeptide
  VL of XENP021725

SEQ ID NO: 27591 - protein, 11 aa, Artificial Sequence
  Description of Artificial Sequence: Synthetic peptide
  XENP021725 vlCDR1
QASQDIGNYLN

SEQ ID NO: 27592 - protein, 7 aa, Artificial Sequence
  Description of Artificial Sequence: Synthetic peptide
  XENP021725 vlCDR2
YTSRLHS

SEQ ID NO: 27593 - protein, 9 aa, Artificial Sequence
  Description of Artificial Sequence: Synthetic peptide
  XENP021725 vlCDR3
QQGNTLPYT

SEQ ID NO: 27594 - protein, 223 aa, Artificial Sequence
  Description of Artificial Sequence: Synthetic polypeptide
  XENP021726 2A11_H1.140_L2_Fab Heavy Chain
EVQLVQSGAEVKKPGATVKISCKASGFNIKHYYMHWVQQAPGKGLEWMGWIDPYTGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27595 - protein, 118 aa, Artificial Sequence
  Description of Artificial Sequence: Synthetic polypeptide
  VH of XENP021726
EVQLVQSGAEVKKPGATVKISCKASGFNIKHYYMHWVQQAPGKGLEWMGWIDPYTGDTEYAPKFQGRVTITADTSTNTAYMELSSLRSEDTAVYYCYARGVKQALDYWGQGTLVTVSS

SEQ ID NO: 27596 - protein, 5 aa, Artificial Sequence
  Description of Artificial Sequence: Synthetic peptide
  XENP021726 vhCDR1
HYYMH

SEQ ID NO: 27597 - protein, 17 aa, Artificial Sequence
  Description of Artificial Sequence: Synthetic peptide
  XENP021726 vhCDR2
WIDPYTGDTEYAPKFQG

SEQ ID NO: 27598 - protein, 9 aa, Artificial Sequence
  Description of Artificial Sequence: Synthetic peptide
  XENP021726 vhCDR3
RGVKQALDY

SEQ ID NO: 27599 - protein, 214 aa, Artificial Sequence; identical to SEQ ID NO: 17250
  Description of Artificial Sequence: Synthetic polypeptide
  XENP021726 2A11_H1.140_L2_Fab Light Chain

SEQ ID NO: 27600 - protein, 107 aa, Artificial Sequence; identical to SEQ ID NO: 17251
  Description of Artificial Sequence: Synthetic polypeptide
  VL of XENP021726

SEQ ID NO: 27601 - protein, 11 aa, Artificial Sequence
  Description of Artificial Sequence: Synthetic peptide
  XENP021726 vlCDR1
QASQDIGNYLN

SEQ ID NO: 27602 - protein, 7 aa, Artificial Sequence
  Description of Artificial Sequence: Synthetic peptide
  XENP021726 vlCDR2
YTSRLHS

SEQ ID NO: 27603 - protein, 9 aa, Artificial Sequence
  Description of Artificial Sequence: Synthetic peptide
  XENP021726 vlCDR3
QQGNTLPYT

SEQ ID NO: 27604 - protein, 223 aa, Artificial Sequence
  Description of Artificial Sequence: Synthetic polypeptide
  XENP021727 2A11_H1.141_L2_Fab Heavy Chain
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27605 - protein, 118 aa, Artificial Sequence
  Description of Artificial Sequence: Synthetic polypeptide
  VH of XENP021727
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVRQALDYWGQGTLVTVSS

SEQ ID NO: 27606 - protein, 5 aa, Artificial Sequence
  Description of Artificial Sequence: Synthetic peptide
  XENP021727 vhCDR1
DYFMH

SEQ ID NO: 27607 - protein, 17 aa, Artificial Sequence
  Description of Artificial Sequence: Synthetic peptide
  XENP021727 vhCDR2
WIDPELGDTEYAPKFQG

SEQ ID NO: 27608 - protein, 9 aa, Artificial Sequence
  Description of Artificial Sequence: Synthetic peptide
  XENP021727 vhCDR3
RGVRQALDY

SEQ ID NO: 27609 - protein, 214 aa, Artificial Sequence; identical to SEQ ID NO: 17250
  Description of Artificial Sequence: Synthetic polypeptide
  XENP021727 2A11_H1.141_L2_Fab Light Chain

SEQ ID NO: 27610 - protein, 107 aa, Artificial Sequence; identical to SEQ ID NO: 17251
  Description of Artificial Sequence: Synthetic polypeptide
  VL of XENP021727

SEQ ID NO: 27611 - protein, 11 aa, Artificial Sequence
  Description of Artificial Sequence: Synthetic peptide
  XENP021727 vlCDR1
QASQDIGNYLN

SEQ ID NO: 27612 - protein, 7 aa, Artificial Sequence
  Description of Artificial Sequence: Synthetic peptide
  XENP021727 vlCDR2
YTSRLHS

SEQ ID NO: 27613 - protein, 9 aa, Artificial Sequence
  Description of Artificial Sequence: Synthetic peptide
  XENP021727 vlCDR3
QQGNTLPYT

SEQ ID NO: 27614 - protein, 223 aa, Artificial Sequence
  Description of Artificial Sequence: Synthetic polypeptide
  XENP021728 2A11_H1.142_L2_Fab Heavy Chain
EVQLVQSGAEVKKPGATVKISCKASGFNIKDYFMHWVQQAPGKGLEWMGWIDPETGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27615 - protein, 118 aa, Artificial Sequence
  Description of Artificial Sequence: Synthetic polypeptide
  VH of XENP021728
EVQLVQSGAEVKKPGATVKISCKASGFNIKDYFMHWVQQAPGKGLEWMGWIDPETGDTEYAPKFQGRVTITADTSTNTAYMELSSLRSEDTAVYYCYARGVRQALDYWGQGTLVTVSS

SEQ ID NO: 27616 - protein, 5 aa, Artificial Sequence
  Description of Artificial Sequence: Synthetic peptide
  XENP021728 vhCDR1
DYFMH

SEQ ID NO: 27617 - protein, 17 aa, Artificial Sequence
  Description of Artificial Sequence: Synthetic peptide
  XENP021728 vhCDR2
WIDPETGDTEYAPKFQG

SEQ ID NO: 27618 - protein, 9 aa, Artificial Sequence
  Description of Artificial Sequence: Synthetic peptide
  XENP021728 vhCDR3
RGVRQALDY

SEQ ID NO: 27619 - protein, 214 aa, Artificial Sequence; identical to SEQ ID NO: 17250
  Description of Artificial Sequence: Synthetic polypeptide
  XENP021728 2A11_H1.142_L2_Fab Light Chain

SEQ ID NO: 27620 - protein, 107 aa, Artificial Sequence; identical to SEQ ID NO: 17251
  Description of Artificial Sequence: Synthetic polypeptide
  VL of XENP021728

SEQ ID NO: 27621 - protein, 11 aa, Artificial Sequence
  Description of Artificial Sequence: Synthetic peptide
  XENP021728 vlCDR1
QASQDIGNYLN

SEQ ID NO: 27622 - protein, 7 aa, Artificial Sequence
  Description of Artificial Sequence: Synthetic peptide
  XENP021728 vlCDR2
YTSRLHS

SEQ ID NO: 27623 - protein, 9 aa, Artificial Sequence
  Description of Artificial Sequence: Synthetic peptide
  XENP021728 vlCDR3
QQGNTLPYT

SEQ ID NO: 27624 - protein, 223 aa, Artificial Sequence
  Description of Artificial Sequence: Synthetic polypeptide
  XENP021729 2A11_H1.143_L2_Fab Heavy Chain
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27625 - protein, 118 aa, Artificial Sequence
  Description of Artificial Sequence: Synthetic polypeptide
  VH of XENP021729
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVKQALDYWGQGTLVTVSS

SEQ ID NO: 27626 - protein, 5 aa, Artificial Sequence
  Description of Artificial Sequence: Synthetic peptide
  XENP021729 vhCDR1
DYFMH

SEQ ID NO: 27627 - protein, 17 aa, Artificial Sequence
  Description of Artificial Sequence: Synthetic peptide
  XENP021729 vhCDR2
WIDPELGDTEYAPKFQG

SEQ ID NO: 27628 - protein, 9 aa, Artificial Sequence
  Description of Artificial Sequence: Synthetic peptide
  XENP021729 vhCDR3
RGVKQALDY

SEQ ID NO: 27629 - protein, 214 aa, Artificial Sequence; identical to SEQ ID NO: 17250
  Description of Artificial Sequence: Synthetic polypeptide
  XENP021729 2A11_H1.143_L2_Fab Light Chain

SEQ ID NO: 27630 - protein, 107 aa, Artificial Sequence; identical to SEQ ID NO: 17251
  Description of Artificial Sequence: Synthetic polypeptide
  VL of XENP021729

SEQ ID NO: 27631 - protein, 11 aa, Artificial Sequence
  Description of Artificial Sequence: Synthetic peptide
  XENP021729 vlCDR1
QASQDIGNYLN

SEQ ID NO: 27632 - protein, 7 aa, Artificial Sequence
  Description of Artificial Sequence: Synthetic peptide
  XENP021729 vlCDR2
YTSRLHS

SEQ ID NO: 27633 - protein, 9 aa, Artificial Sequence
  Description of Artificial Sequence: Synthetic peptide
  XENP021729 vlCDR3
QQGNTLPYT

SEQ ID NO: 27634 - protein, 223 aa, Artificial Sequence
  Description of Artificial Sequence: Synthetic polypeptide
  XENP021730 2A11_H1.144_L2_Fab Heavy Chain
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27635 - protein, 118 aa, Artificial Sequence; identical to SEQ ID NO: 22085
  Description of Artificial Sequence: Synthetic polypeptide
  VH of XENP021730

SEQ ID NO: 27636 - protein, 5 aa, Artificial Sequence
  Description of Artificial Sequence: Synthetic peptide
  XENP021730 vhCDR1
DYFMH

SEQ ID NO: 27637 - protein, 17 aa, Artificial Sequence
  Description of Artificial Sequence: Synthetic peptide
  XENP021730 vhCDR2
WIDPELGDTEYAPKFQG

SEQ ID NO: 27638 - protein, 9 aa, Artificial Sequence
  Description of Artificial Sequence: Synthetic peptide
  XENP021730 vhCDR3
RGVYQALDY

SEQ ID NO: 27639 - protein, 214 aa, Artificial Sequence; identical to SEQ ID NO: 17250
  Description of Artificial Sequence: Synthetic polypeptide
  XENP021730 2A11_H1.144_L2_Fab Light Chain

SEQ ID NO: 27640 - protein, 107 aa, Artificial Sequence; identical to SEQ ID NO: 17251
  Description of Artificial Sequence: Synthetic polypeptide
  VL of XENP021730

SEQ ID NO: 27641 - protein, 11 aa, Artificial Sequence
  Description of Artificial Sequence: Synthetic peptide
  XENP021730 vlCDR1
QASQDIGNYLN

SEQ ID NO: 27642 - protein, 7 aa, Artificial Sequence
  Description of Artificial Sequence: Synthetic peptide
  XENP021730 vlCDR2
YTSRLHS

SEQ ID NO: 27643 - protein, 9 aa, Artificial Sequence
  Description of Artificial Sequence: Synthetic peptide
  XENP021730 vlCDR3
QQGNTLPYT

SEQ ID NO: 27644 - protein, 223 aa, Artificial Sequence
  Description of Artificial Sequence: Synthetic polypeptide
  XENP021731 2A11_H1.145_L2_Fab Heavy Chain
EVQLVQSGAEVKKPGATVKISCKASGFNIKDYFMHWVQQAPGKGLEWMGWIDPETGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27645 - protein, 118 aa, Artificial Sequence
  Description of Artificial Sequence: Synthetic polypeptide
  VH of XENP021731
EVQLVQSGAEVKKPGATVKISCKASGFNIKDYFMHWVQQAPGKGLEWMGWIDPETGDTEYAPKFQGRVTITADTSTNTAYMELSSLRSEDTAVYYCYARGVKQALDYWGQGTLVTVSS

SEQ ID NO: 27646 - protein, 5 aa, Artificial Sequence
  Description of Artificial Sequence: Synthetic peptide
  XENP021731 vhCDR1
DYFMH

SEQ ID NO: 27647 - protein, 17 aa, Artificial Sequence
  Description of Artificial Sequence: Synthetic peptide
  XENP021731 vhCDR2
WIDPETGDTEYAPKFQG

SEQ ID NO: 27648 - protein, 9 aa, Artificial Sequence
  Description of Artificial Sequence: Synthetic peptide
  XENP021731 vhCDR3
RGVKQALDY

SEQ ID NO: 27649 - protein, 214 aa, Artificial Sequence; identical to SEQ ID NO: 17250
  Description of Artificial Sequence: Synthetic polypeptide
  XENP021731 2A11_H1.145_L2_Fab Light Chain

SEQ ID NO: 27650 - protein, 107 aa, Artificial Sequence; identical to SEQ ID NO: 17251
  Description of Artificial Sequence: Synthetic polypeptide
  VL of XENP021731

SEQ ID NO: 27651 - protein, 11 aa, Artificial Sequence
  Description of Artificial Sequence: Synthetic peptide
  XENP021731 vlCDR1
QASQDIGNYLN

SEQ ID NO: 27652 - protein, 7 aa, Artificial Sequence
  Description of Artificial Sequence: Synthetic peptide
  XENP021731 vlCDR2
YTSRLHS

SEQ ID NO: 27653 - protein, 9 aa, Artificial Sequence
  Description of Artificial Sequence: Synthetic peptide
  XENP021731 vlCDR3
QQGNTLPYT

SEQ ID NO: 27654 - protein, 223 aa, Artificial Sequence
  Description of Artificial Sequence: Synthetic polypeptide
  XENP021732 2A11_H1.146_L2_Fab Heavy Chain
EVQLVQSGAEVKKPGATVKISCKASGFNIKDYFMHWVQQAPGKGLEWMGWIDPETGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27655 - protein, 118 aa, Artificial Sequence
  Description of Artificial Sequence: Synthetic polypeptide
  VH of XENP021732
EVQLVQSGAEVKKPGATVKISCKASGFNIKDYFMHWVQQAPGKGLEWMGWIDPETGDTEYAPKFQGRVTITADTSTNTAYMELSSLRSEDTAVYYCYARGVYQALDYWGQGTLVTVSS

SEQ ID NO: 27656 - protein, 5 aa, Artificial Sequence
  Description of Artificial Sequence: Synthetic peptide
  XENP021732 vhCDR1
DYFMH

SEQ ID NO: 27657 - protein, 17 aa, Artificial Sequence
  Description of Artificial Sequence: Synthetic peptide
  XENP021732 vhCDR2
WIDPETGDTEYAPKFQG

SEQ ID NO: 27658 - protein, 9 aa, Artificial Sequence
  Description of Artificial Sequence: Synthetic peptide
  XENP021732 vhCDR3
RGVYQALDY

SEQ ID NO: 27659 - protein, 214 aa, Artificial Sequence; identical to SEQ ID NO: 17250
  Description of Artificial Sequence: Synthetic polypeptide
  XENP021732 2A11_H1.146_L2_Fab Light Chain

SEQ ID NO: 27660 - protein, 107 aa, Artificial Sequence; identical to SEQ ID NO: 17251
  Description of Artificial Sequence: Synthetic polypeptide
  VL of XENP021732

SEQ ID NO: 27661 - protein, 11 aa, Artificial Sequence
  Description of Artificial Sequence: Synthetic peptide
  XENP021732 vlCDR1
QASQDIGNYLN

SEQ ID NO: 27662 - protein, 7 aa, Artificial Sequence
  Description of Artificial Sequence: Synthetic peptide
  XENP021732 vlCDR2
YTSRLHS

SEQ ID NO: 27663 - protein, 9 aa, Artificial Sequence
  Description of Artificial Sequence: Synthetic peptide
  XENP021732 vlCDR3
QQGNTLPYT

SEQ ID NO: 27664 - protein, 223 aa, Artificial Sequence
  Description of Artificial Sequence: Synthetic polypeptide
  XENP021733 2A11_H1.147_L2_Fab Heavy Chain
EVQLVQSGAEVKKPGATVKISCKASGFNIKDYYMHWVQQAPGKGLEWMGWIDLENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27665 - protein, 118 aa, Artificial Sequence
  Description of Artificial Sequence: Synthetic polypeptide
  VH of XENP021733
EVQLVQSGAEVKKPGATVKISCKASGFNIKDYYMHWVQQAPGKGLEWMGWIDLENGDTEYAPKFQGRVTITADTSTNTAYMELSSLRSEDTAVYYCYARGVRQALDYWGQGTLVTVSS

SEQ ID NO: 27666 - protein, 5 aa, Artificial Sequence
  Description of Artificial Sequence: Synthetic peptide
  XENP021733 vhCDR1
DYYMH

SEQ ID NO: 27667 - protein, 17 aa, Artificial Sequence
  Description of Artificial Sequence: Synthetic peptide
  XENP021733 vhCDR2
WIDLENGDTEYAPKFQG

SEQ ID NO: 27668 - protein, 9 aa, Artificial Sequence
  Description of Artificial Sequence: Synthetic peptide
  XENP021733 vhCDR3
RGVRQALDY

SEQ ID NO: 27669 - protein, 214 aa, Artificial Sequence; identical to SEQ ID NO: 17250
  Description of Artificial Sequence: Synthetic polypeptide
  XENP021733 2A11_H1.147_L2_Fab Light Chain

SEQ ID NO: 27670 - protein, 107 aa, Artificial Sequence; identical to SEQ ID NO: 17251
  Description of Artificial Sequence: Synthetic polypeptide
  VL of XENP021733

SEQ ID NO: 27671 - protein, 11 aa, Artificial Sequence
  Description of Artificial Sequence: Synthetic peptide
  XENP021733 vlCDR1
QASQDIGNYLN

SEQ ID NO: 27672 - protein, 7 aa, Artificial Sequence
  Description of Artificial Sequence: Synthetic peptide
  XENP021733 vlCDR2
YTSRLHS

SEQ ID NO: 27673 - protein, 9 aa, Artificial Sequence
  Description of Artificial Sequence: Synthetic peptide
  XENP021733 vlCDR3
QQGNTLPYT

SEQ ID NO: 27674 - protein, 223 aa, Artificial Sequence
  Description of Artificial Sequence: Synthetic polypeptide
  XENP021734 2A11_H1.148_L2_Fab Heavy Chain
EVQLVQSGAEVKKPGATVKISCKASGFNIKDYYMHWVQQAPGKGLEWMGWIDIENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27675 - protein, 118 aa, Artificial Sequence
  Description of Artificial Sequence: Synthetic polypeptide
  VH of XENP021734
EVQLVQSGAEVKKPGATVKISCKASGFNIKDYYMHWVQQAPGKGLEWMGWIDIENGDTEYAPKFQGRVTITADTSTNTAYMELSSLRSEDTAVYYCYARGVRQALDYWGQGTLVTVSS

SEQ ID NO: 27676 - protein, 5 aa, Artificial Sequence
  Description of Artificial Sequence: Synthetic peptide
  XENP021734 vhCDR1
DYYMH

SEQ ID NO: 27677 - protein, 17 aa, Artificial Sequence
  Description of Artificial Sequence: Synthetic peptide
  XENP021734 vhCDR2
WIDIENGDTEYAPKFQG

SEQ ID NO: 27678 - protein, 9 aa, Artificial Sequence
  Description of Artificial Sequence: Synthetic peptide
  XENP021734 vhCDR3
RGVRQALDY

SEQ ID NO: 27679 - protein, 214 aa, Artificial Sequence; identical to SEQ ID NO: 17250
  Description of Artificial Sequence: Synthetic polypeptide
  XENP021734 2A11_H1.148_L2_Fab Light Chain

SEQ ID NO: 27680 - protein, 107 aa, Artificial Sequence; identical to SEQ ID NO: 17251
  Description of Artificial Sequence: Synthetic polypeptide
  VL of XENP021734

SEQ ID NO: 27681 - protein, 11 aa, Artificial Sequence
  Description of Artificial Sequence: Synthetic peptide
  XENP021734 vlCDR1
QASQDIGNYLN

SEQ ID NO: 27682 - protein, 7 aa, Artificial Sequence
  Description of Artificial Sequence: Synthetic peptide
  XENP021734 vlCDR2
YTSRLHS

SEQ ID NO: 27683 - protein, 9 aa, Artificial Sequence
  Description of Artificial Sequence: Synthetic peptide
  XENP021734 vlCDR3
QQGNTLPYT

SEQ ID NO: 27684 - protein, 223 aa, Artificial Sequence
  Description of Artificial Sequence: Synthetic polypeptide
  XENP021735 2A11_H1.149_L2_Fab Heavy Chain
EVQLVQSGAEVKKPGATVKISCKASGFNIKDYYMHWVQQAPGKGLEWMGWIDAENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27685 - protein, 118 aa, Artificial Sequence
  Description of Artificial Sequence: Synthetic polypeptide
  VH of XENP021735
EVQLVQSGAEVKKPGATVKISCKASGFNIKDYYMHWVQQAPGKGLEWMGWIDAENGDTEYAPKFQGRVTITADTSTNTAYMELSSLRSEDTAVYYCYARGVRQALDYWGQGTLVTVSS

SEQ ID NO: 27686 - protein, 5 aa, Artificial Sequence
  Description of Artificial Sequence: Synthetic peptide
  XENP021735 vhCDR1
DYYMH

SEQ ID NO: 27687 - protein, 17 aa, Artificial Sequence
  Description of Artificial Sequence: Synthetic peptide
  XENP021735 vhCDR2
WIDAENGDTEYAPKFQG

SEQ ID NO: 27688 - protein, 9 aa, Artificial Sequence
  Description of Artificial Sequence: Synthetic peptide
  XENP021735 vhCDR3
RGVRQALDY

SEQ ID NO: 27689 - protein, 214 aa, Artificial Sequence; identical to SEQ ID NO: 17250
  Description of Artificial Sequence: Synthetic polypeptide
  XENP021735 2A11_H1.149_L2_Fab Light Chain

SEQ ID NO: 27690 - protein, 107 aa, Artificial Sequence; identical to SEQ ID NO: 17251
  Description of Artificial Sequence: Synthetic polypeptide
  VL of XENP021735

SEQ ID NO: 27691 - protein, 11 aa, Artificial Sequence
  Description of Artificial Sequence: Synthetic peptide
  XENP021735 vlCDR1
QASQDIGNYLN

SEQ ID NO: 27692 - protein, 7 aa, Artificial Sequence
  Description of Artificial Sequence: Synthetic peptide
  XENP021735 vlCDR2
YTSRLHS

SEQ ID NO: 27693 - protein, 9 aa, Artificial Sequence
  Description of Artificial Sequence: Synthetic peptide
  XENP021735 vlCDR3
QQGNTLPYT

SEQ ID NO: 27694 - protein, 223 aa, Artificial Sequence
  Description of Artificial Sequence: Synthetic polypeptide
  XENP021736 2A11_H1.150_L2_Fab Heavy Chain
EVQLVQSGAEVKKPGATVKISCKASGFNIKDYYMHWVQQAPGKGLEWMGWIDQENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27695 - protein, 118 aa, Artificial Sequence
  Description of Artificial Sequence: Synthetic polypeptide
  VH of XENP021736
EVQLVQSGAEVKKPGATVKISCKASGFNIKDYYMHWVQQAPGKGLEWMGWIDQENGDTEYAPKFQGRVTITADTSTNTAYMELSSLRSEDTAVYYCYARGVRQALDYWGQGTLVTVSS

SEQ ID NO: 27696 - protein, 5 aa, Artificial Sequence
  Description of Artificial Sequence: Synthetic peptide
  XENP021736 vhCDR1
DYYMH

SEQ ID NO: 27697 - protein, 17 aa, Artificial Sequence
  Description of Artificial Sequence: Synthetic peptide
  XENP021736 vhCDR2
WIDQENGDTEYAPKFQG

SEQ ID NO: 27698 - protein, 9 aa, Artificial Sequence
  Description of Artificial Sequence: Synthetic peptide
  XENP021736 vhCDR3
RGVRQALDY

SEQ ID NO: 27699 - protein, 214 aa, Artificial Sequence; identical to SEQ ID NO: 17250
  Description of Artificial Sequence: Synthetic polypeptide
  XENP021736 2A11_H1.150_L2_Fab Light Chain

SEQ ID NO: 27700 - protein, 107 aa, Artificial Sequence; identical to SEQ ID NO: 17251
  Description of Artificial Sequence: Synthetic polypeptide
  VL of XENP021736

SEQ ID NO: 27701 - protein, 11 aa, Artificial Sequence
  Description of Artificial Sequence: Synthetic peptide
  XENP021736 vlCDR1
QASQDIGNYLN

SEQ ID NO: 27702 - protein, 7 aa, Artificial Sequence
  Description of Artificial Sequence: Synthetic peptide
  XENP021736 vlCDR2
YTSRLHS

SEQ ID NO: 27703 - protein, 9 aa, Artificial Sequence
  Description of Artificial Sequence: Synthetic peptide
  XENP021736 vlCDR3
QQGNTLPYT

SEQ ID NO: 27704 - protein, 223 aa, Artificial Sequence
  Description of Artificial Sequence: Synthetic polypeptide
  XENP021737 2A11_H1.151_L2_Fab Heavy Chain
EVQLVQSGAEVKKPGATVKISCKASGFNIKDYYMHWVQQAPGKGLEWMGWIDHENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27705 - protein, 118 aa, Artificial Sequence
  Description of Artificial Sequence: Synthetic polypeptide
  VH of XENP021737
EVQLVQSGAEVKKPGATVKISCKASGFNIKDYYMHWVQQAPGKGLEWMGWIDHENGDTEYAPKFQGRVTITADTSTNTAYMELSSLRSEDTAVYYCYARGVRQALDYWGQGTLVTVSS

SEQ ID NO: 27706 - protein, 5 aa, Artificial Sequence
  Description of Artificial Sequence: Synthetic peptide
  XENP021737 vhCDR1
DYYMH

SEQ ID NO: 27707 - protein, 17 aa, Artificial Sequence
  Description of Artificial Sequence: Synthetic peptide
  XENP021737 vhCDR2
WIDHENGDTEYAPKFQG

SEQ ID NO: 27708 - protein, 9 aa, Artificial Sequence
  Description of Artificial Sequence: Synthetic peptide
  XENP021737 vhCDR3
RGVRQALDY

SEQ ID NO: 27709 - protein, 214 aa, Artificial Sequence; identical to SEQ ID NO: 17250
  Description of Artificial Sequence: Synthetic polypeptide
  XENP021737 2A11_H1.151_L2_Fab Light Chain

SEQ ID NO: 27710 - protein, 107 aa, Artificial Sequence; identical to SEQ ID NO: 17251
  Description of Artificial Sequence: Synthetic polypeptide
  VL of XENP021737

SEQ ID NO: 27711 - protein, 11 aa, Artificial Sequence
  Description of Artificial Sequence: Synthetic peptide
  XENP021737 vlCDR1
QASQDIGNYLN

SEQ ID NO: 27712 - protein, 7 aa, Artificial Sequence
  Description of Artificial Sequence: Synthetic peptide
  XENP021737 vlCDR2
YTSRLHS

SEQ ID NO: 27713 - protein, 9 aa, Artificial Sequence
  Description of Artificial Sequence: Synthetic peptide
  XENP021737 vlCDR3
QQGNTLPYT

SEQ ID NO: 27714 - protein, 223 aa, Artificial Sequence
  Description of Artificial Sequence: Synthetic polypeptide
  XENP021738 2A11_H1.152_L2_Fab Heavy Chain
EVQLVQSGAEVKKPGATVKISCKASGFNIKDYYMHWVQQAPGKGLEWMGWIDVENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27715 - protein, 118 aa, Artificial Sequence
  Description of Artificial Sequence: Synthetic polypeptide
  VH of XENP021738
EVQLVQSGAEVKKPGATVKISCKASGFNIKDYYMHWVQQAPGKGLEWMGWIDVENGDTEYAPKFQGRVTITADTSTNTAYMELSSLRSEDTAVYYCYARGVRQALDYWGQGTLVTVSS

SEQ ID NO: 27716 - protein, 5 aa, Artificial Sequence
  Description of Artificial Sequence: Synthetic peptide
  XENP021738 vhCDR1
DYYMH

SEQ ID NO: 27717 - protein, 17 aa, Artificial Sequence
  Description of Artificial Sequence: Synthetic peptide
  XENP021738 vhCDR2
WIDVENGDTEYAPKFQG

SEQ ID NO: 27718 - protein, 9 aa, Artificial Sequence
  Description of Artificial Sequence: Synthetic peptide
  XENP021738 vhCDR3
RGVRQALDY

SEQ ID NO: 27719 - protein, 214 aa, Artificial Sequence; identical to SEQ ID NO: 17250
  Description of Artificial Sequence: Synthetic polypeptide
  XENP021738 2A11_H1.152_L2_Fab Light Chain

SEQ ID NO: 27720 - protein, 107 aa, Artificial Sequence; identical to SEQ ID NO: 17251
  Description of Artificial Sequence: Synthetic polypeptide
  VL of XENP021738

SEQ ID NO: 27721 - protein, 11 aa, Artificial Sequence
  Description of Artificial Sequence: Synthetic peptide
  XENP021738 vlCDR1
QASQDIGNYLN

SEQ ID NO: 27722 - protein, 7 aa, Artificial Sequence
  Description of Artificial Sequence: Synthetic peptide
  XENP021738 vlCDR2
YTSRLHS

SEQ ID NO: 27723 - protein, 9 aa, Artificial Sequence
  Description of Artificial Sequence: Synthetic peptide
  XENP021738 vlCDR3
QQGNTLPYT

SEQ ID NO: 27724 - protein, 223 aa, Artificial Sequence
  Description of Artificial Sequence: Synthetic polypeptide
  XENP021739 2A11_H1.153_L2_Fab Heavy Chain
EVQLVQSGAEVKKPGATVKISCKASGFNIKDYYMHWVQQAPGKGLEWMGWIDWENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27725 - protein, 118 aa, Artificial Sequence
  Description of Artificial Sequence: Synthetic polypeptide
  VH of XENP021739
EVQLVQSGAEVKKPGATVKISCKASGFNIKDYYMHWVQQAPGKGLEWMGWIDWENGDTEYAPKFQGRVTITADTSTNTAYMELSSLRSEDTAVYYCYARGVRQALDYWGQGTLVTVSS

SEQ ID NO: 27726 - protein, 5 aa, Artificial Sequence
  Description of Artificial Sequence: Synthetic peptide
  XENP021739 vhCDR1
DYYMH

SEQ ID NO: 27727 - protein, 17 aa, Artificial Sequence
  Description of Artificial Sequence: Synthetic peptide
  XENP021739 vhCDR2
WIDWENGDTEYAPKFQG

SEQ ID NO: 27728 - protein, 9 aa, Artificial Sequence
  Description of Artificial Sequence: Synthetic peptide
  XENP021739 vhCDR3
RGVRQALDY

SEQ ID NO: 27729 - protein, 214 aa, Artificial Sequence; identical to SEQ ID NO: 17250
  Description of Artificial Sequence: Synthetic polypeptide
  XENP021739 2A11_H1.153_L2_Fab Light Chain

SEQ ID NO: 27730 - protein, 107 aa, Artificial Sequence; identical to SEQ ID NO: 17251
  Description of Artificial Sequence: Synthetic polypeptide
  VL of XENP021739

SEQ ID NO: 27731 - protein, 11 aa, Artificial Sequence
  Description of Artificial Sequence: Synthetic peptide
  XENP021739 vlCDR1
QASQDIGNYLN

SEQ ID NO: 27732 - protein, 7 aa, Artificial Sequence
  Description of Artificial Sequence: Synthetic peptide
  XENP021739 vlCDR2
YTSRLHS

SEQ ID NO: 27733 - protein, 9 aa, Artificial Sequence
  Description of Artificial Sequence: Synthetic peptide
  XENP021739 vlCDR3
QQGNTLPYT

SEQ ID NO: 27734 - protein, 223 aa, Artificial Sequence
  Description of Artificial Sequence: Synthetic polypeptide
  XENP021794 2A11_H1.125_L2_Fab Heavy Chain
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27735 - protein, 118 aa, Artificial Sequence; identical to SEQ ID NO: 22065
  Description of Artificial Sequence: Synthetic polypeptide
  VH of XENP021794

SEQ ID NO: 27736 - protein, 5 aa, Artificial Sequence
  Description of Artificial Sequence: Synthetic peptide
  XENP021794 vhCDR1
HYFMH

SEQ ID NO: 27737 - protein, 17 aa, Artificial Sequence
  Description of Artificial Sequence: Synthetic peptide
  XENP021794 vhCDR2
WIDPYLGDTEYAPKFQG

SEQ ID NO: 27738 - protein, 9 aa, Artificial Sequence
  Description of Artificial Sequence: Synthetic peptide
  XENP021794 vhCDR3
RGVYQALDY

SEQ ID NO: 27739 - protein, 214 aa, Artificial Sequence; identical to SEQ ID NO: 17250
  Description of Artificial Sequence: Synthetic polypeptide
  XENP021794 2A11_H1.125_L2_Fab Light Chain

SEQ ID NO: 27740 - protein, 107 aa, Artificial Sequence; identical to SEQ ID NO: 17251
  Description of Artificial Sequence: Synthetic polypeptide
  VL of XENP021794

SEQ ID NO: 27741 - protein, 11 aa, Artificial Sequence
  Description of Artificial Sequence: Synthetic peptide
  XENP021794 vlCDR1
QASQDIGNYLN

SEQ ID NO: 27742 - protein, 7 aa, Artificial Sequence
  Description of Artificial Sequence: Synthetic peptide
  XENP021794 vlCDR2
YTSRLHS

SEQ ID NO: 27743 - protein, 9 aa, Artificial Sequence
  Description of Artificial Sequence: Synthetic peptide
  XENP021794 vlCDR3
QQGNTLPYT

SEQ ID NO: 27744 - protein, 223 aa, Artificial Sequence; identical to SEQ ID NO: 27474
  Description of Artificial Sequence: Synthetic polypeptide
  XENP021795 2A11_H1.127_L2_Fab Heavy Chain

SEQ ID NO: 27745 - protein, 118 aa, Artificial Sequence; identical to SEQ ID NO: 27475
  Description of Artificial Sequence: Synthetic polypeptide
  VH of XENP021795

SEQ ID NO: 27746 - protein, 5 aa, Artificial Sequence
  Description of Artificial Sequence: Synthetic peptide
  XENP021795 vhCDR1
HYFMH

SEQ ID NO: 27747 - protein, 17 aa, Artificial Sequence
  Description of Artificial Sequence: Synthetic peptide
  XENP021795 vhCDR2
WIDPELGDTEYAPKFQG

SEQ ID NO: 27748 - protein, 9 aa, Artificial Sequence
  Description of Artificial Sequence: Synthetic peptide
  XENP021795 vhCDR3
RGVYQALDY

SEQ ID NO: 27749 - protein, 214 aa, Artificial Sequence; identical to SEQ ID NO: 17250
  Description of Artificial Sequence: Synthetic polypeptide
  XENP021795 2A11_H1.127_L2_Fab Light Chain

SEQ ID NO: 27750 - protein, 107 aa, Artificial Sequence; identical to SEQ ID NO: 17251
  Description of Artificial Sequence: Synthetic polypeptide
  VL of XENP021795

SEQ ID NO: 27751 - protein, 11 aa, Artificial Sequence
  Description of Artificial Sequence: Synthetic peptide
  XENP021795 vlCDR1
QASQDIGNYLN

SEQ ID NO: 27752 - protein, 7 aa, Artificial Sequence
  Description of Artificial Sequence: Synthetic peptide
  XENP021795 vlCDR2
YTSRLHS

SEQ ID NO: 27753 - protein, 9 aa, Artificial Sequence
  Description of Artificial Sequence: Synthetic peptide
  XENP021795 vlCDR3
QQGNTLPYT

SEQ ID NO: 27754 - protein, 223 aa, Artificial Sequence; identical to SEQ ID NO: 25194
  Description of Artificial Sequence: Synthetic polypeptide
  XENP021796 2A11_H1_L2.102_Fab Heavy Chain

SEQ ID NO: 27755 - protein, 118 aa, Artificial Sequence; identical to SEQ ID NO: 17236
  Description of Artificial Sequence: Synthetic polypeptide
  VH of XENP021796

SEQ ID NO: 27756 - protein, 5 aa, Artificial Sequence
  Description of Artificial Sequence: Synthetic peptide
  XENP021796 vhCDR1
DYYMH

SEQ ID NO: 27757 - protein, 17 aa, Artificial Sequence
  Description of Artificial Sequence: Synthetic peptide
  XENP021796 vhCDR2
WIDPENGDTEYAPKFQG

SEQ ID NO: 27758 - protein, 9 aa, Artificial Sequence
  Description of Artificial Sequence: Synthetic peptide
  XENP021796 vhCDR3
RGVRQALDY

SEQ ID NO: 27759 - protein, 214 aa, Artificial Sequence
  Description of Artificial Sequence: Synthetic polypeptide
  XENP021796 2A11_H1_L2.102_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27760 - protein, 107 aa, Artificial Sequence
  Description of Artificial Sequence: Synthetic polypeptide
  VL of XENP021796
DIQMTQSPAFLSVTPGEKVTITCQASQDIGNYLNWFQQKPDQTVKLLIYYTSRLHSGVPSRFSGSGSGTDYTFTISSLEAEDAATYFCQEGNTLPYTFGGGTKVEIK

SEQ ID NO: 27761 - protein, 11 aa, Artificial Sequence
  Description of Artificial Sequence: Synthetic peptide
  XENP021796 vlCDR1
QASQDIGNYLN

SEQ ID NO: 27762 - protein, 7 aa, Artificial Sequence
  Description of Artificial Sequence: Synthetic peptide
  XENP021796 vlCDR2
YTSRLHS

SEQ ID NO: 27763 - protein, 9 aa, Artificial Sequence
  Description of Artificial Sequence: Synthetic peptide
  XENP021796 vlCDR3
QEGNTLPYT

SEQ ID NO: 27764 - protein, 223 aa, Artificial Sequence; identical to SEQ ID NO: 25194
  Description of Artificial Sequence: Synthetic polypeptide
  XENP021801 2A11_H1_L2.103_Fab Heavy Chain

SEQ ID NO: 27765 - protein, 118 aa, Artificial Sequence; identical to SEQ ID NO: 17236
  Description of Artificial Sequence: Synthetic polypeptide
  VH of XENP021801

SEQ ID NO: 27766 - protein, 5 aa, Artificial Sequence
  Description of Artificial Sequence: Synthetic peptide
  XENP021801 vhCDR1
DYYMH

SEQ ID NO: 27767 - protein, 17 aa, Artificial Sequence
  Description of Artificial Sequence: Synthetic peptide
  XENP021801 vhCDR2
WIDPENGDTEYAPKFQG

SEQ ID NO: 27768 - protein, 9 aa, Artificial Sequence
  Description of Artificial Sequence: Synthetic peptide
  XENP021801 vhCDR3
RGVRQALDY

SEQ ID NO: 27769 - protein, 214 aa, Artificial Sequence
  Description of Artificial Sequence: Synthetic polypeptide
  XENP021801 2A11_H1_L2.103_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQHGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27770 - protein, 107 aa, Artificial Sequence
  Description of Artificial Sequence: Synthetic polypeptide
  VL of XENP021801
DIQMTQSPAFLSVTPGEKVTITCQASQDIGNYLNWFQQKPDQTVKLLIYYTSRLHSGVPSRFSGSGSGTDYTFTISSLEAEDAATYFCQHGNTLPYTFGGGTKVEIK

SEQ ID NO: 27771 - protein, 11 aa, Artificial Sequence
  Description of Artificial Sequence: Synthetic peptide
  XENP021801 vlCDR1
QASQDIGNYLN

SEQ ID NO: 27772 - protein, 7 aa, Artificial Sequence
  Description of Artificial Sequence: Synthetic peptide
  XENP021801 vlCDR2
YTSRLHS

SEQ ID NO: 27773 - protein, 9 aa, Artificial Sequence
  Description of Artificial Sequence: Synthetic peptide
  XENP021801 vlCDR3
QHGNTLPYT

SEQ ID NO: 27774 - protein, 223 aa, Artificial Sequence; identical to SEQ ID NO: 25194
  Description of Artificial Sequence: Synthetic polypeptide
  XENP021802 2A11_H1_L2.104_Fab Heavy Chain

SEQ ID NO: 27775 - protein, 118 aa, Artificial Sequence; identical to SEQ ID NO: 17236
  Description of Artificial Sequence: Synthetic polypeptide
  VH of XENP021802

SEQ ID NO: 27776 - protein, 5 aa, Artificial Sequence
  Description of Artificial Sequence: Synthetic peptide
  XENP021802 vhCDR1
DYYMH

SEQ ID NO: 27777 - protein, 17 aa, Artificial Sequence
  Description of Artificial Sequence: Synthetic peptide
  XENP021802 vhCDR2
WIDPENGDTEYAPKFQG

SEQ ID NO: 27778 - protein, 9 aa, Artificial Sequence
  Description of Artificial Sequence: Synthetic peptide
  XENP021802 vhCDR3
RGVRQALDY

SEQ ID NO: 27779 - protein, 214 aa, Artificial Sequence
  Description of Artificial Sequence: Synthetic polypeptide
  XENP021802 2A11_H1_L2.104_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQKGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27780 - protein, 107 aa, Artificial Sequence
  Description of Artificial Sequence: Synthetic polypeptide
  VL of XENP021802
DIQMTQSPAFLSVTPGEKVTITCQASQDIGNYLNWFQQKPDQTVKLLIYYTSRLHSGVPSRFSGSGSGTDYTFTISSLEAEDAATYFCQKGNTLPYTFGGGTKVEIK

SEQ ID NO: 27781 - protein, 11 aa, Artificial Sequence
  Description of Artificial Sequence: Synthetic peptide
  XENP021802 vlCDR1
QASQDIGNYLN

SEQ ID NO: 27782 - protein, 7 aa, Artificial Sequence
  Description of Artificial Sequence: Synthetic peptide
  XENP021802 vlCDR2
YTSRLHS

SEQ ID NO: 27783 - protein, 9 aa, Artificial Sequence
  Description of Artificial Sequence: Synthetic peptide
  XENP021802 vlCDR3
QKGNTLPYT

SEQ ID NO: 27784 - protein, 223 aa, Artificial Sequence; identical to SEQ ID NO: 25194
  Description of Artificial Sequence: Synthetic polypeptide
  XENP021803 2A11_H1_L2.105_Fab Heavy Chain

SEQ ID NO: 27785 - protein, 118 aa, Artificial Sequence; identical to SEQ ID NO: 17236
  Description of Artificial Sequence: Synthetic polypeptide
  VH of XENP021803

SEQ ID NO: 27786 - protein, 5 aa, Artificial Sequence
  Description of Artificial Sequence: Synthetic peptide
  XENP021803 vhCDR1
DYYMH

SEQ ID NO: 27787 - protein, 17 aa, Artificial Sequence
  Description of Artificial Sequence: Synthetic peptide
  XENP021803 vhCDR2
WIDPENGDTEYAPKFQG

SEQ ID NO: 27788 - protein, 9 aa, Artificial Sequence
  Description of Artificial Sequence: Synthetic peptide
  XENP021803 vhCDR3
RGVRQALDY

SEQ ID NO: 27789 - protein, 214 aa, Artificial Sequence
  Description of Artificial Sequence: Synthetic polypeptide
  XENP021803 2A11_H1_L2.105_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQTGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27790 - protein, 107 aa, Artificial Sequence
  Description of Artificial Sequence: Synthetic polypeptide
  VL of XENP021803
DIQMTQSPAFLSVTPGEKVTITCQASQDIGNYLNWFQQKPDQTVKLLIYYTSRLHSGVPSRFSGSGSGTDYTFTISSLEAEDAATYFCQTGNTLPYTFGGGTKVEIK

SEQ ID NO: 27791 - protein, 11 aa, Artificial Sequence
  Description of Artificial Sequence: Synthetic peptide
  XENP021803 vlCDR1
QASQDIGNYLN

SEQ ID NO: 27792 - protein, 7 aa, Artificial Sequence
  Description of Artificial Sequence: Synthetic peptide
  XENP021803 vlCDR2
YTSRLHS

SEQ ID NO: 27793 - protein, 9 aa, Artificial Sequence
  Description of Artificial Sequence: Synthetic peptide
  XENP021803 vlCDR3
QTGNTLPYT

SEQ ID NO: 27794 - protein, 223 aa, Artificial Sequence; identical to SEQ ID NO: 25194
  Description of Artificial Sequence: Synthetic polypeptide
  XENP021804 2A11_H1_L2.106_Fab Heavy Chain

SEQ ID NO: 27795 - protein, 118 aa, Artificial Sequence; identical to SEQ ID NO: 17236
  Description of Artificial Sequence: Synthetic polypeptide
  VH of XENP021804

SEQ ID NO: 27796 - protein, 5 aa, Artificial Sequence
  Description of Artificial Sequence: Synthetic peptide
  XENP021804 vhCDR1
DYYMH

SEQ ID NO: 27797 - protein, 17 aa, Artificial Sequence
  Description of Artificial Sequence: Synthetic peptide
  XENP021804 vhCDR2
WIDPENGDTEYAPKFQG

SEQ ID NO: 27798 - protein, 9 aa, Artificial Sequence
  Description of Artificial Sequence: Synthetic peptide
  XENP021804 vhCDR3
RGVRQALDY

SEQ ID NO: 27799 - protein, 214 aa, Artificial Sequence
  Description of Artificial Sequence: Synthetic polypeptide
  XENP021804 2A11_H1_L2.106_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQRGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27800 - protein, 107 aa, Artificial Sequence
  Description of Artificial Sequence: Synthetic polypeptide
  VL of XENP021804
DIQMTQSPAFLSVTPGEKVTITCQASQDIGNYLNWFQQKPDQTVKLLIYYTSRLHSGVPSRFSGSGSGTDYTFTISSLEAEDAATYFCQRGNTLPYTFGGGTKVEIK

SEQ ID NO: 27801 - protein, 11 aa, Artificial Sequence
  Description of Artificial Sequence: Synthetic peptide
  XENP021804 vlCDR1
QASQDIGNYLN

SEQ ID NO: 27802 - protein, 7 aa, Artificial Sequence
  Description of Artificial Sequence: Synthetic peptide
  XENP021804 vlCDR2
YTSRLHS

SEQ ID NO: 27803 - protein, 9 aa, Artificial Sequence
  Description of Artificial Sequence: Synthetic peptide
  XENP021804 vlCDR3
QRGNTLPYT

SEQ ID NO: 27804 - protein, 223 aa, Artificial Sequence; identical to SEQ ID NO: 25194
  Description of Artificial Sequence: Synthetic polypeptide
  XENP021805 2A11_H1_L2.107_Fab Heavy Chain

SEQ ID NO: 27805 - protein, 118 aa, Artificial Sequence; identical to SEQ ID NO: 17236
  Description of Artificial Sequence: Synthetic polypeptide
  VH of XENP021805

SEQ ID NO: 27806 - protein, 5 aa, Artificial Sequence
  Description of Artificial Sequence: Synthetic peptide
  XENP021805 vhCDR1
DYYMH

SEQ ID NO: 27807 - protein, 17 aa, Artificial Sequence
  Description of Artificial Sequence: Synthetic peptide
  XENP021805 vhCDR2
WIDPENGDTEYAPKFQG

SEQ ID NO: 27808 - protein, 9 aa, Artificial Sequence
  Description of Artificial Sequence: Synthetic peptide
  XENP021805 vhCDR3
RGVRQALDY

SEQ ID NO: 27809 - protein, 214 aa, Artificial Sequence
  Description of Artificial Sequence: Synthetic polypeptide
  XENP021805 2A11_H1_L2.107_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQIGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27810 - protein, 107 aa, Artificial Sequence
  Description of Artificial Sequence: Synthetic polypeptide
  VL of XENP021805
DIQMTQSPAFLSVTPGEKVTITCQASQDIGNYLNWFQQKPDQTVKLLIYYTSRLHSGVPSRFSGSGSGTDYTFTISSLEAEDAATYFCQIGNTLPYTFGGGTKVEIK

SEQ ID NO: 27811 - protein, 11 aa, Artificial Sequence
  Description of Artificial Sequence: Synthetic peptide
  XENP021805 vlCDR1
QASQDIGNYLN

SEQ ID NO: 27812 - protein, 7 aa, Artificial Sequence
  Description of Artificial Sequence: Synthetic peptide
  XENP021805 vlCDR2
YTSRLHS

SEQ ID NO: 27813 - protein, 9 aa, Artificial Sequence
  Description of Artificial Sequence: Synthetic peptide
  XENP021805 vlCDR3
QIGNTLPYT

SEQ ID NO: 27814 - protein, 223 aa, Artificial Sequence; identical to SEQ ID NO: 25194
  Description of Artificial Sequence: Synthetic polypeptide
  XENP021806 2A11_H1_L2.108_Fab Heavy Chain

SEQ ID NO: 27815 - protein, 118 aa, Artificial Sequence; identical to SEQ ID NO: 17236
  Description of Artificial Sequence: Synthetic polypeptide
  VH of XENP021806

SEQ ID NO: 27816 - protein, 5 aa, Artificial Sequence
  Description of Artificial Sequence: Synthetic peptide
  XENP021806 vhCDR1
DYYMH

SEQ ID NO: 27817 - protein, 17 aa, Artificial Sequence
  Description of Artificial Sequence: Synthetic peptide
  XENP021806 vhCDR2
WIDPENGDTEYAPKFQG

SEQ ID NO: 27818 - protein, 9 aa, Artificial Sequence
  Description of Artificial Sequence: Synthetic peptide
  XENP021806 vhCDR3
RGVRQALDY

SEQ ID NO: 27819 - protein, 214 aa, Artificial Sequence
  Description of Artificial Sequence: Synthetic polypeptide
  XENP021806 2A11_H1_L2.108_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQYGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27820 - protein, 107 aa, Artificial Sequence
  Description of Artificial Sequence: Synthetic polypeptide
  VL of XENP021806
DIQMTQSPAFLSVTPGEKVTITCQASQDIGNYLNWFQQKPDQTVKLLIYYTSRLHSGVPSRFSGSGSGTDYTFTISSLEAEDAATYFCQYGNTLPYTFGGGTKVEIK

SEQ ID NO: 27821 - protein, 11 aa, Artificial Sequence
  Description of Artificial Sequence: Synthetic peptide
  XENP021806 vlCDR1
QASQDIGNYLN

SEQ ID NO: 27822 - protein, 7 aa, Artificial Sequence
  Description of Artificial Sequence: Synthetic peptide
  XENP021806 vlCDR2
YTSRLHS

SEQ ID NO: 27823 - protein, 9 aa, Artificial Sequence
  Description of Artificial Sequence: Synthetic peptide
  XENP021806 vlCDR3
QYGNTLPYT

SEQ ID NO: 27824 - protein, 223 aa, Artificial Sequence; identical to SEQ ID NO: 25194
  Description of Artificial Sequence: Synthetic polypeptide
  XENP021807 2A11_H1_L2.109_Fab Heavy Chain

SEQ ID NO: 27825 - protein, 118 aa, Artificial Sequence; identical to SEQ ID NO: 17236
  Description of Artificial Sequence: Synthetic polypeptide
  VH of XENP021807

SEQ ID NO: 27826 - protein, 5 aa, Artificial Sequence
  Description of Artificial Sequence: Synthetic peptide
  XENP021807 vhCDR1
DYYMH

SEQ ID NO: 27827 - protein, 17 aa, Artificial Sequence
  Description of Artificial Sequence: Synthetic peptide
  XENP021807 vhCDR2
WIDPENGDTEYAPKFQG

SEQ ID NO: 27828 - protein, 9 aa, Artificial Sequence
  Description of Artificial Sequence: Synthetic peptide
  XENP021807 vhCDR3
RGVRQALDY

SEQ ID NO: 27829 - protein, 214 aa, Artificial Sequence
  Description of Artificial Sequence: Synthetic polypeptide
  XENP021807 2A11_H1_L2.109_Fab Light Chain
DIQMTQSPAFLSVTPGEKVTITCQASQDIGNYLNWFQQKPDQTVKLLIYFTSRLHSGVPSRFSGSGSGTDYTFTISSLEAEDAATYFCQQGHQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27830 - protein, 107 aa, Artificial Sequence
  Description of Artificial Sequence: Synthetic polypeptide
  VL of XENP021807
DIQMTQSPAFLSVTPGEKVTITCQASQDIGNYLNWFQQKPDQTVKLLIYFTSRLHSGVPSRFSGSGSGTDYTFTISSLEAEDAATYFCQQGHQLPYTFGGGTKVEIK

SEQ ID NO: 27831 - protein, 11 aa, Artificial Sequence
  Description of Artificial Sequence: Synthetic peptide
  XENP021807 vlCDR1
QASQDIGNYLN

SEQ ID NO: 27832 - protein, 7 aa, Artificial Sequence
  Description of Artificial Sequence: Synthetic peptide
  XENP021807 vlCDR2
FTSRLHS

SEQ ID NO: 27833 - protein, 9 aa, Artificial Sequence
  Description of Artificial Sequence: Synthetic peptide
  XENP021807 vlCDR3
QQGHQLPYT

SEQ ID NO: 27834 - protein, 223 aa, Artificial Sequence; identical to SEQ ID NO: 25194
  Description of Artificial Sequence: Synthetic polypeptide
  XENP021808 2A11_H1_L2.110_Fab Heavy Chain

SEQ ID NO: 27835 - protein, 118 aa, Artificial Sequence; identical to SEQ ID NO: 17236
  Description of Artificial Sequence: Synthetic polypeptide
  VH of XENP021808

SEQ ID NO: 27836 - protein, 5 aa, Artificial Sequence
  Description of Artificial Sequence: Synthetic peptide
  XENP021808 vhCDR1
DYYMH

SEQ ID NO: 27837 - protein, 17 aa, Artificial Sequence
  Description of Artificial Sequence: Synthetic peptide
  XENP021808 vhCDR2
WIDPENGDTEYAPKFQG

SEQ ID NO: 27838 - protein, 9 aa, Artificial Sequence
  Description of Artificial Sequence: Synthetic peptide
  XENP021808 vhCDR3
RGVRQALDY

SEQ ID NO: 27839 - protein, 214 aa, Artificial Sequence
  Description of Artificial Sequence: Synthetic polypeptide
  XENP021808 2A11_H1_L2.110_Fab Light Chain
DIQMTQSPAFLSVTPGEKVTITCQASQDIGNYLNWFQQKPDQTVKLLIYYTSHLHSGVPSRFSGSGSGTDYTFTISSLEAEDAATYFCQQGHQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27840 - protein, 107 aa, Artificial Sequence
  Description of Artificial Sequence: Synthetic polypeptide
  VL of XENP021808
DIQMTQSPAFLSVTPGEKVTITCQASQDIGNYLNWFQQKPDQTVKLLIYYTSHLHSGVPSRFSGSGSGTDYTFTISSLEAEDAATYFCQQGHQLPYTFGGGTKVEIK

SEQ ID NO: 27841 - protein, 11 aa, Artificial Sequence
  Description of Artificial Sequence: Synthetic peptide
  XENP021808 vlCDR1
QASQDIGNYLN

SEQ ID NO: 27842 - protein, 7 aa, Artificial Sequence
  Description of Artificial Sequence: Synthetic peptide
  XENP021808 vlCDR2
YTSHLHS

SEQ ID NO: 27843 - protein, 9 aa, Artificial Sequence
  Description of Artificial Sequence: Synthetic peptide
  XENP021808 vlCDR3
QQGHQLPYT

SEQ ID NO: 27844 - protein, 223 aa, Artificial Sequence; identical to SEQ ID NO: 25194
  Description of Artificial Sequence: Synthetic polypeptide
  XENP021809 2A11_H1_L2.111_Fab Heavy Chain

SEQ ID NO: 27845 - protein, 118 aa, Artificial Sequence; identical to SEQ ID NO: 17236
  Description of Artificial Sequence: Synthetic polypeptide
  VH of XENP021809

SEQ ID NO: 27846 - protein, 5 aa, Artificial Sequence
  Description of Artificial Sequence: Synthetic peptide
  XENP021809 vhCDR1
DYYMH

SEQ ID NO: 27847 - protein, 17 aa, Artificial Sequence
  Description of Artificial Sequence: Synthetic peptide
  XENP021809 vhCDR2
WIDPENGDTEYAPKFQG

SEQ ID NO: 27848 - protein, 9 aa, Artificial Sequence
  Description of Artificial Sequence: Synthetic peptide
  XENP021809 vhCDR3
RGVRQALDY

SEQ ID NO: 27849 - protein, 214 aa, Artificial Sequence
  Description of Artificial Sequence: Synthetic polypeptide
  XENP021809 2A11_H1_L2.111_Fab Light Chain
DIQMTQSPAFLSVTPGEKVTITCQASQDIGNYLNWFQQKPDQTVKLLIYYTSYLHSGVPSRFSGSGSGTDYTFTISSLEAEDAATYFCQQGHQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27850 - protein, 107 aa, Artificial Sequence
  Description of Artificial Sequence: Synthetic polypeptide
  VL of XENP021809
DIQMTQSPAFLSVTPGEKVTITCQASQDIGNYLNWFQQKPDQTVKLLIYYTSYLHSGVPSRFSGSGSGTDYTFTISSLEAEDAATYFCQQGHQLPYTFGGGTKVEIK

SEQ ID NO: 27851 - protein, 11 aa, Artificial Sequence
  Description of Artificial Sequence: Synthetic peptide
  XENP021809 vlCDR1
QASQDIGNYLN

SEQ ID NO: 27852 - protein, 7 aa, Artificial Sequence
  Description of Artificial Sequence: Synthetic peptide
  XENP021809 vlCDR2
YTSYLHS

SEQ ID NO: 27853 - protein, 9 aa, Artificial Sequence
  Description of Artificial Sequence: Synthetic peptide
  XENP021809 vlCDR3
QQGHQLPYT

SEQ ID NO: 27854 - protein, 223 aa, Artificial Sequence; identical to SEQ ID NO: 25194
  Description of Artificial Sequence: Synthetic polypeptide
  XENP021810 2A11_H1_L2.112_Fab Heavy Chain

SEQ ID NO: 27855 - protein, 118 aa, Artificial Sequence; identical to SEQ ID NO: 17236
  Description of Artificial Sequence: Synthetic polypeptide
  VH of XENP021810

SEQ ID NO: 27856 - protein, 5 aa, Artificial Sequence
  Description of Artificial Sequence: Synthetic peptide
  XENP021810 vhCDR1
DYYMH

SEQ ID NO: 27857 - protein, 17 aa, Artificial Sequence
  Description of Artificial Sequence: Synthetic peptide
  XENP021810 vhCDR2
WIDPENGDTEYAPKFQG

SEQ ID NO: 27858 - protein, 9 aa, Artificial Sequence
  Description of Artificial Sequence: Synthetic peptide
  XENP021810 vhCDR3
RGVRQALDY

SEQ ID NO: 27859 - protein, 214 aa, Artificial Sequence
  Description of Artificial Sequence: Synthetic polypeptide
  XENP021810 2A11_H1_L2.112_Fab Light Chain
DIQMTQSPAFLSVTPGEKVTITCQASQDIGNYLNWFQQKPDQTVKLLIYFTSHLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27860 - protein, 107 aa, Artificial Sequence
  Description of Artificial Sequence: Synthetic polypeptide
  VL of XENP021810
DIQMTQSPAFLSVTPGEKVTITCQASQDIGNYLNWFQQKPDQTVKLLIYFTSHLHSGVPSRFSGSGSGTDYTFTISSLEAEDAATYFCQQGNTLPYTFGGGTKVEIK

SEQ ID NO: 27861 - protein, 11 aa, Artificial Sequence
  Description of Artificial Sequence: Synthetic peptide
  XENP021810 vlCDR1
QASQDIGNYLN

SEQ ID NO: 27862 - protein, 7 aa, Artificial Sequence
  Description of Artificial Sequence: Synthetic peptide
  XENP021810 vlCDR2
FTSHLHS

SEQ ID NO: 27863 - protein, 9 aa, Artificial Sequence
  Description of Artificial Sequence: Synthetic peptide
  XENP021810 vlCDR3
QQGNTLPYT

SEQ ID NO: 27864 - protein, 223 aa, Artificial Sequence; identical to SEQ ID NO: 25194
  Description of Artificial Sequence: Synthetic polypeptide
  XENP021811 2A11_H1_L2.113_Fab Heavy Chain

SEQ ID NO: 27865 - protein, 118 aa, Artificial Sequence; identical to SEQ ID NO: 17236
  Description of Artificial Sequence: Synthetic polypeptide
  VH of XENP021811

SEQ ID NO: 27866 - protein, 5 aa, Artificial Sequence
  Description of Artificial Sequence: Synthetic peptide
  XENP021811 vhCDR1
DYYMH

SEQ ID NO: 27867 - protein, 17 aa, Artificial Sequence
  Description of Artificial Sequence: Synthetic peptide
  XENP021811 vhCDR2
WIDPENGDTEYAPKFQG

SEQ ID NO: 27868 - protein, 9 aa, Artificial Sequence
  Description of Artificial Sequence: Synthetic peptide
  XENP021811 vhCDR3
RGVRQALDY

SEQ ID NO: 27869 - protein, 214 aa, Artificial Sequence; identical to SEQ ID NO: 22079
  Description of Artificial Sequence: Synthetic polypeptide
  XENP021811 2A11_H1_L2.113_Fab Light Chain

SEQ ID NO: 27870 - protein, 107 aa, Artificial Sequence; identical to SEQ ID NO: 22080
  Description of Artificial Sequence: Synthetic polypeptide
  VL of XENP021811

SEQ ID NO: 27871 - protein, 11 aa, Artificial Sequence
  Description of Artificial Sequence: Synthetic peptide
  XENP021811 vlCDR1
QASQDIGNYLN

SEQ ID NO: 27872 - protein, 7 aa, Artificial Sequence
  Description of Artificial Sequence: Synthetic peptide
  XENP021811 vlCDR2
FTSYLHS

SEQ ID NO: 27873 - protein, 9 aa, Artificial Sequence
  Description of Artificial Sequence: Synthetic peptide
  XENP021811 vlCDR3
QQGNTLPYT

SEQ ID NO: 27874 - protein, 223 aa, Artificial Sequence; identical to SEQ ID NO: 25194
  Description of Artificial Sequence: Synthetic polypeptide
  XENP021812 2A11_H1_L2.114_Fab Heavy Chain

SEQ ID NO: 27875 - protein, 118 aa, Artificial Sequence; identical to SEQ ID NO: 17236
  Description of Artificial Sequence: Synthetic polypeptide
  VH of XENP021812

SEQ ID NO: 27876 - protein, 5 aa, Artificial Sequence
  Description of Artificial Sequence: Synthetic peptide
  XENP021812 vhCDR1
DYYMH

SEQ ID NO: 27877 - protein, 17 aa, Artificial Sequence
  Description of Artificial Sequence: Synthetic peptide
  XENP021812 vhCDR2
WIDPENGDTEYAPKFQG

SEQ ID NO: 27878 - protein, 9 aa, Artificial Sequence
  Description of Artificial Sequence: Synthetic peptide
  XENP021812 vhCDR3
RGVRQALDY

SEQ ID NO: 27879 - protein, 214 aa, Artificial Sequence
  Description of Artificial Sequence: Synthetic polypeptide
  XENP021812 2A11_H1_L2.114_Fab Light Chain
DIQMTQSPAFLSVTPGEKVTITCQASQDIGNYLNWFQQKPDQTVKLLIYFTSHLHSGVPSRFSGSGSGTDYTFTISSLEAEDAATYFCQQGNQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27880 - protein, 107 aa, Artificial Sequence
  Description of Artificial Sequence: Synthetic polypeptide
  VL of XENP021812
DIQMTQSPAFLSVTPGEKVTITCQASQDIGNYLNWFQQKPDQTVKLLIYFTSHLHSGVPSRFSGSGSGTDYTFTISSLEAEDAATYFCQQGNQLPYTFGGGTKVEIK

SEQ ID NO: 27881 - protein, 11 aa, Artificial Sequence
  Description of Artificial Sequence: Synthetic peptide
  XENP021812 vlCDR1
QASQDIGNYLN

SEQ ID NO: 27882 - protein, 7 aa, Artificial Sequence
  Description of Artificial Sequence: Synthetic peptide
  XENP021812 vlCDR2
FTSHLHS

SEQ ID NO: 27883 - protein, 9 aa, Artificial Sequence
  Description of Artificial Sequence: Synthetic peptide
  XENP021812 vlCDR3
QQGNQLPYT

SEQ ID NO: 27884 - protein, 223 aa, Artificial Sequence; identical to SEQ ID NO: 25194
  Description of Artificial Sequence: Synthetic polypeptide
  XENP021813 2A11_H1_L2.115_Fab Heavy Chain

SEQ ID NO: 27885 - protein, 118 aa, Artificial Sequence; identical to SEQ ID NO: 17236
  Description of Artificial Sequence: Synthetic polypeptide
  VH of XENP021813

SEQ ID NO: 27886 - protein, 5 aa, Artificial Sequence
  Description of Artificial Sequence: Synthetic peptide
  XENP021813 vhCDR1
DYYMH

SEQ ID NO: 27887 - protein, 17 aa, Artificial Sequence
  Description of Artificial Sequence: Synthetic peptide
  XENP021813 vhCDR2
WIDPENGDTEYAPKFQG

SEQ ID NO: 27888 - protein, 9 aa, Artificial Sequence
  Description of Artificial Sequence: Synthetic peptide
  XENP021813 vhCDR3
RGVRQALDY

SEQ ID NO: 27889 - protein, 214 aa, Artificial Sequence
  Description of Artificial Sequence: Synthetic polypeptide
  XENP021813 2A11_H1_L2.115_Fab Light Chain
DIQMTQSPAFLSVTPGEKVTITCQASQDIGNYLNWFQQKPDQTVKLLIYFTSYLHSGVPSRFSGSGSGTDYTFTISSLEAEDAATYFCQQGNQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27890 - protein, 107 aa, Artificial Sequence
  Description of Artificial Sequence: Synthetic polypeptide
  VL of XENP021813
DIQMTQSPAFLSVTPGEKVTITCQASQDIGNYLNWFQQKPDQTVKLLIYFTSYLHSGVPSRFSGSGSGTDYTFTISSLEAEDAATYFCQQGNQLPYTFGGGTKVEIK

SEQ ID NO: 27891 - protein, 11 aa, Artificial Sequence
  Description of Artificial Sequence: Synthetic peptide
  XENP021813 vlCDR1
QASQDIGNYLN

SEQ ID NO: 27892 - protein, 7 aa, Artificial Sequence
  Description of Artificial Sequence: Synthetic peptide
  XENP021813 vlCDR2
FTSYLHS

SEQ ID NO: 27893 - protein, 9 aa, Artificial Sequence
  Description of Artificial Sequence: Synthetic peptide
  XENP021813 vlCDR3
QQGNQLPYT

SEQ ID NO: 27894 - protein, 223 aa, Artificial Sequence; identical to SEQ ID NO: 25194
  Description of Artificial Sequence: Synthetic polypeptide
  XENP021814 2A11_H1_L2.116_Fab Heavy Chain

SEQ ID NO: 27895 - protein, 118 aa, Artificial Sequence; identical to SEQ ID NO: 17236
  Description of Artificial Sequence: Synthetic polypeptide
  VH of XENP021814

SEQ ID NO: 27896 - protein, 5 aa, Artificial Sequence
  Description of Artificial Sequence: Synthetic peptide
  XENP021814 vhCDR1
DYYMH

SEQ ID NO: 27897 - protein, 17 aa, Artificial Sequence
  Description of Artificial Sequence: Synthetic peptide
  XENP021814 vhCDR2
WIDPENGDTEYAPKFQG

SEQ ID NO: 27898 - protein, 9 aa, Artificial Sequence
  Description of Artificial Sequence: Synthetic peptide
  XENP021814 vhCDR3
RGVRQALDY

SEQ ID NO: 27899 - protein, 214 aa, Artificial Sequence; identical to SEQ ID NO: 22119
  Description of Artificial Sequence: Synthetic polypeptide
  XENP021814 2A11_H1_L2.116_Fab Light Chain

SEQ ID NO: 27900 - protein, 107 aa, Artificial Sequence; identical to SEQ ID NO: 22120
  Description of Artificial Sequence: Synthetic polypeptide
  VL of XENP021814

SEQ ID NO: 27901 - protein, 11 aa, Artificial Sequence
  Description of Artificial Sequence: Synthetic peptide
  XENP021814 vlCDR1
QASQDIGNYLN

SEQ ID NO: 27902 - protein, 7 aa, Artificial Sequence
  Description of Artificial Sequence: Synthetic peptide
  XENP021814 vlCDR2
FTSHLHS

SEQ ID NO: 27903 - protein, 9 aa, Artificial Sequence
  Description of Artificial Sequence: Synthetic peptide
  XENP021814 vlCDR3
QQGHQLPYT

SEQ ID NO: 27904 - protein, 223 aa, Artificial Sequence; identical to SEQ ID NO: 25194
  Description of Artificial Sequence: Synthetic polypeptide
  XENP021815 2A11_H1_L2.117_Fab Heavy Chain

SEQ ID NO: 27905 - protein, 118 aa, Artificial Sequence; identical to SEQ ID NO: 17236
  Description of Artificial Sequence: Synthetic polypeptide
  VH of XENP021815

SEQ ID NO: 27906 - protein, 5 aa, Artificial Sequence
  Description of Artificial Sequence: Synthetic peptide
  XENP021815 vhCDR1
DYYMH

SEQ ID NO: 27907 - protein, 17 aa, Artificial Sequence
  Description of Artificial Sequence: Synthetic peptide
  XENP021815 vhCDR2
WIDPENGDTEYAPKFQG

SEQ ID NO: 27908 - protein, 9 aa, Artificial Sequence
  Description of Artificial Sequence: Synthetic peptide
  XENP021815 vhCDR3
RGVRQALDY

SEQ ID NO: 27909 - protein, 214 aa, Artificial Sequence
  Description of Artificial Sequence: Synthetic polypeptide
  XENP021815 2A11_H1_L2.117_Fab Light Chain
DIQMTQSPAFLSVTPGEKVTITCQASQDIGNYLNWFQQKPDQTVKLLIYFTSYLHSGVPSRFSGSGSGTDYTFTISSLEAEDAATYFCQQGHQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27910 - protein, 107 aa, Artificial Sequence
  Description of Artificial Sequence: Synthetic polypeptide
  VL of XENP021815
DIQMTQSPAFLSVTPGEKVTITCQASQDIGNYLNWFQQKPDQTVKLLIYFTSYLHSGVPSRFSGSGSGTDYTFTISSLEAEDAATYFCQQGHQLPYTFGGGTKVEIK

SEQ ID NO: 27911 - protein, 11 aa, Artificial Sequence
  Description of Artificial Sequence: Synthetic peptide
  XENP021815 vlCDR1
QASQDIGNYLN

SEQ ID NO: 27912 - protein, 7 aa, Artificial Sequence
  Description of Artificial Sequence: Synthetic peptide
  XENP021815 vlCDR2
FTSYLHS

SEQ ID NO: 27913 - protein, 9 aa, Artificial Sequence
  Description of Artificial Sequence: Synthetic peptide
  XENP021815 vlCDR3
QQGHQLPYT

SEQ ID NO: 27914 - protein, 223 aa, Artificial Sequence; identical to SEQ ID NO: 25194
  Description of Artificial Sequence: Synthetic polypeptide
  XENP021816 2A11_H1_L2.118_Fab Heavy Chain

SEQ ID NO: 27915 - protein, 118 aa, Artificial Sequence; identical to SEQ ID NO: 17236
  Description of Artificial Sequence: Synthetic polypeptide
  VH of XENP021816

SEQ ID NO: 27916 - protein, 5 aa, Artificial Sequence
  Description of Artificial Sequence: Synthetic peptide
  XENP021816 vhCDR1
DYYMH

SEQ ID NO: 27917 - protein, 17 aa, Artificial Sequence
  Description of Artificial Sequence: Synthetic peptide
  XENP021816 vhCDR2
WIDPENGDTEYAPKFQG

SEQ ID NO: 27918 - protein, 9 aa, Artificial Sequence
  Description of Artificial Sequence: Synthetic peptide
  XENP021816 vhCDR3
RGVRQALDY

SEQ ID NO: 27919 - protein, 214 aa, Artificial Sequence
  Description of Artificial Sequence: Synthetic polypeptide
  XENP021816 2A11_H1_L2.118_Fab Light Chain
DIQMTQSPAFLSVTPGEKVTITCQASQDIGNYLNWFQQKPDQTVKLLIYFTSRLHSGVPSRFSGSGSGTDYTFTISSLEAEDAATYFCQQGNQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27920 - protein, 107 aa, Artificial Sequence
  Description of Artificial Sequence: Synthetic polypeptide
  VL of XENP021816
DIQMTQSPAFLSVTPGEKVTITCQASQDIGNYLNWFQQKPDQTVKLLIYFTSRLHSGVPSRFSGSGSGTDYTFTISSLEAEDAATYFCQQGNQLPYTFGGGTKVEIK

SEQ ID NO: 27921 - protein, 11 aa, Artificial Sequence
  Description of Artificial Sequence: Synthetic peptide
  XENP021816 vlCDR1
QASQDIGNYLN

SEQ ID NO: 27922 - protein, 7 aa, Artificial Sequence
  Description of Artificial Sequence: Synthetic peptide
  XENP021816 vlCDR2
FTSRLHS

SEQ ID NO: 27923 - protein, 9 aa, Artificial Sequence
  Description of Artificial Sequence: Synthetic peptide
  XENP021816 vlCDR3
QQGNQLPYT

SEQ ID NO: 27924 - protein, 223 aa, Artificial Sequence; identical to SEQ ID NO: 25194
  Description of Artificial Sequence: Synthetic polypeptide
  XENP021817 2A11_H1_L2.119_Fab Heavy Chain

SEQ ID NO: 27925 - protein, 118 aa, Artificial Sequence; identical to SEQ ID NO: 17236
  Description of Artificial Sequence: Synthetic polypeptide
  VH of XENP021817

SEQ ID NO: 27926 - protein, 5 aa, Artificial Sequence
  Description of Artificial Sequence: Synthetic peptide
  XENP021817 vhCDR1
DYYMH

SEQ ID NO: 27927 - protein, 17 aa, Artificial Sequence
  Description of Artificial Sequence: Synthetic peptide
  XENP021817 vhCDR2
WIDPENGDTEYAPKFQG

SEQ ID NO: 27928 - protein, 9 aa, Artificial Sequence
  Description of Artificial Sequence: Synthetic peptide
  XENP021817 vhCDR3
RGVRQALDY

SEQ ID NO: 27929 - protein, 214 aa, Artificial Sequence
  Description of Artificial Sequence: Synthetic polypeptide
  XENP021817 2A11_H1_L2.119_Fab Light Chain
DIQMTQSPAFLSVTPGEKVTITCQASQDIGNYLNWFQQKPDQTVKLLIYYTSHLHSGVPSRFSGSGSGTDYTFTISSLEAEDAATYFCQQGNQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27930 - protein, 107 aa, Artificial Sequence
  Description of Artificial Sequence: Synthetic polypeptide
  VL of XENP021817
DIQMTQSPAFLSVTPGEKVTITCQASQDIGNYLNWFQQKPDQTVKLLIYYTSHLHSGVPSRFSGSGSGTDYTFTISSLEAEDAATYFCQQGNQLPYTFGGGTKVEIK

SEQ ID NO: 27931 - protein, 11 aa, Artificial Sequence
  Description of Artificial Sequence: Synthetic peptide
  XENP021817 vlCDR1
QASQDIGNYLN

SEQ ID NO: 27932 - protein, 7 aa, Artificial Sequence
  Description of Artificial Sequence: Synthetic peptide
  XENP021817 vlCDR2
YTSHLHS

SEQ ID NO: 27933 - protein, 9 aa, Artificial Sequence
  Description of Artificial Sequence: Synthetic peptide
  XENP021817 vlCDR3
QQGNQLPYT

SEQ ID NO: 27934 - protein, 223 aa, Artificial Sequence; identical to SEQ ID NO: 25194
  Description of Artificial Sequence: Synthetic polypeptide
  XENP021818 2A11_H1_L2.120_Fab Heavy Chain

SEQ ID NO: 27935 - protein, 118 aa, Artificial Sequence; identical to SEQ ID NO: 17236
  Description of Artificial Sequence: Synthetic polypeptide
  VH of XENP021818

SEQ ID NO: 27936 - protein, 5 aa, Artificial Sequence
  Description of Artificial Sequence: Synthetic peptide
  XENP021818 vhCDR1
DYYMH

SEQ ID NO: 27937 - protein, 17 aa, Artificial Sequence
  Description of Artificial Sequence: Synthetic peptide
  XENP021818 vhCDR2
WIDPENGDTEYAPKFQG

SEQ ID NO: 27938 - protein, 9 aa, Artificial Sequence
  Description of Artificial Sequence: Synthetic peptide
  XENP021818 vhCDR3
RGVRQALDY

SEQ ID NO: 27939 - protein, 214 aa, Artificial Sequence
  Description of Artificial Sequence: Synthetic polypeptide
  XENP021818 2A11_H1_L2.120_Fab Light Chain
DIQMTQSPAFLSVTPGEKVTITCQASQDIGNYLNWFQQKPDQTVKLLIYYTSYLHSGVPSRFSGSGSGTDYTFTISSLEAEDAATYFCQQGNQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27940 - protein, 107 aa, Artificial Sequence
  Description of Artificial Sequence: Synthetic polypeptide
  VL of XENP021818
DIQMTQSPAFLSVTPGEKVTITCQASQDIGNYLNWFQQKPDQTVKLLIYYTSYLHSGVPSRFSGSGSGTDYTFTISSLEAEDAATYFCQQGNQLPYTFGGGTKVEIK

SEQ ID NO: 27941 - protein, 11 aa, Artificial Sequence
  Description of Artificial Sequence: Synthetic peptide
  XENP021818 vlCDR1
QASQDIGNYLN

SEQ ID NO: 27942 - protein, 7 aa, Artificial Sequence
  Description of Artificial Sequence: Synthetic peptide
  XENP021818 vlCDR2
YTSYLHS

SEQ ID NO: 27943 - protein, 9 aa, Artificial Sequence
  Description of Artificial Sequence: Synthetic peptide
  XENP021818 vlCDR3
QQGNQLPYT

SEQ ID NO: 27944 - protein, 223 aa, Artificial Sequence; identical to SEQ ID NO: 25194
  Description of Artificial Sequence: Synthetic polypeptide
  XENP021819 2A11_H1_L2.121_Fab Heavy Chain

SEQ ID NO: 27945 - protein, 118 aa, Artificial Sequence; identical to SEQ ID NO: 17236
  Description of Artificial Sequence: Synthetic polypeptide
  VH of XENP021819

SEQ ID NO: 27946 - protein, 5 aa, Artificial Sequence
  Description of Artificial Sequence: Synthetic peptide
  XENP021819 vhCDR1
DYYMH

SEQ ID NO: 27947 - protein, 17 aa, Artificial Sequence
  Description of Artificial Sequence: Synthetic peptide
  XENP021819 vhCDR2
WIDPENGDTEYAPKFQG

SEQ ID NO: 27948 - protein, 9 aa, Artificial Sequence
  Description of Artificial Sequence: Synthetic peptide
  XENP021819 vhCDR3
RGVRQALDY

SEQ ID NO: 27949 - protein, 214 aa, Artificial Sequence
  Description of Artificial Sequence: Synthetic polypeptide
  XENP021819 2A11_H1_L2.121_Fab Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGHQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27950 - protein, 107 aa, Artificial Sequence
  Description of Artificial Sequence: Synthetic polypeptide
  VL of XENP021819
DIQMTQSPAFLSVTPGEKVTITCQASQDIGNYLNWFQQKPDQTVKLLIYYTSRLHSGVPSRFSGSGSGTDYTFTISSLEAEDAATYFCQQGHQLPYTFGGGTKVEIK

SEQ ID NO: 27951 - protein, 11 aa, Artificial Sequence
  Description of Artificial Sequence: Synthetic peptide
  XENP021819 vlCDR1
QASQDIGNYLN

SEQ ID NO: 27952 - protein, 7 aa, Artificial Sequence
  Description of Artificial Sequence: Synthetic peptide
  XENP021819 vlCDR2
YTSRLHS

SEQ ID NO: 27953 - protein, 9 aa, Artificial Sequence
  Description of Artificial Sequence: Synthetic peptide
  XENP021819 vlCDR3
QQGHQLPYT

SEQ ID NO: 27954 - protein, 223 aa, Artificial Sequence; identical to SEQ ID NO: 27384
  Description of Artificial Sequence: Synthetic polypeptide
  XENP021912 2A11_H1.117_L2.50_Fab Heavy Chain

SEQ ID NO: 27955 - protein, 118 aa, Artificial Sequence; identical to SEQ ID NO: 22105
  Description of Artificial Sequence: Synthetic polypeptide
  VH of XENP021912

SEQ ID NO: 27956 - protein, 5 aa, Artificial Sequence
  Description of Artificial Sequence: Synthetic peptide
  XENP021912 vhCDR1
HYFMH

SEQ ID NO: 27957 - protein, 17 aa, Artificial Sequence
  Description of Artificial Sequence: Synthetic peptide
  XENP021912 vhCDR2
WIDPYLGDTEYAPKFQG

SEQ ID NO: 27958 - protein, 9 aa, Artificial Sequence
  Description of Artificial Sequence: Synthetic peptide
  XENP021912 vhCDR3
RGVRQALDY

SEQ ID NO: 27959 - protein, 214 aa, Artificial Sequence; identical to SEQ ID NO: 22059
  Description of Artificial Sequence: Synthetic polypeptide
  XENP021912 2A11_H1.117_L2.50_Fab Light Chain

SEQ ID NO: 27960 - protein, 107 aa, Artificial Sequence; identical to SEQ ID NO: 22060
  Description of Artificial Sequence: Synthetic polypeptide
  VL of XENP021912

SEQ ID NO: 27961 - protein, 11 aa, Artificial Sequence
  Description of Artificial Sequence: Synthetic peptide
  XENP021912 vlCDR1
QASQDIGNYLN

SEQ ID NO: 27962 - protein, 7 aa, Artificial Sequence
  Description of Artificial Sequence: Synthetic peptide
  XENP021912 vlCDR2
YTSYLHS

SEQ ID NO: 27963 - protein, 9 aa, Artificial Sequence
  Description of Artificial Sequence: Synthetic peptide
  XENP021912 vlCDR3
QQGNTLPYT

SEQ ID NO: 27964 - protein, 223 aa, Artificial Sequence; identical to SEQ ID NO: 27734
  Description of Artificial Sequence: Synthetic polypeptide
  XENP021913 2A11_H1.125_L2.50_Fab Heavy Chain

SEQ ID NO: 27965 - protein, 118 aa, Artificial Sequence; identical to SEQ ID NO: 22065
  Description of Artificial Sequence: Synthetic polypeptide
  VH of XENP021913

SEQ ID NO: 27966 - protein, 5 aa, Artificial Sequence
  Description of Artificial Sequence: Synthetic peptide
  XENP021913 vhCDR1
HYFMH

SEQ ID NO: 27967 - protein, 17 aa, Artificial Sequence
  Description of Artificial Sequence: Synthetic peptide
  XENP021913 vhCDR2
WIDPYLGDTEYAPKFQG

SEQ ID NO: 27968 - protein, 9 aa, Artificial Sequence
  Description of Artificial Sequence: Synthetic peptide
  XENP021913 vhCDR3
RGVYQALDY

SEQ ID NO: 27969 - protein, 214 aa, Artificial Sequence; identical to SEQ ID NO: 22059
  Description of Artificial Sequence: Synthetic polypeptide
  XENP021913 2A11_H1.125_L2.50_Fab Light Chain

SEQ ID NO: 27970 - protein, 107 aa, Artificial Sequence; identical to SEQ ID NO: 22060
  Description of Artificial Sequence: Synthetic polypeptide
  VL of XENP021913

SEQ ID NO: 27971 - protein, 11 aa, Artificial Sequence
  Description of Artificial Sequence: Synthetic peptide
  XENP021913 vlCDR1
QASQDIGNYLN

SEQ ID NO: 27972 - protein, 7 aa, Artificial Sequence
  Description of Artificial Sequence: Synthetic peptide
  XENP021913 vlCDR2
YTSYLHS

SEQ ID NO: 27973 - protein, 9 aa, Artificial Sequence
  Description of Artificial Sequence: Synthetic peptide
  XENP021913 vlCDR3
QQGNTLPYT

SEQ ID NO: 27974 - protein, 223 aa, Artificial Sequence; identical to SEQ ID NO: 27464
  Description of Artificial Sequence: Synthetic polypeptide
  XENP021914 2A11_H1.126_L2.50_Fab Heavy Chain

SEQ ID NO: 27975 - protein, 118 aa, Artificial Sequence; identical to SEQ ID NO: 27465
  Description of Artificial Sequence: Synthetic polypeptide
  VH of XENP021914

SEQ ID NO: 27976 - protein, 5 aa, Artificial Sequence
  Description of Artificial Sequence: Synthetic peptide
  XENP021914 vhCDR1
HYFMH

SEQ ID NO: 27977 - protein, 17 aa, Artificial Sequence
  Description of Artificial Sequence: Synthetic peptide
  XENP021914 vhCDR2
WIDPYTGDTEYAPKFQG

SEQ ID NO: 27978 - protein, 9 aa, Artificial Sequence
  Description of Artificial Sequence: Synthetic peptide
  XENP021914 vhCDR3
RGVYQALDY

SEQ ID NO: 27979 - protein, 214 aa, Artificial Sequence; identical to SEQ ID NO: 22059
  Description of Artificial Sequence: Synthetic polypeptide
  XENP021914 2A11_H1.126_L2.50_Fab Light Chain

SEQ ID NO: 27980 - protein, 107 aa, Artificial Sequence; identical to SEQ ID NO: 22060
  Description of Artificial Sequence: Synthetic polypeptide
  VL of XENP021914

SEQ ID NO: 27981 - protein, 11 aa, Artificial Sequence
  Description of Artificial Sequence: Synthetic peptide
  XENP021914 vlCDR1
QASQDIGNYLN

SEQ ID NO: 27982 - protein, 7 aa, Artificial Sequence
  Description of Artificial Sequence: Synthetic peptide
  XENP021914 vlCDR2
YTSYLHS

SEQ ID NO: 27983 - protein, 9 aa, Artificial Sequence
  Description of Artificial Sequence: Synthetic peptide
  XENP021914 vlCDR3
QQGNTLPYT

SEQ ID NO: 27984 - protein, 223 aa, Artificial Sequence; identical to SEQ ID NO: 27634
  Description of Artificial Sequence: Synthetic polypeptide
  XENP021915 2A11_H1.144_L2.50_Fab Heavy Chain

SEQ ID NO: 27985 - protein, 118 aa, Artificial Sequence; identical to SEQ ID NO: 22085
  Description of Artificial Sequence: Synthetic polypeptide
  VH of XENP021915

SEQ ID NO: 27986 - protein, 5 aa, Artificial Sequence
  Description of Artificial Sequence: Synthetic peptide
  XENP021915 vhCDR1
DYFMH

SEQ ID NO: 27987 - protein, 17 aa, Artificial Sequence
  Description of Artificial Sequence: Synthetic peptide
  XENP021915 vhCDR2
WIDPELGDTEYAPKFQG

SEQ ID NO: 27988 - protein, 9 aa, Artificial Sequence
  Description of Artificial Sequence: Synthetic peptide
  XENP021915 vhCDR3
RGVYQALDY

SEQ ID NO: 27989 - protein, 214 aa, Artificial Sequence; identical to SEQ ID NO: 22059
  Description of Artificial Sequence: Synthetic polypeptide
  XENP021915 2A11_H1.144_L2.50_Fab Light Chain

SEQ ID NO: 27990 - protein, 107 aa, Artificial Sequence; identical to SEQ ID NO: 22060
  Description of Artificial Sequence: Synthetic polypeptide
  VL of XENP021915

SEQ ID NO: 27991 - protein, 11 aa, Artificial Sequence
  Description of Artificial Sequence: Synthetic peptide
  XENP021915 vlCDR1
QASQDIGNYLN

SEQ ID NO: 27992 - protein, 7 aa, Artificial Sequence
  Description of Artificial Sequence: Synthetic peptide
  XENP021915 vlCDR2
YTSYLHS

SEQ ID NO: 27993 - protein, 9 aa, Artificial Sequence
  Description of Artificial Sequence: Synthetic peptide
  XENP021915 vlCDR3
QQGNTLPYT

SEQ ID NO: 27994 - protein, 223 aa, Artificial Sequence; identical to SEQ ID NO: 27474
  Description of Artificial Sequence: Synthetic polypeptide
  XENP021916 2A11_H1.127_L2.50_Fab Heavy Chain

SEQ ID NO: 27995 - protein, 118 aa, Artificial Sequence; identical to SEQ ID NO: 27475
  Description of Artificial Sequence: Synthetic polypeptide
  VH of XENP021916

SEQ ID NO: 27996 - protein, 5 aa, Artificial Sequence
  Description of Artificial Sequence: Synthetic peptide
  XENP021916 vhCDR1
HYFMH

SEQ ID NO: 27997 - protein, 17 aa, Artificial Sequence
  Description of Artificial Sequence: Synthetic peptide
  XENP021916 vhCDR2
WIDPELGDTEYAPKFQG

SEQ ID NO: 27998 - protein, 9 aa, Artificial Sequence
  Description of Artificial Sequence: Synthetic peptide
  XENP021916 vhCDR3
RGVYQALDY

SEQ ID NO: 27999 - protein, 214 aa, Artificial Sequence; identical to SEQ ID NO: 22059
  Description of Artificial Sequence: Synthetic polypeptide
  XENP021916 2A11_H1.127_L2.50_Fab Light Chain

SEQ ID NO: 28000 - protein, 107 aa, Artificial Sequence; identical to SEQ ID NO: 22060
  Description of Artificial Sequence: Synthetic polypeptide
  VL of XENP021916

SEQ ID NO: 28001 - protein, 11 aa, Artificial Sequence
  Description of Artificial Sequence: Synthetic peptide
  XENP021916 vlCDR1
QASQDIGNYLN

SEQ ID NO: 28002 - protein, 7 aa, Artificial Sequence
  Description of Artificial Sequence: Synthetic peptide
  XENP021916 vlCDR2
YTSYLHS

SEQ ID NO: 28003 - protein, 9 aa, Artificial Sequence
  Description of Artificial Sequence: Synthetic peptide
  XENP021916 vlCDR3
QQGNTLPYT

SEQ ID NO: 28004 - protein, 223 aa, Artificial Sequence; identical to SEQ ID NO: 27554
  Description of Artificial Sequence: Synthetic polypeptide
  XENP021917 2A11_H1.136_L2.50_Fab Heavy Chain

SEQ ID NO: 28005 - protein, 118 aa, Artificial Sequence; identical to SEQ ID NO: 27555
  Description of Artificial Sequence: Synthetic polypeptide
  VH of XENP021917

SEQ ID NO: 28006 - protein, 5 aa, Artificial Sequence
  Description of Artificial Sequence: Synthetic peptide
  XENP021917 vhCDR1
HYYMH

SEQ ID NO: 28007 - protein, 17 aa, Artificial Sequence
  Description of Artificial Sequence: Synthetic peptide
  XENP021917 vhCDR2
WIDPYLGDTEYAPKFQG

SEQ ID NO: 28008 - protein, 9 aa, Artificial Sequence
  Description of Artificial Sequence: Synthetic peptide
  XENP021917 vhCDR3
RGVYQALDY

SEQ ID NO: 28009 - protein, 214 aa, Artificial Sequence; identical to SEQ ID NO: 22059
  Description of Artificial Sequence: Synthetic polypeptide
  XENP021917 2A11_H1.136_L2.50_Fab Light Chain

SEQ ID NO: 28010 - protein, 107 aa, Artificial Sequence; identical to SEQ ID NO: 22060
  Description of Artificial Sequence: Synthetic polypeptide
  VL of XENP021917

SEQ ID NO: 28011 - protein, 11 aa, Artificial Sequence
  Description of Artificial Sequence: Synthetic peptide
  XENP021917 vlCDR1
QASQDIGNYLN

SEQ ID NO: 28012 - protein, 7 aa, Artificial Sequence
  Description of Artificial Sequence: Synthetic peptide
  XENP021917 vlCDR2
YTSYLHS

SEQ ID NO: 28013 - protein, 9 aa, Artificial Sequence
  Description of Artificial Sequence: Synthetic peptide
  XENP021917 vlCDR3
QQGNTLPYT

SEQ ID NO: 28014 - protein, 223 aa, Artificial Sequence
  Description of Artificial Sequence: Synthetic polypeptide
  XENP021918 2A11_H1.154_L2.50_Fab Heavy Chain
EVQLVQSGAEVKKPGATVKISCKASGFNIKDYYMHWVQQAPGKGLEWMGWIDPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28015 - protein, 118 aa, Artificial Sequence
  Description of Artificial Sequence: Synthetic polypeptide
  VH of XENP021918
EVQLVQSGAEVKKPGATVKISCKASGFNIKDYYMHWVQQAPGKGLEWMGWIDPELGDTEYAPKFQGRVTITADTSTNTAYMELSSLRSEDTAVYYCYARGVYQALDYWGQGTLVTVSS

SEQ ID NO: 28016 - protein, 5 aa, Artificial Sequence
  Description of Artificial Sequence: Synthetic peptide
  XENP021918 vhCDR1
DYYMH

SEQ ID NO: 28017 - protein, 17 aa, Artificial Sequence
  Description of Artificial Sequence: Synthetic peptide
  XENP021918 vhCDR2
WIDPELGDTEYAPKFQG

SEQ ID NO: 28018 - protein, 9 aa, Artificial Sequence
  Description of Artificial Sequence: Synthetic peptide
  XENP021918 vhCDR3
RGVYQALDY

SEQ ID NO: 28019 - protein, 214 aa, Artificial Sequence; identical to SEQ ID NO: 22059
  Description of Artificial Sequence: Synthetic polypeptide
  XENP021918 2A11_H1.154_L2.50_Fab Light Chain

SEQ ID NO: 28020 - protein, 107 aa, Artificial Sequence; identical to SEQ ID NO: 22060
  Description of Artificial Sequence: Synthetic polypeptide
  VL of XENP021918

SEQ ID NO: 28021 - protein, 11 aa, Artificial Sequence
  Description of Artificial Sequence: Synthetic peptide
  XENP021918 vlCDR1
QASQDIGNYLN

SEQ ID NO: 28022 - protein, 7 aa, Artificial Sequence
  Description of Artificial Sequence: Synthetic peptide
  XENP021918 vlCDR2
YTSYLHS

SEQ ID NO: 28023 - protein, 9 aa, Artificial Sequence
  Description of Artificial Sequence: Synthetic peptide
  XENP021918 vlCDR3
QQGNTLPYT

SEQ ID NO: 28024 - protein, 223 aa, Artificial Sequence; identical to SEQ ID NO: 27604
  Description of Artificial Sequence: Synthetic polypeptide
  XENP021919 2A11_H1.141_L2.50_Fab Heavy Chain

SEQ ID NO: 28025 - protein, 118 aa, Artificial Sequence; identical to SEQ ID NO: 27605
  Description of Artificial Sequence: Synthetic polypeptide
  VH of XENP021919

SEQ ID NO: 28026 - protein, 5 aa, Artificial Sequence
  Description of Artificial Sequence: Synthetic peptide
  XENP021919 vhCDR1
DYFMH

SEQ ID NO: 28027 - protein, 17 aa, Artificial Sequence
  Description of Artificial Sequence: Synthetic peptide
  XENP021919 vhCDR2
WIDPELGDTEYAPKFQG

SEQ ID NO: 28028 - protein, 9 aa, Artificial Sequence
  Description of Artificial Sequence: Synthetic peptide
  XENP021919 vhCDR3
RGVRQALDY

SEQ ID NO: 28029 - protein, 214 aa, Artificial Sequence; identical to SEQ ID NO: 22059
  Description of Artificial Sequence: Synthetic polypeptide
  XENP021919 2A11_H1.141_L2.50_Fab Light Chain

SEQ ID NO: 28030 - protein, 107 aa, Artificial Sequence; identical to SEQ ID NO: 22060
  Description of Artificial Sequence: Synthetic polypeptide
  VL of XENP021919

SEQ ID NO: 28031 - protein, 11 aa, Artificial Sequence
  Description of Artificial Sequence: Synthetic peptide
  XENP021919 vlCDR1
QASQDIGNYLN

SEQ ID NO: 28032 - protein, 7 aa, Artificial Sequence
  Description of Artificial Sequence: Synthetic peptide
  XENP021919 vlCDR2
YTSYLHS

SEQ ID NO: 28033 - protein, 9 aa, Artificial Sequence
  Description of Artificial Sequence: Synthetic peptide
  XENP021919 vlCDR3
QQGNTLPYT

SEQ ID NO: 28034 - protein, 223 aa, Artificial Sequence; identical to SEQ ID NO: 27384
  Description of Artificial Sequence: Synthetic polypeptide
  XENP021920 2A11_H1.117_L2.113_Fab Heavy Chain

SEQ ID NO: 28035 - protein, 118 aa, Artificial Sequence; identical to SEQ ID NO: 22105
  Description of Artificial Sequence: Synthetic polypeptide
  VH of XENP021920

SEQ ID NO: 28036 - protein, 5 aa, Artificial Sequence
  Description of Artificial Sequence: Synthetic peptide
  XENP021920 vhCDR1
HYFMH

SEQ ID NO: 28037 - protein, 17 aa, Artificial Sequence
  Description of Artificial Sequence: Synthetic peptide
  XENP021920 vhCDR2
WIDPYLGDTEYAPKFQG

SEQ ID NO: 28038 - protein, 9 aa, Artificial Sequence
  Description of Artificial Sequence: Synthetic peptide
  XENP021920 vhCDR3
RGVRQALDY

SEQ ID NO: 28039 - protein, 214 aa, Artificial Sequence; identical to SEQ ID NO: 22079
  Description of Artificial Sequence: Synthetic polypeptide
  XENP021920 2A11_H1.117_L2.113_Fab Light Chain

SEQ ID NO: 28040 - protein, 107 aa, Artificial Sequence; identical to SEQ ID NO: 22080
  Description of Artificial Sequence: Synthetic polypeptide
  VL of XENP021920

SEQ ID NO: 28041 - protein, 11 aa, Artificial Sequence
  Description of Artificial Sequence: Synthetic peptide
  XENP021920 vlCDR1
QASQDIGNYLN

SEQ ID NO: 28042 - protein, 7 aa, Artificial Sequence
  Description of Artificial Sequence: Synthetic peptide
  XENP021920 vlCDR2
FTSYLHS

SEQ ID NO: 28043 - protein, 9 aa, Artificial Sequence
  Description of Artificial Sequence: Synthetic peptide
  XENP021920 vlCDR3
QQGNTLPYT

SEQ ID NO: 28044 - protein, 223 aa, Artificial Sequence; identical to SEQ ID NO: 27734
  Description of Artificial Sequence: Synthetic polypeptide
  XENP021921 2A11_H1.125_L2.113_Fab Heavy Chain

SEQ ID NO: 28045 - protein, 118 aa, Artificial Sequence; identical to SEQ ID NO: 22065
  Description of Artificial Sequence: Synthetic polypeptide
  VH of XENP021921

SEQ ID NO: 28046 - protein, 5 aa, Artificial Sequence
  Description of Artificial Sequence: Synthetic peptide
  XENP021921 vhCDR1
HYFMH

SEQ ID NO: 28047 - protein, 17 aa, Artificial Sequence
  Description of Artificial Sequence: Synthetic peptide
  XENP021921 vhCDR2
WIDPYLGDTEYAPKFQG

SEQ ID NO: 28048 - protein, 9 aa, Artificial Sequence
  Description of Artificial Sequence: Synthetic peptide
  XENP021921 vhCDR3
RGVYQALDY

SEQ ID NO: 28049 - protein, 214 aa, Artificial Sequence; identical to SEQ ID NO: 22079
  Description of Artificial Sequence: Synthetic polypeptide
  XENP021921 2A11_H1.125_L2.113_Fab Light Chain

SEQ ID NO: 28050 - protein, 107 aa, Artificial Sequence; identical to SEQ ID NO: 22080
  Description of Artificial Sequence: Synthetic polypeptide
  VL of XENP021921

SEQ ID NO: 28051 - protein, 11 aa, Artificial Sequence
  Description of Artificial Sequence: Synthetic peptide
  XENP021921 vlCDR1
QASQDIGNYLN

SEQ ID NO: 28052 - protein, 7 aa, Artificial Sequence
  Description of Artificial Sequence: Synthetic peptide
  XENP021921 vlCDR2
FTSYLHS

SEQ ID NO: 28053 - protein, 9 aa, Artificial Sequence
  Description of Artificial Sequence: Synthetic peptide
  XENP021921 vlCDR3
QQGNTLPYT

SEQ ID NO: 28054 - protein, 223 aa, Artificial Sequence; identical to SEQ ID NO: 27464
  Description of Artificial Sequence: Synthetic polypeptide
  XENP021922 2A11_H1.126_L2.113_Fab Heavy Chain

SEQ ID NO: 28055 - protein, 118 aa, Artificial Sequence; identical to SEQ ID NO: 27465
  Description of Artificial Sequence: Synthetic polypeptide
  VH of XENP021922

SEQ ID NO: 28056 - protein, 5 aa, Artificial Sequence
  Description of Artificial Sequence: Synthetic peptide
  XENP021922 vhCDR1
HYFMH

SEQ ID NO: 28057 - protein, 17 aa, Artificial Sequence
  Description of Artificial Sequence: Synthetic peptide
  XENP021922 vhCDR2
WIDPYTGDTEYAPKFQG

SEQ ID NO: 28058 - protein, 9 aa, Artificial Sequence
  Description of Artificial Sequence: Synthetic peptide
  XENP021922 vhCDR3
RGVYQALDY

SEQ ID NO: 28059 - protein, 214 aa, Artificial Sequence; identical to SEQ ID NO: 22079
  Description of Artificial Sequence: Synthetic polypeptide
  XENP021922 2A11_H1.126_L2.113_Fab Light Chain

SEQ ID NO: 28060 - protein, 107 aa, Artificial Sequence; identical to SEQ ID NO: 22080
  Description of Artificial Sequence: Synthetic polypeptide
  VL of XENP021922

SEQ ID NO: 28061 - protein, 11 aa, Artificial Sequence
  Description of Artificial Sequence: Synthetic peptide
  XENP021922 vlCDR1
QASQDIGNYLN

SEQ ID NO: 28062 - protein, 7 aa, Artificial Sequence
  Description of Artificial Sequence: Synthetic peptide
  XENP021922 vlCDR2
FTSYLHS

SEQ ID NO: 28063 - protein, 9 aa, Artificial Sequence
  Description of Artificial Sequence: Synthetic peptide
  XENP021922 vlCDR3
QQGNTLPYT

SEQ ID NO: 28064 - protein, 223 aa, Artificial Sequence; identical to SEQ ID NO: 27634
  Description of Artificial Sequence: Synthetic polypeptide
  XENP021923 2A11_H1.144_L2.113_Fab Heavy Chain

SEQ ID NO: 28065 - protein, 118 aa, Artificial Sequence; identical to SEQ ID NO: 22085
  Description of Artificial Sequence: Synthetic polypeptide
  VH of XENP021923

SEQ ID NO: 28066 - protein, 5 aa, Artificial Sequence
  Description of Artificial Sequence: Synthetic peptide
  XENP021923 vhCDR1
DYFMH

SEQ ID NO: 28067 - protein, 17 aa, Artificial Sequence
  Description of Artificial Sequence: Synthetic peptide
  XENP021923 vhCDR2
WIDPELGDTEYAPKFQG

SEQ ID NO: 28068 - protein, 9 aa, Artificial Sequence
  Description of Artificial Sequence: Synthetic peptide
  XENP021923 vhCDR3
RGVYQALDY

SEQ ID NO: 28069 - protein, 214 aa, Artificial Sequence; identical to SEQ ID NO: 22079
  Description of Artificial Sequence: Synthetic polypeptide
  XENP021923 2A11_H1.144_L2.113_Fab Light Chain

SEQ ID NO: 28070 - protein, 107 aa, Artificial Sequence; identical to SEQ ID NO: 22080
  Description of Artificial Sequence: Synthetic polypeptide
  VL of XENP021923

SEQ ID NO: 28071 - protein, 11 aa, Artificial Sequence
  Description of Artificial Sequence: Synthetic peptide
  XENP021923 vlCDR1
QASQDIGNYLN

SEQ ID NO: 28072 - protein, 7 aa, Artificial Sequence
  Description of Artificial Sequence: Synthetic peptide
  XENP021923 vlCDR2
FTSYLHS

SEQ ID NO: 28073 - protein, 9 aa, Artificial Sequence
  Description of Artificial Sequence: Synthetic peptide
  XENP021923 vlCDR3
QQGNTLPYT

SEQ ID NO: 28074 - protein, 223 aa, Artificial Sequence; identical to SEQ ID NO: 27474
  Description of Artificial Sequence: Synthetic polypeptide
  XENP021924 2A11_H1.127_L2.113_Fab Heavy Chain

SEQ ID NO: 28075 - protein, 118 aa, Artificial Sequence; identical to SEQ ID NO: 27475
  Description of Artificial Sequence: Synthetic polypeptide
  VH of XENP021924

SEQ ID NO: 28076 - protein, 5 aa, Artificial Sequence
  Description of Artificial Sequence: Synthetic peptide
  XENP021924 vhCDR1
HYFMH

SEQ ID NO: 28077 - protein, 17 aa, Artificial Sequence
  Description of Artificial Sequence: Synthetic peptide
  XENP021924 vhCDR2
WIDPELGDTEYAPKFQG

SEQ ID NO: 28078 - protein, 9 aa, Artificial Sequence
  Description of Artificial Sequence: Synthetic peptide
  XENP021924 vhCDR3
RGVYQALDY

SEQ ID NO: 28079 - protein, 214 aa, Artificial Sequence; identical to SEQ ID NO: 22079
  Description of Artificial Sequence: Synthetic polypeptide
  XENP021924 2A11_H1.127_L2.113_Fab Light Chain

SEQ ID NO: 28080 - protein, 107 aa, Artificial Sequence; identical to SEQ ID NO: 22080
  Description of Artificial Sequence: Synthetic polypeptide
  VL of XENP021924

SEQ ID NO: 28081 - protein, 11 aa, Artificial Sequence
  Description of Artificial Sequence: Synthetic peptide
  XENP021924 vlCDR1
QASQDIGNYLN

SEQ ID NO: 28082 - protein, 7 aa, Artificial Sequence
  Description of Artificial Sequence: Synthetic peptide
  XENP021924 vlCDR2
FTSYLHS

SEQ ID NO: 28083 - protein, 9 aa, Artificial Sequence
  Description of Artificial Sequence: Synthetic peptide
  XENP021924 vlCDR3
QQGNTLPYT

SEQ ID NO: 28084 - protein, 223 aa, Artificial Sequence; identical to SEQ ID NO: 27554
  Description of Artificial Sequence: Synthetic polypeptide
  XENP021925 2A11_H1.136_L2.113_Fab Heavy Chain

SEQ ID NO: 28085 - protein, 118 aa, Artificial Sequence; identical to SEQ ID NO: 27555
  Description of Artificial Sequence: Synthetic polypeptide
  VH of XENP021925

SEQ ID NO: 28086 - protein, 5 aa, Artificial Sequence
  Description of Artificial Sequence: Synthetic peptide
  XENP021925 vhCDR1
HYYMH

SEQ ID NO: 28087 - protein, 17 aa, Artificial Sequence
  Description of Artificial Sequence: Synthetic peptide
  XENP021925 vhCDR2
WIDPYLGDTEYAPKFQG

SEQ ID NO: 28088 - protein, 9 aa, Artificial Sequence
  Description of Artificial Sequence: Synthetic peptide
  XENP021925 vhCDR3
RGVYQALDY

SEQ ID NO: 28089 - protein, 214 aa, Artificial Sequence; identical to SEQ ID NO: 22079
  Description of Artificial Sequence: Synthetic polypeptide
  XENP021925 2A11_H1.136_L2.113_Fab Light Chain

SEQ ID NO: 28090 - protein, 107 aa, Artificial Sequence; identical to SEQ ID NO: 22080
  Description of Artificial Sequence: Synthetic polypeptide
  VL of XENP021925

SEQ ID NO: 28091 - protein, 11 aa, Artificial Sequence
  Description of Artificial Sequence: Synthetic peptide
  XENP021925 vlCDR1
QASQDIGNYLN

SEQ ID NO: 28092 - protein, 7 aa, Artificial Sequence
  Description of Artificial Sequence: Synthetic peptide
  XENP021925 vlCDR2
FTSYLHS

SEQ ID NO: 28093 - protein, 9 aa, Artificial Sequence
  Description of Artificial Sequence: Synthetic peptide
  XENP021925 vlCDR3
QQGNTLPYT

SEQ ID NO: 28094 - protein, 223 aa, Artificial Sequence; identical to SEQ ID NO: 28014
  Description of Artificial Sequence: Synthetic polypeptide
  XENP021926 2A11_H1.154_L2.113_Fab Heavy Chain

SEQ ID NO: 28095 - protein, 118 aa, Artificial Sequence; identical to SEQ ID NO: 28015
  Description of Artificial Sequence: Synthetic polypeptide
  VH of XENP021926

SEQ ID NO: 28096 - protein, 5 aa, Artificial Sequence
  Description of Artificial Sequence: Synthetic peptide
  XENP021926 vhCDR1
DYYMH

SEQ ID NO: 28097 - protein, 17 aa, Artificial Sequence
  Description of Artificial Sequence: Synthetic peptide
  XENP021926 vhCDR2
WIDPELGDTEYAPKFQG

SEQ ID NO: 28098 - protein, 9 aa, Artificial Sequence
  Description of Artificial Sequence: Synthetic peptide
  XENP021926 vhCDR3
RGVYQALDY

SEQ ID NO: 28099 - protein, 214 aa, Artificial Sequence; identical to SEQ ID NO: 22079
  Description of Artificial Sequence: Synthetic polypeptide
  XENP021926 2A11_H1.154_L2.113_Fab Light Chain

SEQ ID NO: 28100 - protein, 107 aa, Artificial Sequence; identical to SEQ ID NO: 22080
  Description of Artificial Sequence: Synthetic polypeptide
  VL of XENP021926

SEQ ID NO: 28101 - protein, 11 aa, Artificial Sequence
  Description of Artificial Sequence: Synthetic peptide
  XENP021926 vlCDR1
QASQDIGNYLN

SEQ ID NO: 28102 - protein, 7 aa, Artificial Sequence
  Description of Artificial Sequence: Synthetic peptide
  XENP021926 vlCDR2
FTSYLHS

SEQ ID NO: 28103 - protein, 9 aa, Artificial Sequence
  Description of Artificial Sequence: Synthetic peptide
  XENP021926 vlCDR3
QQGNTLPYT

SEQ ID NO: 28104 - protein, 223 aa, Artificial Sequence; identical to SEQ ID NO: 27604
  Description of Artificial Sequence: Synthetic polypeptide
  XENP021927 2A11_H1.141_L2.113_Fab Heavy Chain

SEQ ID NO: 28105 - protein, 118 aa, Artificial Sequence; identical to SEQ ID NO: 27605
  Description of Artificial Sequence: Synthetic polypeptide
  VH of XENP021927

SEQ ID NO: 28106 - protein, 5 aa, Artificial Sequence
  Description of Artificial Sequence: Synthetic peptide
  XENP021927 vhCDR1
DYFMH

SEQ ID NO: 28107 - protein, 17 aa, Artificial Sequence
  Description of Artificial Sequence: Synthetic peptide
  XENP021927 vhCDR2
WIDPELGDTEYAPKFQG

SEQ ID NO: 28108 - protein, 9 aa, Artificial Sequence
  Description of Artificial Sequence: Synthetic peptide
  XENP021927 vhCDR3
RGVRQALDY

SEQ ID NO: 28109 - protein, 214 aa, Artificial Sequence; identical to SEQ ID NO: 22079
  Description of Artificial Sequence: Synthetic polypeptide
  XENP021927 2A11_H1.141_L2.113_Fab Light Chain

SEQ ID NO: 28110 - protein, 107 aa, Artificial Sequence; identical to SEQ ID NO: 22080
  Description of Artificial Sequence: Synthetic polypeptide
  VL of XENP021927

SEQ ID NO: 28111 - protein, 11 aa, Artificial Sequence
  Description of Artificial Sequence: Synthetic peptide
  XENP021927 vlCDR1
QASQDIGNYLN

SEQ ID NO: 28112 - protein, 7 aa, Artificial Sequence
  Description of Artificial Sequence: Synthetic peptide
  XENP021927 vlCDR2
FTSYLHS

SEQ ID NO: 28113 - protein, 9 aa, Artificial Sequence
  Description of Artificial Sequence: Synthetic peptide
  XENP021927 vlCDR3
QQGNTLPYT

SEQ ID NO: 28114 - protein, 223 aa, Artificial Sequence; identical to SEQ ID NO: 27384
  Description of Artificial Sequence: Synthetic polypeptide
  XENP021928 2A11_H1.117_L2.116_Fab Heavy Chain

SEQ ID NO: 28115 - protein, 118 aa, Artificial Sequence; identical to SEQ ID NO: 22105
  Description of Artificial Sequence: Synthetic polypeptide
  VH of XENP021928

SEQ ID NO: 28116 - protein, 5 aa, Artificial Sequence
  Description of Artificial Sequence: Synthetic peptide
  XENP021928 vhCDR1
HYFMH

SEQ ID NO: 28117 - protein, 17 aa, Artificial Sequence
  Description of Artificial Sequence: Synthetic peptide
  XENP021928 vhCDR2
WIDPYLGDTEYAPKFQG

SEQ ID NO: 28118 - protein, 9 aa, Artificial Sequence
  Description of Artificial Sequence: Synthetic peptide
  XENP021928 vhCDR3
RGVRQALDY

SEQ ID NO: 28119 - protein, 214 aa, Artificial Sequence; identical to SEQ ID NO: 22119
  Description of Artificial Sequence: Synthetic polypeptide
  XENP021928 2A11_H1.117_L2.116_Fab Light Chain

SEQ ID NO: 28120 - protein, 107 aa, Artificial Sequence; identical to SEQ ID NO: 22120
  Description of Artificial Sequence: Synthetic polypeptide
  VL of XENP021928

SEQ ID NO: 28121 - protein, 11 aa, Artificial Sequence
  Description of Artificial Sequence: Synthetic peptide
  XENP021928 vlCDR1
QASQDIGNYLN

SEQ ID NO: 28122 - protein, 7 aa, Artificial Sequence
  Description of Artificial Sequence: Synthetic peptide
  XENP021928 vlCDR2
FTSHLHS

SEQ ID NO: 28123 - protein, 9 aa, Artificial Sequence
  Description of Artificial Sequence: Synthetic peptide
  XENP021928 vlCDR3
QQGHQLPYT

SEQ ID NO: 28124 - protein, 223 aa, Artificial Sequence; identical to SEQ ID NO: 27734
  Description of Artificial Sequence: Synthetic polypeptide
  XENP021929 2A11_H1.125_L2.116_Fab Heavy Chain

SEQ ID NO: 28125 - protein, 118 aa, Artificial Sequence; identical to SEQ ID NO: 22065
  Description of Artificial Sequence: Synthetic polypeptide
  VH of XENP021929

SEQ ID NO: 28126 - protein, 5 aa, Artificial Sequence
  Description of Artificial Sequence: Synthetic peptide
  XENP021929 vhCDR1
HYFMH

SEQ ID NO: 28127 - protein, 17 aa, Artificial Sequence
  Description of Artificial Sequence: Synthetic peptide
  XENP021929 vhCDR2
WIDPYLGDTEYAPKFQG

SEQ ID NO: 28128 - protein, 9 aa, Artificial Sequence
  Description of Artificial Sequence: Synthetic peptide
  XENP021929 vhCDR3
RGVYQALDY

SEQ ID NO: 28129 - protein, 214 aa, Artificial Sequence; identical to SEQ ID NO: 22119
  Description of Artificial Sequence: Synthetic polypeptide
  XENP021929 2A11_H1.125_L2.116_Fab Light Chain

SEQ ID NO: 28130 - protein, 107 aa, Artificial Sequence; identical to SEQ ID NO: 22120
  Description of Artificial Sequence: Synthetic polypeptide
  VL of XENP021929

SEQ ID NO: 28131 - protein, 11 aa, Artificial Sequence
  Description of Artificial Sequence: Synthetic peptide
  XENP021929 vlCDR1
QASQDIGNYLN

SEQ ID NO: 28132 - protein, 7 aa, Artificial Sequence
  Description of Artificial Sequence: Synthetic peptide
  XENP021929 vlCDR2
FTSHLHS

SEQ ID NO: 28133 - protein, 9 aa, Artificial Sequence
  Description of Artificial Sequence: Synthetic peptide
  XENP021929 vlCDR3
QQGHQLPYT

SEQ ID NO: 28134 - protein, 223 aa, Artificial Sequence; identical to SEQ ID NO: 27464
  Description of Artificial Sequence: Synthetic polypeptide
  XENP021930 2A11_H1.126_L2.116_Fab Heavy Chain

SEQ ID NO: 28135 - protein, 118 aa, Artificial Sequence; identical to SEQ ID NO: 27465
  Description of Artificial Sequence: Synthetic polypeptide
  VH of XENP021930

SEQ ID NO: 28136 - protein, 5 aa, Artificial Sequence
  Description of Artificial Sequence: Synthetic peptide
  XENP021930 vhCDR1
HYFMH

SEQ ID NO: 28137 - protein, 17 aa, Artificial Sequence
  Description of Artificial Sequence: Synthetic peptide
  XENP021930 vhCDR2
WIDPYTGDTEYAPKFQG

SEQ ID NO: 28138 - protein, 9 aa, Artificial Sequence
  Description of Artificial Sequence: Synthetic peptide
  XENP021930 vhCDR3
RGVYQALDY

SEQ ID NO: 28139 - protein, 214 aa, Artificial Sequence; identical to SEQ ID NO: 22119
  Description of Artificial Sequence: Synthetic polypeptide
  XENP021930 2A11_H1.126_L2.116_Fab Light Chain

SEQ ID NO: 28140 - protein, 107 aa, Artificial Sequence; identical to SEQ ID NO: 22120
  Description of Artificial Sequence: Synthetic polypeptide
  VL of XENP021930

SEQ ID NO: 28141 - protein, 11 aa, Artificial Sequence
  Description of Artificial Sequence: Synthetic peptide
  XENP021930 vlCDR1
QASQDIGNYLN

SEQ ID NO: 28142 - protein, 7 aa, Artificial Sequence
  Description of Artificial Sequence: Synthetic peptide
  XENP021930 vlCDR2
FTSHLHS

SEQ ID NO: 28143 - protein, 9 aa, Artificial Sequence
  Description of Artificial Sequence: Synthetic peptide
  XENP021930 vlCDR3
QQGHQLPYT

SEQ ID NO: 28144 - protein, 223 aa, Artificial Sequence; identical to SEQ ID NO: 27634
  Description of Artificial Sequence: Synthetic polypeptide
  XENP021931 2A11_H1.144_L2.116_Fab Heavy Chain

SEQ ID NO: 28145 - protein, 118 aa, Artificial Sequence; identical to SEQ ID NO: 22085
  Description of Artificial Sequence: Synthetic polypeptide
  VH of XENP021931

SEQ ID NO: 28146 - protein, 5 aa, Artificial Sequence
  Description of Artificial Sequence: Synthetic peptide
  XENP021931 vhCDR1
DYFMH

SEQ ID NO: 28147 - protein, 17 aa, Artificial Sequence
  Description of Artificial Sequence: Synthetic peptide
  XENP021931 vhCDR2
WIDPELGDTEYAPKFQG

SEQ ID NO: 28148 - protein, 9 aa, Artificial Sequence
  Description of Artificial Sequence: Synthetic peptide
  XENP021931 vhCDR3
RGVYQALDY

SEQ ID NO: 28149 - protein, 214 aa, Artificial Sequence; identical to SEQ ID NO: 22119
  Description of Artificial Sequence: Synthetic polypeptide
  XENP021931 2A11_H1.144_L2.116_Fab Light Chain

SEQ ID NO: 28150 - protein, 107 aa, Artificial Sequence; identical to SEQ ID NO: 22120
  Description of Artificial Sequence: Synthetic polypeptide
  VL of XENP021931

SEQ ID NO: 28151 - protein, 11 aa, Artificial Sequence
  Description of Artificial Sequence: Synthetic peptide
  XENP021931 vlCDR1
QASQDIGNYLN

SEQ ID NO: 28152 - protein, 7 aa, Artificial Sequence
  Description of Artificial Sequence: Synthetic peptide
  XENP021931 vlCDR2
FTSHLHS

SEQ ID NO: 28153 - protein, 9 aa, Artificial Sequence
  Description of Artificial Sequence: Synthetic peptide
  XENP021931 vlCDR3
QQGHQLPYT

SEQ ID NO: 28154 - protein, 223 aa, Artificial Sequence; identical to SEQ ID NO: 27474
  Description of Artificial Sequence: Synthetic polypeptide
  XENP021932 2A11_H1.127_L2.116_Fab Heavy Chain

SEQ ID NO: 28155 - protein, 118 aa, Artificial Sequence; identical to SEQ ID NO: 27475
  Description of Artificial Sequence: Synthetic polypeptide
  VH of XENP021932

SEQ ID NO: 28156 - protein, 5 aa, Artificial Sequence
  Description of Artificial Sequence: Synthetic peptide
  XENP021932 vhCDR1
HYFMH

SEQ ID NO: 28157 - protein, 17 aa, Artificial Sequence
  Description of Artificial Sequence: Synthetic peptide
  XENP021932 vhCDR2
WIDPELGDTEYAPKFQG

SEQ ID NO: 28158 - protein, 9 aa, Artificial Sequence
  Description of Artificial Sequence: Synthetic peptide
  XENP021932 vhCDR3
RGVYQALDY

SEQ ID NO: 28159 - protein, 214 aa, Artificial Sequence; identical to SEQ ID NO: 22119
  Description of Artificial Sequence: Synthetic polypeptide
  XENP021932 2A11_H1.127_L2.116_Fab Light Chain

SEQ ID NO: 28160 - protein, 107 aa, Artificial Sequence; identical to SEQ ID NO: 22120
  Description of Artificial Sequence: Synthetic polypeptide
  VL of XENP021932

SEQ ID NO: 28161 - protein, 11 aa, Artificial Sequence
  Description of Artificial Sequence: Synthetic peptide
  XENP021932 vlCDR1
QASQDIGNYLN

SEQ ID NO: 28162 - protein, 7 aa, Artificial Sequence
  Description of Artificial Sequence: Synthetic peptide
  XENP021932 vlCDR2
FTSHLHS

SEQ ID NO: 28163 - protein, 9 aa, Artificial Sequence
  Description of Artificial Sequence: Synthetic peptide
  XENP021932 vlCDR3
QQGHQLPYT

SEQ ID NO: 28164 - protein, 223 aa, Artificial Sequence; identical to SEQ ID NO: 27554
  Description of Artificial Sequence: Synthetic polypeptide
  XENP021933 2A11_H1.136_L2.116_Fab Heavy Chain

SEQ ID NO: 28165 - protein, 118 aa, Artificial Sequence; identical to SEQ ID NO: 27555
  Description of Artificial Sequence: Synthetic polypeptide
  VH of XENP021933

SEQ ID NO: 28166 - protein, 5 aa, Artificial Sequence
  Description of Artificial Sequence: Synthetic peptide
  XENP021933 vhCDR1
HYYMH

SEQ ID NO: 28167 - protein, 17 aa, Artificial Sequence
  Description of Artificial Sequence: Synthetic peptide
  XENP021933 vhCDR2
WIDPYLGDTEYAPKFQG

SEQ ID NO: 28168 - protein, 9 aa, Artificial Sequence
  Description of Artificial Sequence: Synthetic peptide
  XENP021933 vhCDR3
RGVYQALDY

SEQ ID NO: 28169 - protein, 214 aa, Artificial Sequence; identical to SEQ ID NO: 22119
  Description of Artificial Sequence: Synthetic polypeptide
  XENP021933 2A11_H1.136_L2.116_Fab Light Chain

SEQ ID NO: 28170 - protein, 107 aa, Artificial Sequence; identical to SEQ ID NO: 22120
  Description of Artificial Sequence: Synthetic polypeptide
  VL of XENP021933

SEQ ID NO: 28171 - protein, 11 aa, Artificial Sequence
  Description of Artificial Sequence: Synthetic peptide
  XENP021933 vlCDR1
QASQDIGNYLN

SEQ ID NO: 28172 - protein, 7 aa, Artificial Sequence
  Description of Artificial Sequence: Synthetic peptide
  XENP021933 vlCDR2
FTSHLHS

SEQ ID NO: 28173 - protein, 9 aa, Artificial Sequence
  Description of Artificial Sequence: Synthetic peptide
  XENP021933 vlCDR3
QQGHQLPYT

SEQ ID NO: 28174 - protein, 223 aa, Artificial Sequence; identical to SEQ ID NO: 28014
  Description of Artificial Sequence: Synthetic polypeptide
  XENP021934 2A11_H1.154_L2.116_Fab Heavy Chain

SEQ ID NO: 28175 - protein, 118 aa, Artificial Sequence; identical to SEQ ID NO: 28015
  Description of Artificial Sequence: Synthetic polypeptide
  VH of XENP021934

SEQ ID NO: 28176 - protein, 5 aa, Artificial Sequence
  Description of Artificial Sequence: Synthetic peptide
  XENP021934 vhCDR1
DYYMH

SEQ ID NO: 28177 - protein, 17 aa, Artificial Sequence
  Description of Artificial Sequence: Synthetic peptide
  XENP021934 vhCDR2
WIDPELGDTEYAPKFQG

SEQ ID NO: 28178 - protein, 9 aa, Artificial Sequence
  Description of Artificial Sequence: Synthetic peptide
  XENP021934 vhCDR3
RGVYQALDY

SEQ ID NO: 28179 - protein, 214 aa, Artificial Sequence; identical to SEQ ID NO: 22119
  Description of Artificial Sequence: Synthetic polypeptide
  XENP021934 2A11_H1.154_L2.116_Fab Light Chain

SEQ ID NO: 28180 - protein, 107 aa, Artificial Sequence; identical to SEQ ID NO: 22120
  Description of Artificial Sequence: Synthetic polypeptide
  VL of XENP021934

SEQ ID NO: 28181 - protein, 11 aa, Artificial Sequence
  Description of Artificial Sequence: Synthetic peptide
  XENP021934 vlCDR1
QASQDIGNYLN

SEQ ID NO: 28182 - protein, 7 aa, Artificial Sequence
  Description of Artificial Sequence: Synthetic peptide
  XENP021934 vlCDR2
FTSHLHS

SEQ ID NO: 28183 - protein, 9 aa, Artificial Sequence
  Description of Artificial Sequence: Synthetic peptide
  XENP021934 vlCDR3
QQGHQLPYT

SEQ ID NO: 28184 - protein, 223 aa, Artificial Sequence; identical to SEQ ID NO: 27604
  Description of Artificial Sequence: Synthetic polypeptide
  XENP021935 2A11_H1.141_L2.116_Fab Heavy Chain

SEQ ID NO: 28185 - protein, 118 aa, Artificial Sequence; identical to SEQ ID NO: 27605
  Description of Artificial Sequence: Synthetic polypeptide
  VH of XENP021935

SEQ ID NO: 28186 - protein, 5 aa, Artificial Sequence
  Description of Artificial Sequence: Synthetic peptide
  XENP021935 vhCDR1
DYFMH

SEQ ID NO: 28187 - protein, 17 aa, Artificial Sequence
  Description of Artificial Sequence: Synthetic peptide
  XENP021935 vhCDR2
WIDPELGDTEYAPKFQG

SEQ ID NO: 28188 - protein, 9 aa, Artificial Sequence
  Description of Artificial Sequence: Synthetic peptide
  XENP021935 vhCDR3
RGVRQALDY

SEQ ID NO: 28189 - protein, 214 aa, Artificial Sequence; identical to SEQ ID NO: 22119
  Description of Artificial Sequence: Synthetic polypeptide
  XENP021935 2A11_H1.141_L2.116_Fab Light Chain

SEQ ID NO: 28190 - protein, 107 aa, Artificial Sequence; identical to SEQ ID NO: 22120
  Description of Artificial Sequence: Synthetic polypeptide
  VL of XENP021935

SEQ ID NO: 28191 - protein, 11 aa, Artificial Sequence
  Description of Artificial Sequence: Synthetic peptide
  XENP021935 vlCDR1
QASQDIGNYLN

SEQ ID NO: 28192 - protein, 7 aa, Artificial Sequence
  Description of Artificial Sequence: Synthetic peptide
  XENP021935 vlCDR2
FTSHLHS

SEQ ID NO: 28193 - protein, 9 aa, Artificial Sequence
  Description of Artificial Sequence: Synthetic peptide
  XENP021935 vlCDR3
QQGHQLPYT

SEQ ID NO: 28194 - protein, 223 aa, Artificial Sequence
  Description of Artificial Sequence: Synthetic polypeptide
  XENP022132 2A11_H1.155_L2.50_Fab Heavy Chain
EVQLVQSGAEVKKPGATVKISCKASGFNIKDYFMHWVQQAPGKGLEWMGWIDPYLGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28195 - protein, 118 aa, Artificial Sequence
  Description of Artificial Sequence: Synthetic polypeptide
  VH of XENP022132
EVQLVQSGAEVKKPGATVKISCKASGFNIKDYFMHWVQQAPGKGLEWMGWIDPYLGDTEYAPKFQGRVTITADTSTNTAYMELSSLRSEDTAVYYCYARGVYQALDYWGQGTLVTVSS

SEQ ID NO: 28196 - protein, 5 aa, Artificial Sequence
  Description of Artificial Sequence: Synthetic peptide
  XENP022132 vhCDR1
DYFMH

SEQ ID NO: 28197 - protein, 17 aa, Artificial Sequence
  Description of Artificial Sequence: Synthetic peptide
  XENP022132 vhCDR2
WIDPYLGDTEYAPKFQG

SEQ ID NO: 28198 - protein, 9 aa, Artificial Sequence
  Description of Artificial Sequence: Synthetic peptide
  XENP022132 vhCDR3
RGVYQALDY

SEQ ID NO: 28199 - protein, 214 aa, Artificial Sequence; identical to SEQ ID NO: 22059
  Description of Artificial Sequence: Synthetic polypeptide
  XENP022132 2A11_H1.155_L2.50_Fab Light Chain

SEQ ID NO: 28200 - protein, 107 aa, Artificial Sequence; identical to SEQ ID NO: 22060
  Description of Artificial Sequence: Synthetic polypeptide
  VL of XENP022132

SEQ ID NO: 28201 - protein, 11 aa, Artificial Sequence
  Description of Artificial Sequence: Synthetic peptide
  XENP022132 vlCDR1
QASQDIGNYLN

SEQ ID NO: 28202 - protein, 7 aa, Artificial Sequence
  Description of Artificial Sequence: Synthetic peptide
  XENP022132 vlCDR2
YTSYLHS

SEQ ID NO: 28203 - protein, 9 aa, Artificial Sequence
  Description of Artificial Sequence: Synthetic peptide
  XENP022132 vlCDR3
QQGNTLPYT

SEQ ID NO: 28204 - protein, 223 aa, Artificial Sequence
  Description of Artificial Sequence: Synthetic polypeptide
  XENP022133 2A11_H1.156_L2.50_Fab Heavy Chain
EVQLVQSGAEVKKPGATVKISCKASGFNIKDYFMHWVQQAPGKGLEWMGWIDPYLGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28205 - protein, 118 aa, Artificial Sequence
  Description of Artificial Sequence: Synthetic polypeptide
  VH of XENP022133
EVQLVQSGAEVKKPGATVKISCKASGFNIKDYFMHWVQQAPGKGLEWMGWIDPYLGDTEYAPKFQGRVTITADTSTNTAYMELSSLRSEDTAVYYCYARGVKQALDYWGQGTLVTVSS

SEQ ID NO: 28206 - protein, 5 aa, Artificial Sequence
  Description of Artificial Sequence: Synthetic peptide
  XENP022133 vhCDR1
DYFMH

SEQ ID NO: 28207 - protein, 17 aa, Artificial Sequence
  Description of Artificial Sequence: Synthetic peptide
  XENP022133 vhCDR2
WIDPYLGDTEYAPKFQG

SEQ ID NO: 28208 - protein, 9 aa, Artificial Sequence
  Description of Artificial Sequence: Synthetic peptide
  XENP022133 vhCDR3
RGVKQALDY

SEQ ID NO: 28209 - protein, 214 aa, Artificial Sequence; identical to SEQ ID NO: 22059
  Description of Artificial Sequence: Synthetic polypeptide
  XENP022133 2A11_H1.156_L2.50_Fab Light Chain

SEQ ID NO: 28210 - protein, 107 aa, Artificial Sequence; identical to SEQ ID NO: 22060
  Description of Artificial Sequence: Synthetic polypeptide
  VL of XENP022133

SEQ ID NO: 28211 - protein, 11 aa, Artificial Sequence
  Description of Artificial Sequence: Synthetic peptide
  XENP022133 vlCDR1
QASQDIGNYLN

SEQ ID NO: 28212 - protein, 7 aa, Artificial Sequence
  Description of Artificial Sequence: Synthetic peptide
  XENP022133 vlCDR2
YTSYLHS

SEQ ID NO: 28213 - protein, 9 aa, Artificial Sequence
  Description of Artificial Sequence: Synthetic peptide
  XENP022133 vlCDR3
QQGNTLPYT

SEQ ID NO: 28214 - protein, 223 aa, Artificial Sequence; identical to SEQ ID NO: 28194
  Description of Artificial Sequence: Synthetic polypeptide
  XENP022134 2A11_H1.155_L2.113_Fab Heavy Chain

SEQ ID NO: 28215 - protein, 118 aa, Artificial Sequence; identical to SEQ ID NO: 28195
  Description of Artificial Sequence: Synthetic polypeptide
  VH of XENP022134

SEQ ID NO: 28216 - protein, 5 aa, Artificial Sequence
  Description of Artificial Sequence: Synthetic peptide
  XENP022134 vhCDR1
DYFMH

SEQ ID NO: 28217 - protein, 17 aa, Artificial Sequence
  Description of Artificial Sequence: Synthetic peptide
  XENP022134 vhCDR2
WIDPYLGDTEYAPKFQG

SEQ ID NO: 28218 - protein, 9 aa, Artificial Sequence
  Description of Artificial Sequence: Synthetic peptide
  XENP022134 vhCDR3
RGVYQALDY

SEQ ID NO: 28219 - protein, 214 aa, Artificial Sequence; identical to SEQ ID NO: 22079
  Description of Artificial Sequence: Synthetic polypeptide
  XENP022134 2A11_H1.155_L2.113_Fab Light Chain

SEQ ID NO: 28220 - protein, 107 aa, Artificial Sequence; identical to SEQ ID NO: 22080
  Description of Artificial Sequence: Synthetic polypeptide
  VL of XENP022134

SEQ ID NO: 28221 - protein, 11 aa, Artificial Sequence
  Description of Artificial Sequence: Synthetic peptide
  XENP022134 vlCDR1
QASQDIGNYLN

SEQ ID NO: 28222 - protein, 7 aa, Artificial Sequence
  Description of Artificial Sequence: Synthetic peptide
  XENP022134 vlCDR2
FTSYLHS

SEQ ID NO: 28223 - protein, 9 aa, Artificial Sequence
  Description of Artificial Sequence: Synthetic peptide
  XENP022134 vlCDR3
QQGNTLPYT

SEQ ID NO: 28224 - protein, 223 aa, Artificial Sequence; identical to SEQ ID NO: 28204
  Description of Artificial Sequence: Synthetic polypeptide
  XENP022135 2A11_H1.156_L2.113_Fab Heavy Chain

SEQ ID NO: 28225 - protein, 118 aa, Artificial Sequence; identical to SEQ ID NO: 28205
  Description of Artificial Sequence: Synthetic polypeptide
  VH of XENP022135

SEQ ID NO: 28226 - protein, 5 aa, Artificial Sequence
  Description of Artificial Sequence: Synthetic peptide
  XENP022135 vhCDR1
DYFMH

SEQ ID NO: 28227 - protein, 17 aa, Artificial Sequence
  Description of Artificial Sequence: Synthetic peptide
  XENP022135 vhCDR2
WIDPYLGDTEYAPKFQG

SEQ ID NO: 28228 - protein, 9 aa, Artificial Sequence
  Description of Artificial Sequence: Synthetic peptide
  XENP022135 vhCDR3
RGVKQALDY

SEQ ID NO: 28229 - protein, 214 aa, Artificial Sequence; identical to SEQ ID NO: 22079
  Description of Artificial Sequence: Synthetic polypeptide
  XENP022135 2A11_H1.156_L2.113_Fab Light Chain

SEQ ID NO: 28230 - protein, 107 aa, Artificial Sequence; identical to SEQ ID NO: 22080
  Description of Artificial Sequence: Synthetic polypeptide
  VL of XENP022135

SEQ ID NO: 28231 - protein, 11 aa, Artificial Sequence
  Description of Artificial Sequence: Synthetic peptide
  XENP022135 vlCDR1
QASQDIGNYLN

SEQ ID NO: 28232 - protein, 7 aa, Artificial Sequence
  Description of Artificial Sequence: Synthetic peptide
  XENP022135 vlCDR2
FTSYLHS

SEQ ID NO: 28233 - protein, 9 aa, Artificial Sequence
  Description of Artificial Sequence: Synthetic peptide
  XENP022135 vlCDR3
QQGNTLPYT

SEQ ID NO: 28234 - protein, 223 aa, Artificial Sequence; identical to SEQ ID NO: 28194
  Description of Artificial Sequence: Synthetic polypeptide
  XENP022136 2A11_H1.155_L2.116_Fab Heavy Chain

SEQ ID NO: 28235 - protein, 118 aa, Artificial Sequence; identical to SEQ ID NO: 28195
  Description of Artificial Sequence: Synthetic polypeptide
  VH of XENP022136

SEQ ID NO: 28236 - protein, 5 aa, Artificial Sequence
  Description of Artificial Sequence: Synthetic peptide
  XENP022136 vhCDR1
DYFMH

SEQ ID NO: 28237 - protein, 17 aa, Artificial Sequence
  Description of Artificial Sequence: Synthetic peptide
  XENP022136 vhCDR2
WIDPYLGDTEYAPKFQG

SEQ ID NO: 28238 - protein, 9 aa, Artificial Sequence
  Description of Artificial Sequence: Synthetic peptide
  XENP022136 vhCDR3
RGVYQALDY

SEQ ID NO: 28239 - protein, 214 aa, Artificial Sequence; identical to SEQ ID NO: 22119
  Description of Artificial Sequence: Synthetic polypeptide
  XENP022136 2A11_H1.155_L2.116_Fab Light Chain

SEQ ID NO: 28240 - protein, 107 aa, Artificial Sequence; identical to SEQ ID NO: 22120
  Description of Artificial Sequence: Synthetic polypeptide
  VL of XENP022136

SEQ ID NO: 28241 - protein, 11 aa, Artificial Sequence
  Description of Artificial Sequence: Synthetic peptide
  XENP022136 vlCDR1
QASQDIGNYLN

SEQ ID NO: 28242 - protein, 7 aa, Artificial Sequence
  Description of Artificial Sequence: Synthetic peptide
  XENP022136 vlCDR2
FTSHLHS

SEQ ID NO: 28243 - protein, 9 aa, Artificial Sequence
  Description of Artificial Sequence: Synthetic peptide
  XENP022136 vlCDR3
QQGHQLPYT

SEQ ID NO: 28244 - protein, 223 aa, Artificial Sequence; identical to SEQ ID NO: 28204
  Description of Artificial Sequence: Synthetic polypeptide
  XENP022137 2A11_H1.156_L2.116_Fab Heavy Chain

SEQ ID NO: 28245 - protein, 118 aa, Artificial Sequence; identical to SEQ ID NO: 28205
  Description of Artificial Sequence: Synthetic polypeptide
  VH of XENP022137

SEQ ID NO: 28246 - protein, 5 aa, Artificial Sequence
  Description of Artificial Sequence: Synthetic peptide
  XENP022137 vhCDR1
DYFMH

SEQ ID NO: 28247 - protein, 17 aa, Artificial Sequence
  Description of Artificial Sequence: Synthetic peptide
  XENP022137 vhCDR2
WIDPYLGDTEYAPKFQG

SEQ ID NO: 28248 - protein, 9 aa, Artificial Sequence
  Description of Artificial Sequence: Synthetic peptide
  XENP022137 vhCDR3
RGVKQALDY

SEQ ID NO: 28249 - protein, 214 aa, Artificial Sequence; identical to SEQ ID NO: 22119
  Description of Artificial Sequence: Synthetic polypeptide
  XENP022137 2A11_H1.156_L2.116_Fab Light Chain

SEQ ID NO: 28250 - protein, 107 aa, Artificial Sequence; identical to SEQ ID NO: 22120
  Description of Artificial Sequence: Synthetic polypeptide
  VL of XENP022137

SEQ ID NO: 28251 - protein, 11 aa, Artificial Sequence
  Description of Artificial Sequence: Synthetic peptide
  XENP022137 vlCDR1
QASQDIGNYLN

SEQ ID NO: 28252 - protein, 7 aa, Artificial Sequence
  Description of Artificial Sequence: Synthetic peptide
  XENP022137 vlCDR2
FTSHLHS

SEQ ID NO: 28253 - protein, 9 aa, Artificial Sequence
  Description of Artificial Sequence: Synthetic peptide
  XENP022137 vlCDR3
QQGHQLPYT

SEQ ID NO: 28254 - protein, 223 aa, Artificial Sequence
  Description of Artificial Sequence: Synthetic polypeptide
  XENP022138 2A11_H1.158_L2.126_Fab Heavy Chain
EVQLVQSGAEVKKPGATVKISCKASGFNIKDYFMHWVQQAPGKGLEWMGWITPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28255 - protein, 118 aa, Artificial Sequence
  Description of Artificial Sequence: Synthetic polypeptide
  VH of XENP022138
EVQLVQSGAEVKKPGATVKISCKASGFNIKDYFMHWVQQAPGKGLEWMGWITPELGDTEYAPKFQGRVTITADTSTNTAYMELSSLRSEDTAVYYCYARGVYQALDYWGQGTLVTVSS

SEQ ID NO: 28256 - protein, 5 aa, Artificial Sequence
  Description of Artificial Sequence: Synthetic peptide
  XENP022138 vhCDR1
DYFMH

SEQ ID NO: 28257 - protein, 17 aa, Artificial Sequence
  Description of Artificial Sequence: Synthetic peptide
  XENP022138 vhCDR2
WITPELGDTEYAPKFQG

SEQ ID NO: 28258 - protein, 9 aa, Artificial Sequence
  Description of Artificial Sequence: Synthetic peptide
  XENP022138 vhCDR3
RGVYQALDY

SEQ ID NO: 28259 - protein, 214 aa, Artificial Sequence; identical to SEQ ID NO: 22259
  Description of Artificial Sequence: Synthetic polypeptide
  XENP022138 2A11_H1.158_L2.126_Fab Light Chain

SEQ ID NO: 28260 - protein, 107 aa, Artificial Sequence; identical to SEQ ID NO: 22260
  Description of Artificial Sequence: Synthetic polypeptide
  VL of XENP022138

SEQ ID NO: 28261 - protein, 11 aa, Artificial Sequence
  Description of Artificial Sequence: Synthetic peptide
  XENP022138 vlCDR1
QASQDIGNYLN

SEQ ID NO: 28262 - protein, 7 aa, Artificial Sequence
  Description of Artificial Sequence: Synthetic peptide
  XENP022138 vlCDR2
FTSYLHS

SEQ ID NO: 28263 - protein, 9 aa, Artificial Sequence
  Description of Artificial Sequence: Synthetic peptide
  XENP022138 vlCDR3
QEGNTLPYT

SEQ ID NO: 28264 - protein, 223 aa, Artificial Sequence
  Description of Artificial Sequence: Synthetic polypeptide
  XENP022139 2A11_H1.159_L2.126_Fab Heavy Chain
EVQLVQSGAEVKKPGATVKISCKASGFNIKDYFMHWVQQAPGKGLEWMGWIVPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28265 - protein, 118 aa, Artificial Sequence
  Description of Artificial Sequence: Synthetic polypeptide
  VH of XENP022139
EVQLVQSGAEVKKPGATVKISCKASGFNIKDYFMHWVQQAPGKGLEWMGWIVPELGDTEYAPKFQGRVTITADTSTNTAYMELSSLRSEDTAVYYCYARGVYQALDYWGQGTLVTVSS

SEQ ID NO: 28266 - protein, 5 aa, Artificial Sequence
  Description of Artificial Sequence: Synthetic peptide
  XENP022139 vhCDR1
DYFMH

SEQ ID NO: 28267 - protein, 17 aa, Artificial Sequence
  Description of Artificial Sequence: Synthetic peptide
  XENP022139 vhCDR2
WIVPELGDTEYAPKFQG

SEQ ID NO: 28268 - protein, 9 aa, Artificial Sequence
  Description of Artificial Sequence: Synthetic peptide
  XENP022139 vhCDR3
RGVYQALDY

SEQ ID NO: 28269 - protein, 214 aa, Artificial Sequence; identical to SEQ ID NO: 22259
  Description of Artificial Sequence: Synthetic polypeptide
  XENP022139 2A11_H1.159_L2.126_Fab Light Chain

SEQ ID NO: 28270 - protein, 107 aa, Artificial Sequence; identical to SEQ ID NO: 22260
  Description of Artificial Sequence: Synthetic polypeptide
  VL of XENP022139

SEQ ID NO: 28271 - protein, 11 aa, Artificial Sequence
  Description of Artificial Sequence: Synthetic peptide
  XENP022139 vlCDR1
QASQDIGNYLN

SEQ ID NO: 28272 - protein, 7 aa, Artificial Sequence
  Description of Artificial Sequence: Synthetic peptide
  XENP022139 vlCDR2
FTSYLHS

SEQ ID NO: 28273 - protein, 9 aa, Artificial Sequence
  Description of Artificial Sequence: Synthetic peptide
  XENP022139 vlCDR3
QEGNTLPYT

SEQ ID NO: 28274 - protein, 223 aa, Artificial Sequence
  Description of Artificial Sequence: Synthetic polypeptide
  XENP022140 2A11_H1.160_L2.126_Fab Heavy Chain
EVQLVQSGAEVKKPGATVKISCKASGFNIKDYFMHWVQQAPGKGLEWMGWIAPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28275 - protein, 118 aa, Artificial Sequence
  Description of Artificial Sequence: Synthetic polypeptide
  VH of XENP022140
EVQLVQSGAEVKKPGATVKISCKASGFNIKDYFMHWVQQAPGKGLEWMGWIAPELGDTEYAPKFQGRVTITADTSTNTAYMELSSLRSEDTAVYYCYARGVYQALDYWGQGTLVTVSS

SEQ ID NO: 28276 - protein, 5 aa, Artificial Sequence
  Description of Artificial Sequence: Synthetic peptide
  XENP022140 vhCDR1
DYFMH

SEQ ID NO: 28277 - protein, 17 aa, Artificial Sequence
  Description of Artificial Sequence: Synthetic peptide
  XENP022140 vhCDR2
WIAPELGDTEYAPKFQG

SEQ ID NO: 28278 - protein, 9 aa, Artificial Sequence
  Description of Artificial Sequence: Synthetic peptide
  XENP022140 vhCDR3
RGVYQALDY

SEQ ID NO: 28279 - protein, 214 aa, Artificial Sequence; identical to SEQ ID NO: 22259
  Description of Artificial Sequence: Synthetic polypeptide
  XENP022140 2A11_H1.160_L2.126_Fab Light Chain

SEQ ID NO: 28280 - protein, 107 aa, Artificial Sequence; identical to SEQ ID NO: 22260
  Description of Artificial Sequence: Synthetic polypeptide
  VL of XENP022140

SEQ ID NO: 28281 - protein, 11 aa, Artificial Sequence
  Description of Artificial Sequence: Synthetic peptide
  XENP022140 vlCDR1
QASQDIGNYLN

SEQ ID NO: 28282 - protein, 7 aa, Artificial Sequence
  Description of Artificial Sequence: Synthetic peptide
  XENP022140 vlCDR2
FTSYLHS

SEQ ID NO: 28283 - protein, 9 aa, Artificial Sequence
  Description of Artificial Sequence: Synthetic peptide
  XENP022140 vlCDR3
QEGNTLPYT

SEQ ID NO: 28284 - protein, 223 aa, Artificial Sequence
  Description of Artificial Sequence: Synthetic polypeptide
  XENP022141 2A11_H1.161_L2.126_Fab Heavy Chain
EVQLVQSGAEVKKPGATVKISCKASGFNIKDYFMHWVQQAPGKGLEWMGWIIPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28285 - protein, 118 aa, Artificial Sequence
  Description of Artificial Sequence: Synthetic polypeptide
  VH of XENP022141
EVQLVQSGAEVKKPGATVKISCKASGFNIKDYFMHWVQQAPGKGLEWMGWIIPELGDTEYAPKFQGRVTITADTSTNTAYMELSSLRSEDTAVYYCYARGVYQALDYWGQGTLVTVSS

SEQ ID NO: 28286 - protein, 5 aa, Artificial Sequence
  Description of Artificial Sequence: Synthetic peptide
  XENP022141 vhCDR1
DYFMH

SEQ ID NO: 28287 - protein, 17 aa, Artificial Sequence
  Description of Artificial Sequence: Synthetic peptide
  XENP022141 vhCDR2
WIIPELGDTEYAPKFQG

SEQ ID NO: 28288 - protein, 9 aa, Artificial Sequence
  Description of Artificial Sequence: Synthetic peptide
  XENP022141 vhCDR3
RGVYQALDY

SEQ ID NO: 28289 - protein, 214 aa, Artificial Sequence; identical to SEQ ID NO: 22259
  Description of Artificial Sequence: Synthetic polypeptide
  XENP022141 2A11_H1.161_L2.126_Fab Light Chain

SEQ ID NO: 28290 - protein, 107 aa, Artificial Sequence; identical to SEQ ID NO: 22260
  Description of Artificial Sequence: Synthetic polypeptide
  VL of XENP022141

SEQ ID NO: 28291 - protein, 11 aa, Artificial Sequence
  Description of Artificial Sequence: Synthetic peptide
  XENP022141 vlCDR1
QASQDIGNYLN

SEQ ID NO: 28292 - protein, 7 aa, Artificial Sequence
  Description of Artificial Sequence: Synthetic peptide
  XENP022141 vlCDR2
FTSYLHS

SEQ ID NO: 28293 - protein, 9 aa, Artificial Sequence
  Description of Artificial Sequence: Synthetic peptide
  XENP022141 vlCDR3
QEGNTLPYT

SEQ ID NO: 28294 - protein, 223 aa, Artificial Sequence
  Description of Artificial Sequence: Synthetic polypeptide
  XENP022142 2A11_H1.162_L2.126_Fab Heavy Chain
EVQLVQSGAEVKKPGATVKISCKASGFNIKDYFMHWVQQAPGKGLEWMGWIGPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28295 - protein, 118 aa, Artificial Sequence
  Description of Artificial Sequence: Synthetic polypeptide
  VH of XENP022142
EVQLVQSGAEVKKPGATVKISCKASGFNIKDYFMHWVQQAPGKGLEWMGWIGPELGDTEYAPKFQGRVTITADTSTNTAYMELSSLRSEDTAVYYCYARGVYQALDYWGQGTLVTVSS

SEQ ID NO: 28296 - protein, 5 aa, Artificial Sequence
  Description of Artificial Sequence: Synthetic peptide
  XENP022142 vhCDR1
DYFMH

SEQ ID NO: 28297 - protein, 17 aa, Artificial Sequence
  Description of Artificial Sequence: Synthetic peptide
  XENP022142 vhCDR2
WIGPELGDTEYAPKFQG

SEQ ID NO: 28298 - protein, 9 aa, Artificial Sequence
  Description of Artificial Sequence: Synthetic peptide
  XENP022142 vhCDR3
RGVYQALDY

SEQ ID NO: 28299 - protein, 214 aa, Artificial Sequence; identical to SEQ ID NO: 22259
  Description of Artificial Sequence: Synthetic polypeptide
  XENP022142 2A11_H1.162_L2.126_Fab Light Chain

SEQ ID NO: 28300 - protein, 107 aa, Artificial Sequence; identical to SEQ ID NO: 22260
  Description of Artificial Sequence: Synthetic polypeptide
  VL of XENP022142

SEQ ID NO: 28301 - protein, 11 aa, Artificial Sequence
  Description of Artificial Sequence: Synthetic peptide
  XENP022142 vlCDR1
QASQDIGNYLN

SEQ ID NO: 28302 - protein, 7 aa, Artificial Sequence
  Description of Artificial Sequence: Synthetic peptide
  XENP022142 vlCDR2
FTSYLHS

SEQ ID NO: 28303 - protein, 9 aa, Artificial Sequence
  Description of Artificial Sequence: Synthetic peptide
  XENP022142 vlCDR3
QEGNTLPYT

SEQ ID NO: 28304 - protein, 223 aa, Artificial Sequence
  Description of Artificial Sequence: Synthetic polypeptide
  XENP022143 2A11_H1.163_L2.126_Fab Heavy Chain
EVQLVQSGAEVKKPGATVKISCKASGFNIKDYFMHWVQQAPGKGLEWMGWILPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28305 - protein, 118 aa, Artificial Sequence
  Description of Artificial Sequence: Synthetic polypeptide
  VH of XENP022143
EVQLVQSGAEVKKPGATVKISCKASGFNIKDYFMHWVQQAPGKGLEWMGWILPELGDTEYAPKFQGRVTITADTSTNTAYMELSSLRSEDTAVYYCYARGVYQALDYWGQGTLVTVSS

SEQ ID NO: 28306 - protein, 5 aa, Artificial Sequence
  Description of Artificial Sequence: Synthetic peptide
  XENP022143 vhCDR1
DYFMH

SEQ ID NO: 28307 - protein, 17 aa, Artificial Sequence
  Description of Artificial Sequence: Synthetic peptide
  XENP022143 vhCDR2
WILPELGDTEYAPKFQG

SEQ ID NO: 28308 - protein, 9 aa, Artificial Sequence
  Description of Artificial Sequence: Synthetic peptide
  XENP022143 vhCDR3
RGVYQALDY

SEQ ID NO: 28309 - protein, 214 aa, Artificial Sequence; identical to SEQ ID NO: 22259
  Description of Artificial Sequence: Synthetic polypeptide
  XENP022143 2A11_H1.163_L2.126_Fab Light Chain

SEQ ID NO: 28310 - protein, 107 aa, Artificial Sequence; identical to SEQ ID NO: 22260
  Description of Artificial Sequence: Synthetic polypeptide
  VL of XENP022143

SEQ ID NO: 28311 - protein, 11 aa, Artificial Sequence
  Description of Artificial Sequence: Synthetic peptide
  XENP022143 vlCDR1
QASQDIGNYLN

SEQ ID NO: 28312 - protein, 7 aa, Artificial Sequence
  Description of Artificial Sequence: Synthetic peptide
  XENP022143 vlCDR2
FTSYLHS

SEQ ID NO: 28313 - protein, 9 aa, Artificial Sequence
  Description of Artificial Sequence: Synthetic peptide
  XENP022143 vlCDR3
QEGNTLPYT

SEQ ID NO: 28314 - protein, 223 aa, Artificial Sequence
  Description of Artificial Sequence: Synthetic polypeptide
  XENP022144 2A11_H1.164_L2.126_Fab Heavy Chain
EVQLVQSGAEVKKPGATVKISCKASGFNIKDYFMHWVQQAPGKGLEWMGWITPETGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28315 - protein, 118 aa, Artificial Sequence
  Description of Artificial Sequence: Synthetic polypeptide
  VH of XENP022144
EVQLVQSGAEVKKPGATVKISCKASGFNIKDYFMHWVQQAPGKGLEWMGWITPETGDTEYAPKFQGRVTITADTSTNTAYMELSSLRSEDTAVYYCYARGVYQALDYWGQGTLVTVSS

SEQ ID NO: 28316 - protein, 5 aa, Artificial Sequence
  Description of Artificial Sequence: Synthetic peptide
  XENP022144 vhCDR1
DYFMH

SEQ ID NO: 28317 - protein, 17 aa, Artificial Sequence
  Description of Artificial Sequence: Synthetic peptide
  XENP022144 vhCDR2
WITPETGDTEYAPKFQG

SEQ ID NO: 28318 - protein, 9 aa, Artificial Sequence
  Description of Artificial Sequence: Synthetic peptide
  XENP022144 vhCDR3
RGVYQALDY

SEQ ID NO: 28319 - protein, 214 aa, Artificial Sequence; identical to SEQ ID NO: 22259
  Description of Artificial Sequence: Synthetic polypeptide
  XENP022144 2A11_H1.164_L2.126_Fab Light Chain

SEQ ID NO: 28320 - protein, 107 aa, Artificial Sequence; identical to SEQ ID NO: 22260
  Description of Artificial Sequence: Synthetic polypeptide
  VL of XENP022144

SEQ ID NO: 28321 - protein, 11 aa, Artificial Sequence
  Description of Artificial Sequence: Synthetic peptide
  XENP022144 vlCDR1
QASQDIGNYLN

SEQ ID NO: 28322 - protein, 7 aa, Artificial Sequence
  Description of Artificial Sequence: Synthetic peptide
  XENP022144 vlCDR2
FTSYLHS

SEQ ID NO: 28323 - protein, 9 aa, Artificial Sequence
  Description of Artificial Sequence: Synthetic peptide
  XENP022144 vlCDR3
QEGNTLPYT

SEQ ID NO: 28324 - protein, 223 aa, Artificial Sequence
  Description of Artificial Sequence: Synthetic polypeptide
  XENP022145 2A11_H1.165_L2.126_Fab Heavy Chain
EVQLVQSGAEVKKPGATVKISCKASGFNIKDYFMHWVQQAPGKGLEWMGWIVPETGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28325 - protein, 118 aa, Artificial Sequence
  Description of Artificial Sequence: Synthetic polypeptide
  VH of XENP022145
EVQLVQSGAEVKKPGATVKISCKASGFNIKDYFMHWVQQAPGKGLEWMGWIVPETGDTEYAPKFQGRVTITADTSTNTAYMELSSLRSEDTAVYYCYARGVYQALDYWGQGTLVTVSS

SEQ ID NO: 28326 - protein, 5 aa, Artificial Sequence
  Description of Artificial Sequence: Synthetic peptide
  XENP022145 vhCDR1
DYFMH

SEQ ID NO: 28327 - protein, 17 aa, Artificial Sequence
  Description of Artificial Sequence: Synthetic peptide
  XENP022145 vhCDR2
WIVPETGDTEYAPKFQG

SEQ ID NO: 28328 - protein, 9 aa, Artificial Sequence
  Description of Artificial Sequence: Synthetic peptide
  XENP022145 vhCDR3
RGVYQALDY

SEQ ID NO: 28329 - protein, 214 aa, Artificial Sequence; identical to SEQ ID NO: 22259
  Description of Artificial Sequence: Synthetic polypeptide
  XENP022145 2A11_H1.165_L2.126_Fab Light Chain

SEQ ID NO: 28330 - protein, 107 aa, Artificial Sequence; identical to SEQ ID NO: 22260
  Description of Artificial Sequence: Synthetic polypeptide
  VL of XENP022145

SEQ ID NO: 28331 - protein, 11 aa, Artificial Sequence
  Description of Artificial Sequence: Synthetic peptide
  XENP022145 vlCDR1
QASQDIGNYLN

SEQ ID NO: 28332 - protein, 7 aa, Artificial Sequence
  Description of Artificial Sequence: Synthetic peptide
  XENP022145 vlCDR2
FTSYLHS

SEQ ID NO: 28333 - protein, 9 aa, Artificial Sequence
  Description of Artificial Sequence: Synthetic peptide
  XENP022145 vlCDR3
QEGNTLPYT

SEQ ID NO: 28334 - protein, 223 aa, Artificial Sequence
  Description of Artificial Sequence: Synthetic polypeptide
  XENP022146 2A11_H1.166_L2.126_Fab Heavy Chain
EVQLVQSGAEVKKPGATVKISCKASGFNIKDYFMHWVQQAPGKGLEWMGWIAPETGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28335 - protein, 118 aa, Artificial Sequence
  Description of Artificial Sequence: Synthetic polypeptide
  VH of XENP022146
EVQLVQSGAEVKKPGATVKISCKASGFNIKDYFMHWVQQAPGKGLEWMGWIAPETGDTEYAPKFQGRVTITADTSTNTAYMELSSLRSEDTAVYYCYARGVYQALDYWGQGTLVTVSS

SEQ ID NO: 28336 - protein, 5 aa, Artificial Sequence
  Description of Artificial Sequence: Synthetic peptide
  XENP022146 vhCDR1
DYFMH

SEQ ID NO: 28337 - protein, 17 aa, Artificial Sequence
  Description of Artificial Sequence: Synthetic peptide
  XENP022146 vhCDR2
WIAPETGDTEYAPKFQG

SEQ ID NO: 28338 - protein, 9 aa, Artificial Sequence
  Description of Artificial Sequence: Synthetic peptide
  XENP022146 vhCDR3
RGVYQALDY

SEQ ID NO: 28339 - protein, 214 aa, Artificial Sequence; identical to SEQ ID NO: 22259
  Description of Artificial Sequence: Synthetic polypeptide
  XENP022146 2A11_H1.166_L2.126_Fab Light Chain

SEQ ID NO: 28340 - protein, 107 aa, Artificial Sequence; identical to SEQ ID NO: 22260
  Description of Artificial Sequence: Synthetic polypeptide
  VL of XENP022146

SEQ ID NO: 28341 - protein, 11 aa, Artificial Sequence
  Description of Artificial Sequence: Synthetic peptide
  XENP022146 vlCDR1
QASQDIGNYLN

SEQ ID NO: 28342 - protein, 7 aa, Artificial Sequence
  Description of Artificial Sequence: Synthetic peptide
  XENP022146 vlCDR2
FTSYLHS

SEQ ID NO: 28343 - protein, 9 aa, Artificial Sequence
  Description of Artificial Sequence: Synthetic peptide
  XENP022146 vlCDR3
QEGNTLPYT

SEQ ID NO: 28344 - protein, 223 aa, Artificial Sequence
  Description of Artificial Sequence: Synthetic polypeptide
  XENP022147 2A11_H1.167_L2.126_Fab Heavy Chain
EVQLVQSGAEVKKPGATVKISCKASGFNIKDYFMHWVQQAPGKGLEWMGWIIPETGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28345 - protein, 118 aa, Artificial Sequence
  Description of Artificial Sequence: Synthetic polypeptide
  VH of XENP022147
EVQLVQSGAEVKKPGATVKISCKASGFNIKDYFMHWVQQAPGKGLEWMGWIIPETGDTEYAPKFQGRVTITADTSTNTAYMELSSLRSEDTAVYYCYARGVYQALDYWGQGTLVTVSS

SEQ ID NO: 28346 - protein, 5 aa, Artificial Sequence
  Description of Artificial Sequence: Synthetic peptide
  XENP022147 vhCDR1
DYFMH

SEQ ID NO: 28347 - protein, 17 aa, Artificial Sequence
  Description of Artificial Sequence: Synthetic peptide
  XENP022147 vhCDR2
WIIPETGDTEYAPKFQG

SEQ ID NO: 28348 - protein, 9 aa, Artificial Sequence
  Description of Artificial Sequence: Synthetic peptide
  XENP022147 vhCDR3
RGVYQALDY

SEQ ID NO: 28349 - protein, 214 aa, Artificial Sequence; identical to SEQ ID NO: 22259
  Description of Artificial Sequence: Synthetic polypeptide
  XENP022147 2A11_H1.167_L2.126_Fab Light Chain

SEQ ID NO: 28350 - protein, 107 aa, Artificial Sequence; identical to SEQ ID NO: 22260
  Description of Artificial Sequence: Synthetic polypeptide
  VL of XENP022147

SEQ ID NO: 28351 - protein, 11 aa, Artificial Sequence
  Description of Artificial Sequence: Synthetic peptide
  XENP022147 vlCDR1
QASQDIGNYLN

SEQ ID NO: 28352 - protein, 7 aa, Artificial Sequence
  Description of Artificial Sequence: Synthetic peptide
  XENP022147 vlCDR2
FTSYLHS

SEQ ID NO: 28353 - protein, 9 aa, Artificial Sequence
  Description of Artificial Sequence: Synthetic peptide
  XENP022147 vlCDR3
QEGNTLPYT

SEQ ID NO: 28354 - protein, 223 aa, Artificial Sequence
  Description of Artificial Sequence: Synthetic polypeptide
  XENP022148 2A11_H1.168_L2.126_Fab Heavy Chain
EVQLVQSGAEVKKPGATVKISCKASGFNIKDYFMHWVQQAPGKGLEWMGWIGPETGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28355 - protein, 118 aa, Artificial Sequence
  Description of Artificial Sequence: Synthetic polypeptide
  VH of XENP022148
EVQLVQSGAEVKKPGATVKISCKASGFNIKDYFMHWVQQAPGKGLEWMGWIGPETGDTEYAPKFQGRVTITADTSTNTAYMELSSLRSEDTAVYYCYARGVYQALDYWGQGTLVTVSS

SEQ ID NO: 28356 - protein, 5 aa, Artificial Sequence
  Description of Artificial Sequence: Synthetic peptide
  XENP022148 vhCDR1
DYFMH

SEQ ID NO: 28357 - protein, 17 aa, Artificial Sequence
  Description of Artificial Sequence: Synthetic peptide
  XENP022148 vhCDR2
WIGPETGDTEYAPKFQG

SEQ ID NO: 28358 - protein, 9 aa, Artificial Sequence
  Description of Artificial Sequence: Synthetic peptide
  XENP022148 vhCDR3
RGVYQALDY

SEQ ID NO: 28359 - protein, 214 aa, Artificial Sequence; identical to SEQ ID NO: 22259
  Description of Artificial Sequence: Synthetic polypeptide
  XENP022148 2A11_H1.168_L2.126_Fab Light Chain

SEQ ID NO: 28360 - protein, 107 aa, Artificial Sequence; identical to SEQ ID NO: 22260
  Description of Artificial Sequence: Synthetic polypeptide
  VL of XENP022148

SEQ ID NO: 28361 - protein, 11 aa, Artificial Sequence
  Description of Artificial Sequence: Synthetic peptide
  XENP022148 vlCDR1
QASQDIGNYLN

SEQ ID NO: 28362 - protein, 7 aa, Artificial Sequence
  Description of Artificial Sequence: Synthetic peptide
  XENP022148 vlCDR2
FTSYLHS

SEQ ID NO: 28363 - protein, 9 aa, Artificial Sequence
  Description of Artificial Sequence: Synthetic peptide
  XENP022148 vlCDR3
QEGNTLPYT

SEQ ID NO: 28364 - protein, 223 aa, Artificial Sequence
  Description of Artificial Sequence: Synthetic polypeptide
  XENP022149 2A11_H1.169_L2.126_Fab Heavy Chain
EVQLVQSGAEVKKPGATVKISCKASGFNIKDYFMHWVQQAPGKGLEWMGWILPETGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28365 - protein, 118 aa, Artificial Sequence
  Description of Artificial Sequence: Synthetic polypeptide
  VH of XENP022149
EVQLVQSGAEVKKPGATVKISCKASGFNIKDYFMHWVQQAPGKGLEWMGWILPETGDTEYAPKFQGRVTITADTSTNTAYMELSSLRSEDTAVYYCYARGVYQALDYWGQGTLVTVSS

SEQ ID NO: 28366 - protein, 5 aa, Artificial Sequence
  Description of Artificial Sequence: Synthetic peptide
  XENP022149 vhCDR1
DYFMH

SEQ ID NO: 28367 - protein, 17 aa, Artificial Sequence
  Description of Artificial Sequence: Synthetic peptide
  XENP022149 vhCDR2
WILPETGDTEYAPKFQG

SEQ ID NO: 28368 - protein, 9 aa, Artificial Sequence
  Description of Artificial Sequence: Synthetic peptide
  XENP022149 vhCDR3
RGVYQALDY

SEQ ID NO: 28369 - protein, 214 aa, Artificial Sequence; identical to SEQ ID NO: 22259
  Description of Artificial Sequence: Synthetic polypeptide
  XENP022149 2A11_H1.169_L2.126_Fab Light Chain

SEQ ID NO: 28370 - protein, 107 aa, Artificial Sequence; identical to SEQ ID NO: 22260
  Description of Artificial Sequence: Synthetic polypeptide
  VL of XENP022149

SEQ ID NO: 28371 - protein, 11 aa, Artificial Sequence
  Description of Artificial Sequence: Synthetic peptide
  XENP022149 vlCDR1
QASQDIGNYLN

SEQ ID NO: 28372 - protein, 7 aa, Artificial Sequence
  Description of Artificial Sequence: Synthetic peptide
  XENP022149 vlCDR2
FTSYLHS

SEQ ID NO: 28373 - protein, 9 aa, Artificial Sequence
  Description of Artificial Sequence: Synthetic peptide
  XENP022149 vlCDR3
QEGNTLPYT

SEQ ID NO: 28374 - protein, 223 aa, Artificial Sequence; identical to SEQ ID NO: 27634
  Description of Artificial Sequence: Synthetic polypeptide
  XENP022450 2A11_H1.144_L2.128_Fab Heavy Chain

SEQ ID NO: 28375 - protein, 118 aa, Artificial Sequence; identical to SEQ ID NO: 22085
  Description of Artificial Sequence: Synthetic polypeptide
  VH of XENP022450

SEQ ID NO: 28376 - protein, 5 aa, Artificial Sequence
  Description of Artificial Sequence: Synthetic peptide
  XENP022450 vhCDR1
DYFMH

SEQ ID NO: 28377 - protein, 17 aa, Artificial Sequence
  Description of Artificial Sequence: Synthetic peptide
  XENP022450 vhCDR2
WIDPELGDTEYAPKFQG

SEQ ID NO: 28378 - protein, 9 aa, Artificial Sequence
  Description of Artificial Sequence: Synthetic peptide
  XENP022450 vhCDR3
RGVYQALDY

SEQ ID NO: 28379 - protein, 214 aa, Artificial Sequence
  Description of Artificial Sequence: Synthetic polypeptide
  XENP022450 2A11_H1.144_L2.128_Fab Light Chain
DIQMTQSPAFLSVTPGEKVTITCQASQDIGNYLNWFQQKPGQTVKLLIYYTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28380 - protein, 107 aa, Artificial Sequence
  Description of Artificial Sequence: Synthetic polypeptide
  VL of XENP022450
DIQMTQSPAFLSVTPGEKVTITCQASQDIGNYLNWFQQKPGQTVKLLIYYTSYLHSGVPSRFSGSGSGTDYTFTISSLEAEDAATYFCQEGNTLPYTFGGGTKVEIK

SEQ ID NO: 28381 - protein, 11 aa, Artificial Sequence
  Description of Artificial Sequence: Synthetic peptide
  XENP022450 vlCDR1
QASQDIGNYLN

SEQ ID NO: 28382 - protein, 7 aa, Artificial Sequence
  Description of Artificial Sequence: Synthetic peptide
  XENP022450 vlCDR2
YTSYLHS

SEQ ID NO: 28383 - protein, 9 aa, Artificial Sequence
  Description of Artificial Sequence: Synthetic peptide
  XENP022450 vlCDR3
QEGNTLPYT

SEQ ID NO: 28384 - protein, 223 aa, Artificial Sequence; identical to SEQ ID NO: 27634
  Description of Artificial Sequence: Synthetic polypeptide
  XENP022451 2A11_H1.144_L2.129_Fab Heavy Chain

SEQ ID NO: 28385 - protein, 118 aa, Artificial Sequence; identical to SEQ ID NO: 22085
  Description of Artificial Sequence: Synthetic polypeptide
  VH of XENP022451

SEQ ID NO: 28386 - protein, 5 aa, Artificial Sequence
  Description of Artificial Sequence: Synthetic peptide
  XENP022451 vhCDR1
DYFMH

SEQ ID NO: 28387 - protein, 17 aa, Artificial Sequence
  Description of Artificial Sequence: Synthetic peptide
  XENP022451 vhCDR2
WIDPELGDTEYAPKFQG

SEQ ID NO: 28388 - protein, 9 aa, Artificial Sequence
  Description of Artificial Sequence: Synthetic peptide
  XENP022451 vhCDR3
RGVYQALDY

SEQ ID NO: 28389 - protein, 214 aa, Artificial Sequence
  Description of Artificial Sequence: Synthetic polypeptide
  XENP022451 2A11_H1.144_L2.129_Fab Light Chain
DIQMTQSPAFLSVTPGEKVTITCQASQDIGNYLNWFQQKPDQTPKLLIYYTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28390 - protein, 107 aa, Artificial Sequence
  Description of Artificial Sequence: Synthetic polypeptide
  VL of XENP022451
DIQMTQSPAFLSVTPGEKVTITCQASQDIGNYLNWFQQKPDQTPKLLIYYTSYLHSGVPSRFSGSGSGTDYTFTISSLEAEDAATYFCQEGNTLPYTFGGGTKVEIK

SEQ ID NO: 28391 - protein, 11 aa, Artificial Sequence
  Description of Artificial Sequence: Synthetic peptide
  XENP022451 vlCDR1
QASQDIGNYLN

SEQ ID NO: 28392 - protein, 7 aa, Artificial Sequence
  Description of Artificial Sequence: Synthetic peptide
  XENP022451 vlCDR2
YTSYLHS

SEQ ID NO: 28393 - protein, 9 aa, Artificial Sequence
  Description of Artificial Sequence: Synthetic peptide
  XENP022451 vlCDR3
QEGNTLPYT

SEQ ID NO: 28394 - protein, 223 aa, Artificial Sequence; identical to SEQ ID NO: 27634
  Description of Artificial Sequence: Synthetic polypeptide
  XENP022452 2A11_H1.144_L2.130_Fab Heavy Chain

SEQ ID NO: 28395 - protein, 118 aa, Artificial Sequence; identical to SEQ ID NO: 22085
  Description of Artificial Sequence: Synthetic polypeptide
  VH of XENP022452

SEQ ID NO: 28396 - protein, 5 aa, Artificial Sequence
  Description of Artificial Sequence: Synthetic peptide
  XENP022452 vhCDR1
DYFMH

SEQ ID NO: 28397 - protein, 17 aa, Artificial Sequence
  Description of Artificial Sequence: Synthetic peptide
  XENP022452 vhCDR2
WIDPELGDTEYAPKFQG

SEQ ID NO: 28398 - protein, 9 aa, Artificial Sequence
  Description of Artificial Sequence: Synthetic peptide
  XENP022452 vhCDR3
RGVYQALDY

SEQ ID NO: 28399 - protein, 214 aa, Artificial Sequence
  Description of Artificial Sequence: Synthetic polypeptide
  XENP022452 2A11_H1.144_L2.130_Fab Light Chain
DIQMTQSPAFLSVTPGEKVTITCQASQDIGNYLNWFQQKPGQTPKLLIYYTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28400 - protein, 107 aa, Artificial Sequence
  Description of Artificial Sequence: Synthetic polypeptide
  VL of XENP022452
DIQMTQSPAFLSVTPGEKVTITCQASQDIGNYLNWFQQKPGQTPKLLIYYTSYLHSGVPSRFSGSGSGTDYTFTISSLEAEDAATYFCQEGNTLPYTFGGGTKVEIK

SEQ ID NO: 28401 - protein, 11 aa, Artificial Sequence
  Description of Artificial Sequence: Synthetic peptide
  XENP022452 vlCDR1
QASQDIGNYLN

SEQ ID NO: 28402 - protein, 7 aa, Artificial Sequence
  Description of Artificial Sequence: Synthetic peptide
  XENP022452 vlCDR2
YTSYLHS

SEQ ID NO: 28403 - protein, 9 aa, Artificial Sequence
  Description of Artificial Sequence: Synthetic peptide
  XENP022452 vlCDR3
QEGNTLPYT

SEQ ID NO: 28404 - protein, 223 aa, Artificial Sequence; identical to SEQ ID NO: 27634
  Description of Artificial Sequence: Synthetic polypeptide
  XENP022453 2A11_H1.144_L2.131_Fab Heavy Chain

SEQ ID NO: 28405 - protein, 118 aa, Artificial Sequence; identical to SEQ ID NO: 22085
  Description of Artificial Sequence: Synthetic polypeptide
  VH of XENP022453

SEQ ID NO: 28406 - protein, 5 aa, Artificial Sequence
  Description of Artificial Sequence: Synthetic peptide
  XENP022453 vhCDR1
DYFMH

SEQ ID NO: 28407 - protein, 17 aa, Artificial Sequence
  Description of Artificial Sequence: Synthetic peptide
  XENP022453 vhCDR2
WIDPELGDTEYAPKFQG

SEQ ID NO: 28408 - protein, 9 aa, Artificial Sequence
  Description of Artificial Sequence: Synthetic peptide
  XENP022453 vhCDR3
RGVYQALDY

SEQ ID NO: 28409 - protein, 214 aa, Artificial Sequence
  Description of Artificial Sequence: Synthetic polypeptide
  XENP022453 2A11_H1.144_L2.131_Fab Light Chain
DIQMTQSPAFLSVTPGEKVTITCQASQDIGNYLNWFQQKPGQSPKLLIYYTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28410 - protein, 107 aa, Artificial Sequence
  Description of Artificial Sequence: Synthetic polypeptide
  VL of XENP022453
DIQMTQSPAFLSVTPGEKVTITCQASQDIGNYLNWFQQKPGQSPKLLIYYTSYLHSGVPSRFSGSGSGTDYTFTISSLEAEDAATYFCQEGNTLPYTFGGGTKVEIK

SEQ ID NO: 28411 - protein, 11 aa, Artificial Sequence
  Description of Artificial Sequence: Synthetic peptide
  XENP022453 vlCDR1
QASQDIGNYLN

SEQ ID NO: 28412 - protein, 7 aa, Artificial Sequence
  Description of Artificial Sequence: Synthetic peptide
  XENP022453 vlCDR2
YTSYLHS

SEQ ID NO: 28413 - protein, 9 aa, Artificial Sequence
  Description of Artificial Sequence: Synthetic peptide
  XENP022453 vlCDR3
QEGNTLPYT

SEQ ID NO: 28414 - protein, 223 aa, Artificial Sequence; identical to SEQ ID NO: 28344
  Description of Artificial Sequence: Synthetic polypeptide
  XENP022454 2A11_H1.167_L2.128_Fab Heavy Chain

SEQ ID NO: 28415 - protein, 118 aa, Artificial Sequence; identical to SEQ ID NO: 28345
  Description of Artificial Sequence: Synthetic polypeptide
  VH of XENP022454

SEQ ID NO: 28416 - protein, 5 aa, Artificial Sequence
  Description of Artificial Sequence: Synthetic peptide
  XENP022454 vhCDR1
DYFMH

SEQ ID NO: 28417 - protein, 17 aa, Artificial Sequence
  Description of Artificial Sequence: Synthetic peptide
  XENP022454 vhCDR2
WIIPETGDTEYAPKFQG

SEQ ID NO: 28418 - protein, 9 aa, Artificial Sequence
  Description of Artificial Sequence: Synthetic peptide
  XENP022454 vhCDR3
RGVYQALDY

SEQ ID NO: 28419 - protein, 214 aa, Artificial Sequence; identical to SEQ ID NO: 28379
  Description of Artificial Sequence: Synthetic polypeptide
  XENP022454 2A11_H1.167_L2.128_Fab Light Chain

SEQ ID NO: 28420 - protein, 107 aa, Artificial Sequence; identical to SEQ ID NO: 28380
  Description of Artificial Sequence: Synthetic polypeptide
  VL of XENP022454

SEQ ID NO: 28421 - protein, 11 aa, Artificial Sequence
  Description of Artificial Sequence: Synthetic peptide
  XENP022454 vlCDR1
QASQDIGNYLN

SEQ ID NO: 28422 - protein, 7 aa, Artificial Sequence
  Description of Artificial Sequence: Synthetic peptide
  XENP022454 vlCDR2
YTSYLHS

SEQ ID NO: 28423 - protein, 9 aa, Artificial Sequence
  Description of Artificial Sequence: Synthetic peptide
  XENP022454 vlCDR3
QEGNTLPYT

SEQ ID NO: 28424 - protein, 223 aa, Artificial Sequence; identical to SEQ ID NO: 28344
  Description of Artificial Sequence: Synthetic polypeptide
  XENP022455 2A11_H1.167_L2.129_Fab Heavy Chain

SEQ ID NO: 28425 - protein, 118 aa, Artificial Sequence; identical to SEQ ID NO: 28345
  Description of Artificial Sequence: Synthetic polypeptide
  VH of XENP022455

SEQ ID NO: 28426 - protein, 5 aa, Artificial Sequence
  Description of Artificial Sequence: Synthetic peptide
  XENP022455 vhCDR1
DYFMH

SEQ ID NO: 28427 - protein, 17 aa, Artificial Sequence
  Description of Artificial Sequence: Synthetic peptide
  XENP022455 vhCDR2
WIIPETGDTEYAPKFQG

SEQ ID NO: 28428 - protein, 9 aa, Artificial Sequence
  Description of Artificial Sequence: Synthetic peptide
  XENP022455 vhCDR3
RGVYQALDY

SEQ ID NO: 28429 - protein, 214 aa, Artificial Sequence; identical to SEQ ID NO: 28389
  Description of Artificial Sequence: Synthetic polypeptide
  XENP022455 2A11_H1.167_L2.129_Fab Light Chain

SEQ ID NO: 28430 - protein, 107 aa, Artificial Sequence; identical to SEQ ID NO: 28390
  Description of Artificial Sequence: Synthetic polypeptide
  VL of XENP022455

SEQ ID NO: 28431 - protein, 11 aa, Artificial Sequence
  Description of Artificial Sequence: Synthetic peptide
  XENP022455 vlCDR1
QASQDIGNYLN

SEQ ID NO: 28432 - protein, 7 aa, Artificial Sequence
  Description of Artificial Sequence: Synthetic peptide
  XENP022455 vlCDR2
YTSYLHS

SEQ ID NO: 28433 - protein, 9 aa, Artificial Sequence
  Description of Artificial Sequence: Synthetic peptide
  XENP022455 vlCDR3
QEGNTLPYT

SEQ ID NO: 28434 - protein, 223 aa, Artificial Sequence; identical to SEQ ID NO: 28344
  Description of Artificial Sequence: Synthetic polypeptide
  XENP022456 2A11_H1.167_L2.130_Fab Heavy Chain

SEQ ID NO: 28435 - protein, 118 aa, Artificial Sequence; identical to SEQ ID NO: 28345
  Description of Artificial Sequence: Synthetic polypeptide
  VH of XENP022456

SEQ ID NO: 28436 - protein, 5 aa, Artificial Sequence
  Description of Artificial Sequence: Synthetic peptide
  XENP022456 vhCDR1
DYFMH

SEQ ID NO: 28437 - protein, 17 aa, Artificial Sequence
  Description of Artificial Sequence: Synthetic peptide
  XENP022456 vhCDR2
WIIPETGDTEYAPKFQG

SEQ ID NO: 28438 - protein, 9 aa, Artificial Sequence
  Description of Artificial Sequence: Synthetic peptide
  XENP022456 vhCDR3
RGVYQALDY

SEQ ID NO: 28439 - protein, 214 aa, Artificial Sequence; identical to SEQ ID NO: 28399
  Description of Artificial Sequence: Synthetic polypeptide
  XENP022456 2A11_H1.167_L2.130_Fab Light Chain

SEQ ID NO: 28440 - protein, 107 aa, Artificial Sequence; identical to SEQ ID NO: 28400
  Description of Artificial Sequence: Synthetic polypeptide
  VL of XENP022456

SEQ ID NO: 28441 - protein, 11 aa, Artificial Sequence
  Description of Artificial Sequence: Synthetic peptide
  XENP022456 vlCDR1
QASQDIGNYLN

SEQ ID NO: 28442 - protein, 7 aa, Artificial Sequence
  Description of Artificial Sequence: Synthetic peptide
  XENP022456 vlCDR2
YTSYLHS

SEQ ID NO: 28443 - protein, 9 aa, Artificial Sequence
  Description of Artificial Sequence: Synthetic peptide
  XENP022456 vlCDR3
QEGNTLPYT

SEQ ID NO: 28444 - protein, 223 aa, Artificial Sequence; identical to SEQ ID NO: 28344
  Description of Artificial Sequence: Synthetic polypeptide
  XENP022457 2A11_H1.167_L2.131_Fab Heavy Chain

SEQ ID NO: 28445 - protein, 118 aa, Artificial Sequence; identical to SEQ ID NO: 28345
  Description of Artificial Sequence: Synthetic polypeptide
  VH of XENP022457

SEQ ID NO: 28446 - protein, 5 aa, Artificial Sequence
  Description of Artificial Sequence: Synthetic peptide
  XENP022457 vhCDR1
DYFMH

SEQ ID NO: 28447 - protein, 17 aa, Artificial Sequence
  Description of Artificial Sequence: Synthetic peptide
  XENP022457 vhCDR2
WIIPETGDTEYAPKFQG

SEQ ID NO: 28448 - protein, 9 aa, Artificial Sequence
  Description of Artificial Sequence: Synthetic peptide
  XENP022457 vhCDR3
RGVYQALDY

SEQ ID NO: 28449 - protein, 214 aa, Artificial Sequence; identical to SEQ ID NO: 28409
  Description of Artificial Sequence: Synthetic polypeptide
  XENP022457 2A11_H1.167_L2.131_Fab Light Chain

SEQ ID NO: 28450 - protein, 107 aa, Artificial Sequence; identical to SEQ ID NO: 28410
  Description of Artificial Sequence: Synthetic polypeptide
  VL of XENP022457

SEQ ID NO: 28451 - protein, 11 aa, Artificial Sequence
  Description of Artificial Sequence: Synthetic peptide
  XENP022457 vlCDR1
QASQDIGNYLN

SEQ ID NO: 28452 - protein, 7 aa, Artificial Sequence
  Description of Artificial Sequence: Synthetic peptide
  XENP022457 vlCDR2
YTSYLHS

SEQ ID NO: 28453 - protein, 9 aa, Artificial Sequence
  Description of Artificial Sequence: Synthetic peptide
  XENP022457 vlCDR3
QEGNTLPYT

SEQ ID NO: 28454 - protein, 223 aa, Artificial Sequence; identical to SEQ ID NO: 27734
  Description of Artificial Sequence: Synthetic polypeptide
  XENP022458 2A11_H1.125_L2.128_Fab Heavy Chain

SEQ ID NO: 28455 - protein, 118 aa, Artificial Sequence; identical to SEQ ID NO: 22065
  Description of Artificial Sequence: Synthetic polypeptide
  VH of XENP022458

SEQ ID NO: 28456 - protein, 5 aa, Artificial Sequence
  Description of Artificial Sequence: Synthetic peptide
  XENP022458 vhCDR1
HYFMH

SEQ ID NO: 28457 - protein, 17 aa, Artificial Sequence
  Description of Artificial Sequence: Synthetic peptide
  XENP022458 vhCDR2
WIDPYLGDTEYAPKFQG

SEQ ID NO: 28458 - protein, 9 aa, Artificial Sequence
  Description of Artificial Sequence: Synthetic peptide
  XENP022458 vhCDR3
RGVYQALDY

SEQ ID NO: 28459 - protein, 214 aa, Artificial Sequence; identical to SEQ ID NO: 28379
  Description of Artificial Sequence: Synthetic polypeptide
  XENP022458 2A11_H1.125_L2.128_Fab Light Chain

SEQ ID NO: 28460 - protein, 107 aa, Artificial Sequence; identical to SEQ ID NO: 28380
  Description of Artificial Sequence: Synthetic polypeptide
  VL of XENP022458

SEQ ID NO: 28461 - protein, 11 aa, Artificial Sequence
  Description of Artificial Sequence: Synthetic peptide
  XENP022458 vlCDR1
QASQDIGNYLN

SEQ ID NO: 28462 - protein, 7 aa, Artificial Sequence
  Description of Artificial Sequence: Synthetic peptide
  XENP022458 vlCDR2
YTSYLHS

SEQ ID NO: 28463 - protein, 9 aa, Artificial Sequence
  Description of Artificial Sequence: Synthetic peptide
  XENP022458 vlCDR3
QEGNTLPYT

SEQ ID NO: 28464 - protein, 223 aa, Artificial Sequence; identical to SEQ ID NO: 27734
  Description of Artificial Sequence: Synthetic polypeptide
  XENP022459 2A11_H1.125_L2.129_Fab Heavy Chain

SEQ ID NO: 28465 - protein, 118 aa, Artificial Sequence; identical to SEQ ID NO: 22065
  Description of Artificial Sequence: Synthetic polypeptide
  VH of XENP022459

SEQ ID NO: 28466 - protein, 5 aa, Artificial Sequence
  Description of Artificial Sequence: Synthetic peptide
  XENP022459 vhCDR1
HYFMH

SEQ ID NO: 28467 - protein, 17 aa, Artificial Sequence
  Description of Artificial Sequence: Synthetic peptide
  XENP022459 vhCDR2
WIDPYLGDTEYAPKFQG

SEQ ID NO: 28468 - protein, 9 aa, Artificial Sequence
  Description of Artificial Sequence: Synthetic peptide
  XENP022459 vhCDR3
RGVYQALDY

SEQ ID NO: 28469 - protein, 214 aa, Artificial Sequence; identical to SEQ ID NO: 28389
  Description of Artificial Sequence: Synthetic polypeptide
  XENP022459 2A11_H1.125_L2.129_Fab Light Chain

SEQ ID NO: 28470 - protein, 107 aa, Artificial Sequence; identical to SEQ ID NO: 28390
  Description of Artificial Sequence: Synthetic polypeptide
  VL of XENP022459

SEQ ID NO: 28471 - protein, 11 aa, Artificial Sequence
  Description of Artificial Sequence: Synthetic peptide
  XENP022459 vlCDR1
QASQDIGNYLN

SEQ ID NO: 28472 - protein, 7 aa, Artificial Sequence
  Description of Artificial Sequence: Synthetic peptide
  XENP022459 vlCDR2
YTSYLHS

SEQ ID NO: 28473 - protein, 9 aa, Artificial Sequence
  Description of Artificial Sequence: Synthetic peptide
  XENP022459 vlCDR3
QEGNTLPYT

SEQ ID NO: 28474 - protein, 223 aa, Artificial Sequence; identical to SEQ ID NO: 27734
  Description of Artificial Sequence: Synthetic polypeptide
  XENP022460 2A11_H1.125_L2.130_Fab Heavy Chain

SEQ ID NO: 28475 - protein, 118 aa, Artificial Sequence; identical to SEQ ID NO: 22065
  Description of Artificial Sequence: Synthetic polypeptide
  VH of XENP022460

SEQ ID NO: 28476 - protein, 5 aa, Artificial Sequence
  Description of Artificial Sequence: Synthetic peptide
  XENP022460 vhCDR1
HYFMH

SEQ ID NO: 28477 - protein, 17 aa, Artificial Sequence
  Description of Artificial Sequence: Synthetic peptide
  XENP022460 vhCDR2
WIDPYLGDTEYAPKFQG

SEQ ID NO: 28478 - protein, 9 aa, Artificial Sequence
  Description of Artificial Sequence: Synthetic peptide
  XENP022460 vhCDR3
RGVYQALDY

SEQ ID NO: 28479 - protein, 214 aa, Artificial Sequence; identical to SEQ ID NO: 28399
  Description of Artificial Sequence: Synthetic polypeptide
  XENP022460 2A11_H1.125_L2.130_Fab Light Chain

SEQ ID NO: 28480 - protein, 107 aa, Artificial Sequence; identical to SEQ ID NO: 28400
  Description of Artificial Sequence: Synthetic polypeptide
  VL of XENP022460

SEQ ID NO: 28481 - protein, 11 aa, Artificial Sequence
  Description of Artificial Sequence: Synthetic peptide
  XENP022460 vlCDR1
QASQDIGNYLN

SEQ ID NO: 28482 - protein, 7 aa, Artificial Sequence
  Description of Artificial Sequence: Synthetic peptide
  XENP022460 vlCDR2
YTSYLHS

SEQ ID NO: 28483 - protein, 9 aa, Artificial Sequence
  Description of Artificial Sequence: Synthetic peptide
  XENP022460 vlCDR3
QEGNTLPYT

SEQ ID NO: 28484 - protein, 223 aa, Artificial Sequence; identical to SEQ ID NO: 27734
  Description of Artificial Sequence: Synthetic polypeptide
  XENP022461 2A11_H1.125_L2.131_Fab Heavy Chain

SEQ ID NO: 28485 - protein, 118 aa, Artificial Sequence; identical to SEQ ID NO: 22065
  Description of Artificial Sequence: Synthetic polypeptide
  VH of XENP022461

SEQ ID NO: 28486 - protein, 5 aa, Artificial Sequence
  Description of Artificial Sequence: Synthetic peptide
  XENP022461 vhCDR1
HYFMH

SEQ ID NO: 28487 - protein, 17 aa, Artificial Sequence
  Description of Artificial Sequence: Synthetic peptide
  XENP022461 vhCDR2
WIDPYLGDTEYAPKFQG

SEQ ID NO: 28488 - protein, 9 aa, Artificial Sequence
  Description of Artificial Sequence: Synthetic peptide
  XENP022461 vhCDR3
RGVYQALDY

SEQ ID NO: 28489 - protein, 214 aa, Artificial Sequence; identical to SEQ ID NO: 28409
  Description of Artificial Sequence: Synthetic polypeptide
  XENP022461 2A11_H1.125_L2.131_Fab Light Chain

SEQ ID NO: 28490 - protein, 107 aa, Artificial Sequence; identical to SEQ ID NO: 28410
  Description of Artificial Sequence: Synthetic polypeptide
  VL of XENP022461

SEQ ID NO: 28491 - protein, 11 aa, Artificial Sequence
  Description of Artificial Sequence: Synthetic peptide
  XENP022461 vlCDR1
QASQDIGNYLN

SEQ ID NO: 28492 - protein, 7 aa, Artificial Sequence
  Description of Artificial Sequence: Synthetic peptide
  XENP022461 vlCDR2
YTSYLHS

SEQ ID NO: 28493 - protein, 9 aa, Artificial Sequence
  Description of Artificial Sequence: Synthetic peptide
  XENP022461 vlCDR3
QEGNTLPYT

SEQ ID NO: 28494 - protein, 223 aa, Artificial Sequence; identical to SEQ ID NO: 27634
  Description of Artificial Sequence: Synthetic polypeptide
  XENP022570 2A11_H1.144_L2.132_Fab Heavy Chain

SEQ ID NO: 28495 - protein, 118 aa, Artificial Sequence; identical to SEQ ID NO: 22085
  Description of Artificial Sequence: Synthetic polypeptide
  VH of XENP022570

SEQ ID NO: 28496 - protein, 5 aa, Artificial Sequence
  Description of Artificial Sequence: Synthetic peptide
  XENP022570 vhCDR1
DYFMH

SEQ ID NO: 28497 - protein, 17 aa, Artificial Sequence
  Description of Artificial Sequence: Synthetic peptide
  XENP022570 vhCDR2
WIDPELGDTEYAPKFQG

SEQ ID NO: 28498 - protein, 9 aa, Artificial Sequence
  Description of Artificial Sequence: Synthetic peptide
  XENP022570 vhCDR3
RGVYQALDY

SEQ ID NO: 28499 - protein, 214 aa, Artificial Sequence; identical to SEQ ID NO: 22219
  Description of Artificial Sequence: Synthetic polypeptide
  XENP022570 2A11_H1.144_L2.132_Fab Light Chain

SEQ ID NO: 28500 - protein, 107 aa, Artificial Sequence; identical to SEQ ID NO: 22220
  Description of Artificial Sequence: Synthetic polypeptide
  VL of XENP022570

SEQ ID NO: 28501 - protein, 11 aa, Artificial Sequence
  Description of Artificial Sequence: Synthetic peptide
  XENP022570 vlCDR1
QASQDIGNYLN

SEQ ID NO: 28502 - protein, 7 aa, Artificial Sequence
  Description of Artificial Sequence: Synthetic peptide
  XENP022570 vlCDR2
FTSYLHS

SEQ ID NO: 28503 - protein, 9 aa, Artificial Sequence
  Description of Artificial Sequence: Synthetic peptide
  XENP022570 vlCDR3
QEGNTLPYT

SEQ ID NO: 28504 - protein, 223 aa, Artificial Sequence; identical to SEQ ID NO: 27634
  Description of Artificial Sequence: Synthetic polypeptide
  XENP022571 2A11_H1.144_L2.133_Fab Heavy Chain

SEQ ID NO: 28505 - protein, 118 aa, Artificial Sequence; identical to SEQ ID NO: 22085
  Description of Artificial Sequence: Synthetic polypeptide
  VH of XENP022571

SEQ ID NO: 28506 - protein, 5 aa, Artificial Sequence
  Description of Artificial Sequence: Synthetic peptide
  XENP022571 vhCDR1
DYFMH

SEQ ID NO: 28507 - protein, 17 aa, Artificial Sequence
  Description of Artificial Sequence: Synthetic peptide
  XENP022571 vhCDR2
WIDPELGDTEYAPKFQG

SEQ ID NO: 28508 - protein, 9 aa, Artificial Sequence
  Description of Artificial Sequence: Synthetic peptide
  XENP022571 vhCDR3
RGVYQALDY

SEQ ID NO: 28509 - protein, 214 aa, Artificial Sequence; identical to SEQ ID NO: 22199
  Description of Artificial Sequence: Synthetic polypeptide
  XENP022571 2A11_H1.144_L2.133_Fab Light Chain

SEQ ID NO: 28510 - protein, 107 aa, Artificial Sequence; identical to SEQ ID NO: 22200
  Description of Artificial Sequence: Synthetic polypeptide
  VL of XENP022571

SEQ ID NO: 28511 - protein, 11 aa, Artificial Sequence
  Description of Artificial Sequence: Synthetic peptide
  XENP022571 vlCDR1
QASQDIGNYLN

SEQ ID NO: 28512 - protein, 7 aa, Artificial Sequence
  Description of Artificial Sequence: Synthetic peptide
  XENP022571 vlCDR2
FTSYLHS

SEQ ID NO: 28513 - protein, 9 aa, Artificial Sequence
  Description of Artificial Sequence: Synthetic peptide
  XENP022571 vlCDR3
QEGNTLPYT

SEQ ID NO: 28514 - protein, 223 aa, Artificial Sequence; identical to SEQ ID NO: 27634
  Description of Artificial Sequence: Synthetic polypeptide
  XENP022572 2A11_H1.144_L2.134_Fab Heavy Chain

SEQ ID NO: 28515 - protein, 118 aa, Artificial Sequence; identical to SEQ ID NO: 22085
  Description of Artificial Sequence: Synthetic polypeptide
  VH of XENP022572

SEQ ID NO: 28516 - protein, 5 aa, Artificial Sequence
  Description of Artificial Sequence: Synthetic peptide
  XENP022572 vhCDR1
DYFMH

SEQ ID NO: 28517 - protein, 17 aa, Artificial Sequence
  Description of Artificial Sequence: Synthetic peptide
  XENP022572 vhCDR2
WIDPELGDTEYAPKFQG

SEQ ID NO: 28518 - protein, 9 aa, Artificial Sequence
  Description of Artificial Sequence: Synthetic peptide
  XENP022572 vhCDR3
RGVYQALDY

SEQ ID NO: 28519 - protein, 214 aa, Artificial Sequence
  Description of Artificial Sequence: Synthetic polypeptide
  XENP022572 2A11_H1.144_L2.134_Fab Light Chain
DIQMTQSPAFLSVTPGEKVTITCQASQDIGNYLNWFQQKPGQTPKLLIYFTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28520 - protein, 107 aa, Artificial Sequence
  Description of Artificial Sequence: Synthetic polypeptide
  VL of XENP022572
DIQMTQSPAFLSVTPGEKVTITCQASQDIGNYLNWFQQKPGQTPKLLIYFTSYLHSGVPSRFSGSGSGTDYTFTISSLEAEDAATYFCQEGNTLPYTFGGGTKVEIK

SEQ ID NO: 28521 - protein, 11 aa, Artificial Sequence
  Description of Artificial Sequence: Synthetic peptide
  XENP022572 vlCDR1
QASQDIGNYLN

SEQ ID NO: 28522 - protein, 7 aa, Artificial Sequence
  Description of Artificial Sequence: Synthetic peptide
  XENP022572 vlCDR2
FTSYLHS

SEQ ID NO: 28523 - protein, 9 aa, Artificial Sequence
  Description of Artificial Sequence: Synthetic peptide
  XENP022572 vlCDR3
QEGNTLPYT

SEQ ID NO: 28524 - protein, 223 aa, Artificial Sequence; identical to SEQ ID NO: 27634
  Description of Artificial Sequence: Synthetic polypeptide
  XENP022573 2A11_H1.144_L2.135_Fab Heavy Chain

SEQ ID NO: 28525 - protein, 118 aa, Artificial Sequence; identical to SEQ ID NO: 22085
  Description of Artificial Sequence: Synthetic polypeptide
  VH of XENP022573

SEQ ID NO: 28526 - protein, 5 aa, Artificial Sequence
  Description of Artificial Sequence: Synthetic peptide
  XENP022573 vhCDR1
DYFMH

SEQ ID NO: 28527 - protein, 17 aa, Artificial Sequence
  Description of Artificial Sequence: Synthetic peptide
  XENP022573 vhCDR2
WIDPELGDTEYAPKFQG

SEQ ID NO: 28528 - protein, 9 aa, Artificial Sequence
  Description of Artificial Sequence: Synthetic peptide
  XENP022573 vhCDR3
RGVYQALDY

SEQ ID NO: 28529 - protein, 214 aa, Artificial Sequence
  Description of Artificial Sequence: Synthetic polypeptide
  XENP022573 2A11_H1.144_L2.135_Fab Light Chain
DIQMTQSPAFLSVTPGEKVTITCQASQDIGNYLNWFQQKPGQSPKLLIYFTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28530 - protein, 107 aa, Artificial Sequence
  Description of Artificial Sequence: Synthetic polypeptide
  VL of XENP022573
DIQMTQSPAFLSVTPGEKVTITCQASQDIGNYLNWFQQKPGQSPKLLIYFTSYLHSGVPSRFSGSGSGTDYTFTISSLEAEDAATYFCQEGNTLPYTFGGGTKVEIK

SEQ ID NO: 28531 - protein, 11 aa, Artificial Sequence
  Description of Artificial Sequence: Synthetic peptide
  XENP022573 vlCDR1
QASQDIGNYLN

SEQ ID NO: 28532 - protein, 7 aa, Artificial Sequence
  Description of Artificial Sequence: Synthetic peptide
  XENP022573 vlCDR2
FTSYLHS

SEQ ID NO: 28533 - protein, 9 aa, Artificial Sequence
  Description of Artificial Sequence: Synthetic peptide
  XENP022573 vlCDR3
QEGNTLPYT

SEQ ID NO: 28534 - protein, 223 aa, Artificial Sequence; identical to SEQ ID NO: 27734
  Description of Artificial Sequence: Synthetic polypeptide
  XENP022574 2A11_H1.125_L2.132_Fab Heavy Chain

SEQ ID NO: 28535 - protein, 118 aa, Artificial Sequence; identical to SEQ ID NO: 22065
  Description of Artificial Sequence: Synthetic polypeptide
  VH of XENP022574

SEQ ID NO: 28536 - protein, 5 aa, Artificial Sequence
  Description of Artificial Sequence: Synthetic peptide
  XENP022574 vhCDR1
HYFMH

SEQ ID NO: 28537 - protein, 17 aa, Artificial Sequence
  Description of Artificial Sequence: Synthetic peptide
  XENP022574 vhCDR2
WIDPYLGDTEYAPKFQG

SEQ ID NO: 28538 - protein, 9 aa, Artificial Sequence
  Description of Artificial Sequence: Synthetic peptide
  XENP022574 vhCDR3
RGVYQALDY

SEQ ID NO: 28539 - protein, 214 aa, Artificial Sequence; identical to SEQ ID NO: 22219
  Description of Artificial Sequence: Synthetic polypeptide
  XENP022574 2A11_H1.125_L2.132_Fab Light Chain

SEQ ID NO: 28540 - protein, 107 aa, Artificial Sequence; identical to SEQ ID NO: 22220
  Description of Artificial Sequence: Synthetic polypeptide
  VL of XENP022574

SEQ ID NO: 28541 - protein, 11 aa, Artificial Sequence
  Description of Artificial Sequence: Synthetic peptide
  XENP022574 vlCDR1
QASQDIGNYLN

SEQ ID NO: 28542 - protein, 7 aa, Artificial Sequence
  Description of Artificial Sequence: Synthetic peptide
  XENP022574 vlCDR2
FTSYLHS

SEQ ID NO: 28543 - protein, 9 aa, Artificial Sequence
  Description of Artificial Sequence: Synthetic peptide
  XENP022574 vlCDR3
QEGNTLPYT

SEQ ID NO: 28544 - protein, 223 aa, Artificial Sequence; identical to SEQ ID NO: 27734
  Description of Artificial Sequence: Synthetic polypeptide
  XENP022575 2A11_H1.125_L2.133_Fab Heavy Chain

SEQ ID NO: 28545 - protein, 118 aa, Artificial Sequence; identical to SEQ ID NO: 22065
  Description of Artificial Sequence: Synthetic polypeptide
  VH of XENP022575

SEQ ID NO: 28546 - protein, 5 aa, Artificial Sequence
  Description of Artificial Sequence: Synthetic peptide
  XENP022575 vhCDR1
HYFMH

SEQ ID NO: 28547 - protein, 17 aa, Artificial Sequence
  Description of Artificial Sequence: Synthetic peptide
  XENP022575 vhCDR2
WIDPYLGDTEYAPKFQG

SEQ ID NO: 28548 - protein, 9 aa, Artificial Sequence
  Description of Artificial Sequence: Synthetic peptide
  XENP022575 vhCDR3
RGVYQALDY

SEQ ID NO: 28549 - protein, 214 aa, Artificial Sequence; identical to SEQ ID NO: 22199
  Description of Artificial Sequence: Synthetic polypeptide
  XENP022575 2A11_H1.125_L2.133_Fab Light Chain

SEQ ID NO: 28550 - protein, 107 aa, Artificial Sequence; identical to SEQ ID NO: 22200
  Description of Artificial Sequence: Synthetic polypeptide
  VL of XENP022575

SEQ ID NO: 28551 - protein, 11 aa, Artificial Sequence
  Description of Artificial Sequence: Synthetic peptide
  XENP022575 vlCDR1
QASQDIGNYLN

SEQ ID NO: 28552 - protein, 7 aa, Artificial Sequence
  Description of Artificial Sequence: Synthetic peptide
  XENP022575 vlCDR2
FTSYLHS

SEQ ID NO: 28553 - protein, 9 aa, Artificial Sequence
  Description of Artificial Sequence: Synthetic peptide
  XENP022575 vlCDR3
QEGNTLPYT

SEQ ID NO: 28554 - protein, 223 aa, Artificial Sequence; identical to SEQ ID NO: 27734
  Description of Artificial Sequence: Synthetic polypeptide
  XENP022576 2A11_H1.125_L2.134_Fab Heavy Chain

SEQ ID NO: 28555 - protein, 118 aa, Artificial Sequence; identical to SEQ ID NO: 22065
  Description of Artificial Sequence: Synthetic polypeptide
  VH of XENP022576

SEQ ID NO: 28556 - protein, 5 aa, Artificial Sequence
  Description of Artificial Sequence: Synthetic peptide
  XENP022576 vhCDR1
HYFMH

SEQ ID NO: 28557 - protein, 17 aa, Artificial Sequence
  Description of Artificial Sequence: Synthetic peptide
  XENP022576 vhCDR2
WIDPYLGDTEYAPKFQG

SEQ ID NO: 28558 - protein, 9 aa, Artificial Sequence
  Description of Artificial Sequence: Synthetic peptide
  XENP022576 vhCDR3
RGVYQALDY

SEQ ID NO: 28559 - protein, 214 aa, Artificial Sequence; identical to SEQ ID NO: 28519
  Description of Artificial Sequence: Synthetic polypeptide
  XENP022576 2A11_H1.125_L2.134_Fab Light Chain

SEQ ID NO: 28560 - protein, 107 aa, Artificial Sequence; identical to SEQ ID NO: 28520
  Description of Artificial Sequence: Synthetic polypeptide
  VL of XENP022576

SEQ ID NO: 28561 - protein, 11 aa, Artificial Sequence
  Description of Artificial Sequence: Synthetic peptide
  XENP022576 vlCDR1
QASQDIGNYLN

SEQ ID NO: 28562 - protein, 7 aa, Artificial Sequence
  Description of Artificial Sequence: Synthetic peptide
  XENP022576 vlCDR2
FTSYLHS

SEQ ID NO: 28563 - protein, 9 aa, Artificial Sequence
  Description of Artificial Sequence: Synthetic peptide
  XENP022576 vlCDR3
QEGNTLPYT

SEQ ID NO: 28564 - protein, 223 aa, Artificial Sequence; identical to SEQ ID NO: 27734
  Description of Artificial Sequence: Synthetic polypeptide
  XENP022577 2A11_H1.125_L2.135_Fab Heavy Chain

SEQ ID NO: 28565 - protein, 118 aa, Artificial Sequence; identical to SEQ ID NO: 22065
  Description of Artificial Sequence: Synthetic polypeptide
  VH of XENP022577

SEQ ID NO: 28566 - protein, 5 aa, Artificial Sequence
  Description of Artificial Sequence: Synthetic peptide
  XENP022577 vhCDR1
HYFMH

SEQ ID NO: 28567 - protein, 17 aa, Artificial Sequence
  Description of Artificial Sequence: Synthetic peptide
  XENP022577 vhCDR2
WIDPYLGDTEYAPKFQG

SEQ ID NO: 28568 - protein, 9 aa, Artificial Sequence
  Description of Artificial Sequence: Synthetic peptide
  XENP022577 vhCDR3
RGVYQALDY

SEQ ID NO: 28569 - protein, 214 aa, Artificial Sequence; identical to SEQ ID NO: 28529
  Description of Artificial Sequence: Synthetic polypeptide
  XENP022577 2A11_H1.125_L2.135_Fab Light Chain

SEQ ID NO: 28570 - protein, 107 aa, Artificial Sequence; identical to SEQ ID NO: 28530
  Description of Artificial Sequence: Synthetic polypeptide
  VL of XENP022577

SEQ ID NO: 28571 - protein, 11 aa, Artificial Sequence
  Description of Artificial Sequence: Synthetic peptide
  XENP022577 vlCDR1
QASQDIGNYLN

SEQ ID NO: 28572 - protein, 7 aa, Artificial Sequence
  Description of Artificial Sequence: Synthetic peptide
  XENP022577 vlCDR2
FTSYLHS

SEQ ID NO: 28573 - protein, 9 aa, Artificial Sequence
  Description of Artificial Sequence: Synthetic peptide
  XENP022577 vlCDR3
QEGNTLPYT

SEQ ID NO: 28574 - protein, 223 aa, Artificial Sequence; identical to SEQ ID NO: 27604
  Description of Artificial Sequence: Synthetic polypeptide
  XENP022578 2A11_H1.141_L2.132_Fab Heavy Chain

SEQ ID NO: 28575 - protein, 118 aa, Artificial Sequence; identical to SEQ ID NO: 27605
  Description of Artificial Sequence: Synthetic polypeptide
  VH of XENP022578

SEQ ID NO: 28576 - protein, 5 aa, Artificial Sequence
  Description of Artificial Sequence: Synthetic peptide
  XENP022578 vhCDR1
DYFMH

SEQ ID NO: 28577 - protein, 17 aa, Artificial Sequence
  Description of Artificial Sequence: Synthetic peptide
  XENP022578 vhCDR2
WIDPELGDTEYAPKFQG

SEQ ID NO: 28578 - protein, 9 aa, Artificial Sequence
  Description of Artificial Sequence: Synthetic peptide
  XENP022578 vhCDR3
RGVRQALDY

SEQ ID NO: 28579 - protein, 214 aa, Artificial Sequence; identical to SEQ ID NO: 22219
  Description of Artificial Sequence: Synthetic polypeptide
  XENP022578 2A11_H1.141_L2.132_Fab Light Chain

SEQ ID NO: 28580 - protein, 107 aa, Artificial Sequence; identical to SEQ ID NO: 22220
  Description of Artificial Sequence: Synthetic polypeptide
  VL of XENP022578

SEQ ID NO: 28581 - protein, 11 aa, Artificial Sequence
  Description of Artificial Sequence: Synthetic peptide
  XENP022578 vlCDR1
QASQDIGNYLN

SEQ ID NO: 28582 - protein, 7 aa, Artificial Sequence
  Description of Artificial Sequence: Synthetic peptide
  XENP022578 vlCDR2
FTSYLHS

SEQ ID NO: 28583 - protein, 9 aa, Artificial Sequence
  Description of Artificial Sequence: Synthetic peptide
  XENP022578 vlCDR3
QEGNTLPYT

SEQ ID NO: 28584 - protein, 223 aa, Artificial Sequence; identical to SEQ ID NO: 27604
  Description of Artificial Sequence: Synthetic polypeptide
  XENP022579 2A11_H1.141_L2.133_Fab Heavy Chain

SEQ ID NO: 28585 - protein, 118 aa, Artificial Sequence; identical to SEQ ID NO: 27605
  Description of Artificial Sequence: Synthetic polypeptide
  VH of XENP022579

SEQ ID NO: 28586 - protein, 5 aa, Artificial Sequence
  Description of Artificial Sequence: Synthetic peptide
  XENP022579 vhCDR1
DYFMH

SEQ ID NO: 28587 - protein, 17 aa, Artificial Sequence
  Description of Artificial Sequence: Synthetic peptide
  XENP022579 vhCDR2
WIDPELGDTEYAPKFQG

SEQ ID NO: 28588 - protein, 9 aa, Artificial Sequence
  Description of Artificial Sequence: Synthetic peptide
  XENP022579 vhCDR3
RGVRQALDY

SEQ ID NO: 28589 - protein, 214 aa, Artificial Sequence; identical to SEQ ID NO: 22199
  Description of Artificial Sequence: Synthetic polypeptide
  XENP022579 2A11_H1.141_L2.133_Fab Light Chain

SEQ ID NO: 28590 - protein, 107 aa, Artificial Sequence; identical to SEQ ID NO: 22200
  Description of Artificial Sequence: Synthetic polypeptide
  VL of XENP022579

SEQ ID NO: 28591 - protein, 11 aa, Artificial Sequence
  Description of Artificial Sequence: Synthetic peptide
  XENP022579 vlCDR1
QASQDIGNYLN

SEQ ID NO: 28592 - protein, 7 aa, Artificial Sequence
  Description of Artificial Sequence: Synthetic peptide
  XENP022579 vlCDR2
FTSYLHS

SEQ ID NO: 28593 - protein, 9 aa, Artificial Sequence
  Description of Artificial Sequence: Synthetic peptide
  XENP022579 vlCDR3
QEGNTLPYT

SEQ ID NO: 28594 - protein, 223 aa, Artificial Sequence; identical to SEQ ID NO: 27604
  Description of Artificial Sequence: Synthetic polypeptide
  XENP022580 2A11_H1.141_L2.134_Fab Heavy Chain

SEQ ID NO: 28595 - protein, 118 aa, Artificial Sequence; identical to SEQ ID NO: 27605
  Description of Artificial Sequence: Synthetic polypeptide
  VH of XENP022580

SEQ ID NO: 28596 - protein, 5 aa, Artificial Sequence
  Description of Artificial Sequence: Synthetic peptide
  XENP022580 vhCDR1
DYFMH

SEQ ID NO: 28597 - protein, 17 aa, Artificial Sequence
  Description of Artificial Sequence: Synthetic peptide
  XENP022580 vhCDR2
WIDPELGDTEYAPKFQG

SEQ ID NO: 28598 - protein, 9 aa, Artificial Sequence
  Description of Artificial Sequence: Synthetic peptide
  XENP022580 vhCDR3
RGVRQALDY

SEQ ID NO: 28599 - protein, 214 aa, Artificial Sequence; identical to SEQ ID NO: 28519
  Description of Artificial Sequence: Synthetic polypeptide
  XENP022580 2A11_H1.141_L2.134_Fab Light Chain

SEQ ID NO: 28600 - protein, 107 aa, Artificial Sequence; identical to SEQ ID NO: 28520
  Description of Artificial Sequence: Synthetic polypeptide
  VL of XENP022580

SEQ ID NO: 28601 - protein, 11 aa, Artificial Sequence
  Description of Artificial Sequence: Synthetic peptide
  XENP022580 vlCDR1
QASQDIGNYLN

SEQ ID NO: 28602 - protein, 7 aa, Artificial Sequence
  Description of Artificial Sequence: Synthetic peptide
  XENP022580 vlCDR2
FTSYLHS

SEQ ID NO: 28603 - protein, 9 aa, Artificial Sequence
  Description of Artificial Sequence: Synthetic peptide
  XENP022580 vlCDR3
QEGNTLPYT

SEQ ID NO: 28604 - protein, 223 aa, Artificial Sequence; identical to SEQ ID NO: 27604
  Description of Artificial Sequence: Synthetic polypeptide
  XENP022581 2A11_H1.141_L2.135_Fab Heavy Chain

SEQ ID NO: 28605 - protein, 118 aa, Artificial Sequence; identical to SEQ ID NO: 27605
  Description of Artificial Sequence: Synthetic polypeptide
  VH of XENP022581

SEQ ID NO: 28606 - protein, 5 aa, Artificial Sequence
  Description of Artificial Sequence: Synthetic peptide
  XENP022581 vhCDR1
DYFMH

SEQ ID NO: 28607 - protein, 17 aa, Artificial Sequence
  Description of Artificial Sequence: Synthetic peptide
  XENP022581 vhCDR2
WIDPELGDTEYAPKFQG

SEQ ID NO: 28608 - protein, 9 aa, Artificial Sequence
  Description of Artificial Sequence: Synthetic peptide
  XENP022581 vhCDR3
RGVRQALDY

SEQ ID NO: 28609 - protein, 214 aa, Artificial Sequence; identical to SEQ ID NO: 28529
  Description of Artificial Sequence: Synthetic polypeptide
  XENP022581 2A11_H1.141_L2.135_Fab Light Chain

SEQ ID NO: 28610 - protein, 107 aa, Artificial Sequence; identical to SEQ ID NO: 28530
  Description of Artificial Sequence: Synthetic polypeptide
  VL of XENP022581

SEQ ID NO: 28611 - protein, 11 aa, Artificial Sequence
  Description of Artificial Sequence: Synthetic peptide
  XENP022581 vlCDR1
QASQDIGNYLN

SEQ ID NO: 28612 - protein, 7 aa, Artificial Sequence
  Description of Artificial Sequence: Synthetic peptide
  XENP022581 vlCDR2
FTSYLHS

SEQ ID NO: 28613 - protein, 9 aa, Artificial Sequence
  Description of Artificial Sequence: Synthetic peptide
  XENP022581 vlCDR3
QEGNTLPYT

SEQ ID NO: 28614 - protein, 223 aa, Artificial Sequence; identical to SEQ ID NO: 27634
  Description of Artificial Sequence: Synthetic polypeptide
  XENP022609 2A11_H1.144_L2.136_Fab Heavy Chain

SEQ ID NO: 28615 - protein, 118 aa, Artificial Sequence; identical to SEQ ID NO: 22085
  Description of Artificial Sequence: Synthetic polypeptide
  VH of XENP022609

SEQ ID NO: 28616 - protein, 5 aa, Artificial Sequence
  Description of Artificial Sequence: Synthetic peptide
  XENP022609 vhCDR1
DYFMH

SEQ ID NO: 28617 - protein, 17 aa, Artificial Sequence
  Description of Artificial Sequence: Synthetic peptide
  XENP022609 vhCDR2
WIDPELGDTEYAPKFQG

SEQ ID NO: 28618 - protein, 9 aa, Artificial Sequence
  Description of Artificial Sequence: Synthetic peptide
  XENP022609 vhCDR3
RGVYQALDY

SEQ ID NO: 28619 - protein, 214 aa, Artificial Sequence
  Description of Artificial Sequence: Synthetic polypeptide
  XENP022609 2A11_H1.144_L2.136_Fab Light Chain
DIQMTQSPAFLSVTPGEKVTITCQASQDIGNYLNWFQQKPGKVPKLLIYYTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28620 - protein, 107 aa, Artificial Sequence
  Description of Artificial Sequence: Synthetic polypeptide
  VL of XENP022609
DIQMTQSPAFLSVTPGEKVTITCQASQDIGNYLNWFQQKPGKVPKLLIYYTSYLHSGVPSRFSGSGSGTDYTFTISSLEAEDAATYFCQEGNTLPYTFGGGTKVEIK

SEQ ID NO: 28621 - protein, 11 aa, Artificial Sequence
  Description of Artificial Sequence: Synthetic peptide
  XENP022609 vlCDR1
QASQDIGNYLN

SEQ ID NO: 28622 - protein, 7 aa, Artificial Sequence
  Description of Artificial Sequence: Synthetic peptide
  XENP022609 vlCDR2
YTSYLHS

SEQ ID NO: 28623 - protein, 9 aa, Artificial Sequence
  Description of Artificial Sequence: Synthetic peptide
  XENP022609 vlCDR3
QEGNTLPYT

SEQ ID NO: 28624 - protein, 223 aa, Artificial Sequence; identical to SEQ ID NO: 27734
  Description of Artificial Sequence: Synthetic polypeptide
  XENP022610 2A11_H1.125_L2.136_Fab Heavy Chain

SEQ ID NO: 28625 - protein, 118 aa, Artificial Sequence; identical to SEQ ID NO: 22065
  Description of Artificial Sequence: Synthetic polypeptide
  VH of XENP022610

SEQ ID NO: 28626 - protein, 5 aa, Artificial Sequence
  Description of Artificial Sequence: Synthetic peptide
  XENP022610 vhCDR1
HYFMH

SEQ ID NO: 28627 - protein, 17 aa, Artificial Sequence
  Description of Artificial Sequence: Synthetic peptide
  XENP022610 vhCDR2
WIDPYLGDTEYAPKFQG

SEQ ID NO: 28628 - protein, 9 aa, Artificial Sequence
  Description of Artificial Sequence: Synthetic peptide
  XENP022610 vhCDR3
RGVYQALDY

SEQ ID NO: 28629 - protein, 214 aa, Artificial Sequence; identical to SEQ ID NO: 28619
  Description of Artificial Sequence: Synthetic polypeptide
  XENP022610 2A11_H1.125_L2.136_Fab Light Chain

SEQ ID NO: 28630 - protein, 107 aa, Artificial Sequence; identical to SEQ ID NO: 28620
  Description of Artificial Sequence: Synthetic polypeptide
  VL of XENP022610

SEQ ID NO: 28631 - protein, 11 aa, Artificial Sequence
  Description of Artificial Sequence: Synthetic peptide
  XENP022610 vlCDR1
QASQDIGNYLN

SEQ ID NO: 28632 - protein, 7 aa, Artificial Sequence
  Description of Artificial Sequence: Synthetic peptide
  XENP022610 vlCDR2
YTSYLHS

SEQ ID NO: 28633 - protein, 9 aa, Artificial Sequence
  Description of Artificial Sequence: Synthetic peptide
  XENP022610 vlCDR3
QEGNTLPYT

SEQ ID NO: 28634 - protein, 223 aa, Artificial Sequence; identical to SEQ ID NO: 27604
  Description of Artificial Sequence: Synthetic polypeptide
  XENP022611 2A11_H1.141_L2.136_Fab Heavy Chain

SEQ ID NO: 28635 - protein, 118 aa, Artificial Sequence; identical to SEQ ID NO: 27605
  Description of Artificial Sequence: Synthetic polypeptide
  VH of XENP022611

SEQ ID NO: 28636 - protein, 5 aa, Artificial Sequence
  Description of Artificial Sequence: Synthetic peptide
  XENP022611 vhCDR1
DYFMH

SEQ ID NO: 28637 - protein, 17 aa, Artificial Sequence
  Description of Artificial Sequence: Synthetic peptide
  XENP022611 vhCDR2
WIDPELGDTEYAPKFQG

SEQ ID NO: 28638 - protein, 9 aa, Artificial Sequence
  Description of Artificial Sequence: Synthetic peptide
  XENP022611 vhCDR3
RGVRQALDY

SEQ ID NO: 28639 - protein, 214 aa, Artificial Sequence; identical to SEQ ID NO: 28619
  Description of Artificial Sequence: Synthetic polypeptide
  XENP022611 2A11_H1.141_L2.136_Fab Light Chain

SEQ ID NO: 28640 - protein, 107 aa, Artificial Sequence; identical to SEQ ID NO: 28620
  Description of Artificial Sequence: Synthetic polypeptide
  VL of XENP022611

SEQ ID NO: 28641 - protein, 11 aa, Artificial Sequence
  Description of Artificial Sequence: Synthetic peptide
  XENP022611 vlCDR1
QASQDIGNYLN

SEQ ID NO: 28642 - protein, 7 aa, Artificial Sequence
  Description of Artificial Sequence: Synthetic peptide
  XENP022611 vlCDR2
YTSYLHS

SEQ ID NO: 28643 - protein, 9 aa, Artificial Sequence
  Description of Artificial Sequence: Synthetic peptide
  XENP022611 vlCDR3
QEGNTLPYT

SEQ ID NO: 28644 - protein, 223 aa, Artificial Sequence; identical to SEQ ID NO: 27634
  Description of Artificial Sequence: Synthetic polypeptide
  XENP022612 2A11_H1.144_L2.137_Fab Heavy Chain

SEQ ID NO: 28645 - protein, 118 aa, Artificial Sequence; identical to SEQ ID NO: 22085
  Description of Artificial Sequence: Synthetic polypeptide
  VH of XENP022612

SEQ ID NO: 28646 - protein, 5 aa, Artificial Sequence
  Description of Artificial Sequence: Synthetic peptide
  XENP022612 vhCDR1
DYFMH

SEQ ID NO: 28647 - protein, 17 aa, Artificial Sequence
  Description of Artificial Sequence: Synthetic peptide
  XENP022612 vhCDR2
WIDPELGDTEYAPKFQG

SEQ ID NO: 28648 - protein, 9 aa, Artificial Sequence
  Description of Artificial Sequence: Synthetic peptide
  XENP022612 vhCDR3
RGVYQALDY

SEQ ID NO: 28649 - protein, 214 aa, Artificial Sequence; identical to SEQ ID NO: 22239
  Description of Artificial Sequence: Synthetic polypeptide
  XENP022612 2A11_H1.144_L2.137_Fab Light Chain

SEQ ID NO: 28650 - protein, 107 aa, Artificial Sequence; identical to SEQ ID NO: 22240
  Description of Artificial Sequence: Synthetic polypeptide
  VL of XENP022612

SEQ ID NO: 28651 - protein, 11 aa, Artificial Sequence
  Description of Artificial Sequence: Synthetic peptide
  XENP022612 vlCDR1
QASQDIGNYLN

SEQ ID NO: 28652 - protein, 7 aa, Artificial Sequence
  Description of Artificial Sequence: Synthetic peptide
  XENP022612 vlCDR2
FTSYLHS

SEQ ID NO: 28653 - protein, 9 aa, Artificial Sequence
  Description of Artificial Sequence: Synthetic peptide
  XENP022612 vlCDR3
QEGNTLPYT

SEQ ID NO: 28654 - protein, 223 aa, Artificial Sequence; identical to SEQ ID NO: 27734
  Description of Artificial Sequence: Synthetic polypeptide
  XENP022613 2A11_H1.125_L2.137_Fab Heavy Chain

SEQ ID NO: 28655 - protein, 118 aa, Artificial Sequence; identical to SEQ ID NO: 22065
  Description of Artificial Sequence: Synthetic polypeptide
  VH of XENP022613

SEQ ID NO: 28656 - protein, 5 aa, Artificial Sequence
  Description of Artificial Sequence: Synthetic peptide
  XENP022613 vhCDR1
HYFMH

SEQ ID NO: 28657 - protein, 17 aa, Artificial Sequence
  Description of Artificial Sequence: Synthetic peptide
  XENP022613 vhCDR2
WIDPYLGDTEYAPKFQG

SEQ ID NO: 28658 - protein, 9 aa, Artificial Sequence
  Description of Artificial Sequence: Synthetic peptide
  XENP022613 vhCDR3
RGVYQALDY

SEQ ID NO: 28659 - protein, 214 aa, Artificial Sequence; identical to SEQ ID NO: 22239
  Description of Artificial Sequence: Synthetic polypeptide
  XENP022613 2A11_H1.125_L2.137_Fab Light Chain

SEQ ID NO: 28660 - protein, 107 aa, Artificial Sequence; identical to SEQ ID NO: 22240
  Description of Artificial Sequence: Synthetic polypeptide
  VL of XENP022613

SEQ ID NO: 28661 - protein, 11 aa, Artificial Sequence
  Description of Artificial Sequence: Synthetic peptide
  XENP022613 vlCDR1
QASQDIGNYLN

SEQ ID NO: 28662 - protein, 7 aa, Artificial Sequence
  Description of Artificial Sequence: Synthetic peptide
  XENP022613 vlCDR2
FTSYLHS

SEQ ID NO: 28663 - protein, 9 aa, Artificial Sequence
  Description of Artificial Sequence: Synthetic peptide
  XENP022613 vlCDR3
QEGNTLPYT

SEQ ID NO: 28664 - protein, 223 aa, Artificial Sequence; identical to SEQ ID NO: 27604
  Description of Artificial Sequence: Synthetic polypeptide
  XENP022614 2A11_H1.141_L2.137_Fab Heavy Chain

SEQ ID NO: 28665 - protein, 118 aa, Artificial Sequence; identical to SEQ ID NO: 27605
  Description of Artificial Sequence: Synthetic polypeptide
  VH of XENP022614

SEQ ID NO: 28666 - protein, 5 aa, Artificial Sequence
  Description of Artificial Sequence: Synthetic peptide
  XENP022614 vhCDR1
DYFMH

SEQ ID NO: 28667 - protein, 17 aa, Artificial Sequence
  Description of Artificial Sequence: Synthetic peptide
  XENP022614 vhCDR2
WIDPELGDTEYAPKFQG

SEQ ID NO: 28668 - protein, 9 aa, Artificial Sequence
  Description of Artificial Sequence: Synthetic peptide
  XENP022614 vhCDR3
RGVRQALDY

SEQ ID NO: 28669 - protein, 214 aa, Artificial Sequence; identical to SEQ ID NO: 22239
  Description of Artificial Sequence: Synthetic polypeptide
  XENP022614 2A11_H1.141_L2.137_Fab Light Chain

SEQ ID NO: 28670 - protein, 107 aa, Artificial Sequence; identical to SEQ ID NO: 22240
  Description of Artificial Sequence: Synthetic polypeptide
  VL of XENP022614

SEQ ID NO: 28671 - protein, 11 aa, Artificial Sequence
  Description of Artificial Sequence: Synthetic peptide
  XENP022614 vlCDR1
QASQDIGNYLN

SEQ ID NO: 28672 - protein, 7 aa, Artificial Sequence
  Description of Artificial Sequence: Synthetic peptide
  XENP022614 vlCDR2
FTSYLHS

SEQ ID NO: 28673 - protein, 9 aa, Artificial Sequence
  Description of Artificial Sequence: Synthetic peptide
  XENP022614 vlCDR3
QEGNTLPYT

SEQ ID NO: 28674 - protein, 223 aa, Artificial Sequence; identical to SEQ ID NO: 27634
  Description of Artificial Sequence: Synthetic polypeptide
  XENP022615 2A11_H1.144_L2.126_Fab Heavy Chain

SEQ ID NO: 28675 - protein, 118 aa, Artificial Sequence; identical to SEQ ID NO: 22085
  Description of Artificial Sequence: Synthetic polypeptide
  VH of XENP022615

SEQ ID NO: 28676 - protein, 5 aa, Artificial Sequence
  Description of Artificial Sequence: Synthetic peptide
  XENP022615 vhCDR1
DYFMH

SEQ ID NO: 28677 - protein, 17 aa, Artificial Sequence
  Description of Artificial Sequence: Synthetic peptide
  XENP022615 vhCDR2
WIDPELGDTEYAPKFQG

SEQ ID NO: 28678 - protein, 9 aa, Artificial Sequence
  Description of Artificial Sequence: Synthetic peptide
  XENP022615 vhCDR3
RGVYQALDY

SEQ ID NO: 28679 - protein, 214 aa, Artificial Sequence; identical to SEQ ID NO: 22259
  Description of Artificial Sequence: Synthetic polypeptide
  XENP022615 2A11_H1.144_L2.126_Fab Light Chain

SEQ ID NO: 28680 - protein, 107 aa, Artificial Sequence; identical to SEQ ID NO: 22260
  Description of Artificial Sequence: Synthetic polypeptide
  VL of XENP022615

SEQ ID NO: 28681 - protein, 11 aa, Artificial Sequence
  Description of Artificial Sequence: Synthetic peptide
  XENP022615 vlCDR1
QASQDIGNYLN

SEQ ID NO: 28682 - protein, 7 aa, Artificial Sequence
  Description of Artificial Sequence: Synthetic peptide
  XENP022615 vlCDR2
FTSYLHS

SEQ ID NO: 28683 - protein, 9 aa, Artificial Sequence
  Description of Artificial Sequence: Synthetic peptide
  XENP022615 vlCDR3
QEGNTLPYT

SEQ ID NO: 28684 - protein, 223 aa, Artificial Sequence; identical to SEQ ID NO: 27634
  Description of Artificial Sequence: Synthetic polypeptide
  XENP022616 2A11_H1.144_L2.91_Fab Heavy Chain

SEQ ID NO: 28685 - protein, 118 aa, Artificial Sequence; identical to SEQ ID NO: 22085
  Description of Artificial Sequence: Synthetic polypeptide
  VH of XENP022616

SEQ ID NO: 28686 - protein, 5 aa, Artificial Sequence
  Description of Artificial Sequence: Synthetic peptide
  XENP022616 vhCDR1
DYFMH

SEQ ID NO: 28687 - protein, 17 aa, Artificial Sequence
  Description of Artificial Sequence: Synthetic peptide
  XENP022616 vhCDR2
WIDPELGDTEYAPKFQG

SEQ ID NO: 28688 - protein, 9 aa, Artificial Sequence
  Description of Artificial Sequence: Synthetic peptide
  XENP022616 vhCDR3
RGVYQALDY

SEQ ID NO: 28689 - protein, 321 aa, Artificial Sequence
  Description of Artificial Sequence: Synthetic polypeptide
  XENP022616 2A11_H1.144_L2.91_Fab Light Chain
DIQMTQSPAFLSVTPGEKVTITCQASQDIGNYLNWFQQKPGQTVKLLIYYTSRLHSGVPSRFSGSGSGTDYTFTISSLEAEDAATYFCQQGNTLPYTFGGGTKVEIKDIQMTQSPAFLSVTPGEKVTITCQASQDIGNYLNWYQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28690 - protein, 214 aa, Artificial Sequence
  Description of Artificial Sequence: Synthetic polypeptide
  VL of XENP022616
DIQMTQSPAFLSVTPGEKVTITCQASQDIGNYLNWFQQKPGQTVKLLIYYTSRLHSGVPSRFSGSGSGTDYTFTISSLEAEDAATYFCQQGNTLPYTFGGGTKVEIKDIQMTQSPAFLSVTPGEKVTITCQASQDIGNYLNWYQQKPDQTVKLLIYYTSRLHSGVPSRFSGSGSGTDYTFTISSLEAEDAATYFCQQGNTLPYTFGGGTKVEIK

SEQ ID NO: 28691 - protein, 11 aa, Artificial Sequence
  Description of Artificial Sequence: Synthetic peptide
  XENP022616 vlCDR1
QASQDIGNYLN

SEQ ID NO: 28692 - protein, 7 aa, Artificial Sequence
  Description of Artificial Sequence: Synthetic peptide
  XENP022616 vlCDR2
YTSRLHS

SEQ ID NO: 28693 - protein, 9 aa, Artificial Sequence
  Description of Artificial Sequence: Synthetic peptide
  XENP022616 vlCDR3
QQGNTLPYT

SEQ ID NO: 28694 - protein, 223 aa, Artificial Sequence; identical to SEQ ID NO: 27634
  Description of Artificial Sequence: Synthetic polypeptide
  XENP022617 2A11_H1.144_L2.93_Fab Heavy Chain

SEQ ID NO: 28695 - protein, 118 aa, Artificial Sequence; identical to SEQ ID NO: 22085
  Description of Artificial Sequence: Synthetic polypeptide
  VH of XENP022617

SEQ ID NO: 28696 - protein, 5 aa, Artificial Sequence
  Description of Artificial Sequence: Synthetic peptide
  XENP022617 vhCDR1
DYFMH

SEQ ID NO: 28697 - protein, 17 aa, Artificial Sequence
  Description of Artificial Sequence: Synthetic peptide
  XENP022617 vhCDR2
WIDPELGDTEYAPKFQG

SEQ ID NO: 28698 - protein, 9 aa, Artificial Sequence
  Description of Artificial Sequence: Synthetic peptide
  XENP022617 vhCDR3
RGVYQALDY

SEQ ID NO: 28699 - protein, 535 aa, Artificial Sequence
  Description of Artificial Sequence: Synthetic polypeptide
  XENP022617 2A11_H1.144_L2.93_Fab Light Chain
DIQMTQSPAFLSVTPGEKVTITCQASQDIGNYLNWFQQKPDQTPKLLIYYTSRLHSGVPSRFSGSGSGTDYTFTISSLEAEDAATYFCQQGNTLPYTFGGGTKVEIKDIQMTQSPAFLSVTPGEKVTITCQASQDIGNYLNWFQQKPDQSVKLLIYYTSRLHSGVPSRFSGSGSGTDYTFTISSLEAEDAATYFCQQGNTLPYTFGGGTKVEIKDIQMTQSPAFLSVTPGEKVTITCQASQDIGNYLNWFQQKPGQTVKLLIYYTSRLHSGVPSRFSGSGSGTDYTFTISSLEAEDAATYFCQQGNTLPYTFGGGTKVEIKDIQMTQSPAFLSVTPGEKVTITCQASQDIGNYLNWYQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28700 - protein, 428 aa, Artificial Sequence
  Description of Artificial Sequence: Synthetic polypeptide
  VL of XENP022617
DIQMTQSPAFLSVTPGEKVTITCQASQDIGNYLNWFQQKPDQTPKLLIYYTSRLHSGVPSRFSGSGSGTDYTFTISSLEAEDAATYFCQQGNTLPYTFGGGTKVEIKDIQMTQSPAFLSVTPGEKVTITCQASQDIGNYLNWFQQKPDQSVKLLIYYTSRLHSGVPSRFSGSGSGTDYTFTISSLEAEDAATYFCQQGNTLPYTFGGGTKVEIKDIQMTQSPAFLSVTPGEKVTITCQASQDIGNYLNWFQQKPGQTVKLLIYYTSRLHSGVPSRFSGSGSGTDYTFTISSLEAEDAATYFCQQGNTLPYTFGGGTKVEIKDIQMTQSPAFLSVTPGEKVTITCQASQDIGNYLNWYQQKPDQTVKLLIYYTSRLHSGVPSRFSGSGSGTDYTFTISSLEAEDAATYFCQQGNTLPYTFGGGTKVEIK

SEQ ID NO: 28701 - protein, 11 aa, Artificial Sequence
  Description of Artificial Sequence: Synthetic peptide
  XENP022617 vlCDR1
QASQDIGNYLN

SEQ ID NO: 28702 - protein, 7 aa, Artificial Sequence
  Description of Artificial Sequence: Synthetic peptide
  XENP022617 vlCDR2
YTSRLHS

SEQ ID NO: 28703 - protein, 9 aa, Artificial Sequence
  Description of Artificial Sequence: Synthetic peptide
  XENP022617 vlCDR3
QQGNTLPYT

SEQ ID NO: 28704 - protein, 223 aa, Artificial Sequence; identical to SEQ ID NO: 27634
  Description of Artificial Sequence: Synthetic polypeptide
  XENP022618 2A11_H1.144_L2.122_Fab Heavy Chain

SEQ ID NO: 28705 - protein, 118 aa, Artificial Sequence; identical to SEQ ID NO: 22085
  Description of Artificial Sequence: Synthetic polypeptide
  VH of XENP022618

SEQ ID NO: 28706 - protein, 5 aa, Artificial Sequence
  Description of Artificial Sequence: Synthetic peptide
  XENP022618 vhCDR1
DYFMH

SEQ ID NO: 28707 - protein, 17 aa, Artificial Sequence
  Description of Artificial Sequence: Synthetic peptide
  XENP022618 vhCDR2
WIDPELGDTEYAPKFQG

SEQ ID NO: 28708 - protein, 9 aa, Artificial Sequence
  Description of Artificial Sequence: Synthetic peptide
  XENP022618 vhCDR3
RGVYQALDY

SEQ ID NO: 28709 - protein, 214 aa, Artificial Sequence; identical to SEQ ID NO: 24690
  Description of Artificial Sequence: Synthetic polypeptide
  XENP022618 2A11_H1.144_L2.122_Fab Light Chain

SEQ ID NO: 28710 - protein, 107 aa, Artificial Sequence; identical to SEQ ID NO: 24691
  Description of Artificial Sequence: Synthetic polypeptide
  VL of XENP022618

SEQ ID NO: 28711 - protein, 11 aa, Artificial Sequence
  Description of Artificial Sequence: Synthetic peptide
  XENP022618 vlCDR1
QASQDIGNYLN

SEQ ID NO: 28712 - protein, 7 aa, Artificial Sequence
  Description of Artificial Sequence: Synthetic peptide
  XENP022618 vlCDR2
YTSRLHS

SEQ ID NO: 28713 - protein, 9 aa, Artificial Sequence
  Description of Artificial Sequence: Synthetic peptide
  XENP022618 vlCDR3
QQGNTLPYT

SEQ ID NO: 28714 - protein, 223 aa, Artificial Sequence; identical to SEQ ID NO: 27634
  Description of Artificial Sequence: Synthetic polypeptide
  XENP022619 2A11_H1.144_L2.124_Fab Heavy Chain

SEQ ID NO: 28715 - protein, 118 aa, Artificial Sequence; identical to SEQ ID NO: 22085
  Description of Artificial Sequence: Synthetic polypeptide
  VH of XENP022619

SEQ ID NO: 28716 - protein, 5 aa, Artificial Sequence
  Description of Artificial Sequence: Synthetic peptide
  XENP022619 vhCDR1
DYFMH

SEQ ID NO: 28717 - protein, 17 aa, Artificial Sequence
  Description of Artificial Sequence: Synthetic peptide
  XENP022619 vhCDR2
WIDPELGDTEYAPKFQG

SEQ ID NO: 28718 - protein, 9 aa, Artificial Sequence
  Description of Artificial Sequence: Synthetic peptide
  XENP022619 vhCDR3
RGVYQALDY

SEQ ID NO: 28719 - protein, 214 aa, Artificial Sequence; identical to SEQ ID NO: 24730
  Description of Artificial Sequence: Synthetic polypeptide
  XENP022619 2A11_H1.144_L2.124_Fab Light Chain

SEQ ID NO: 28720 - protein, 107 aa, Artificial Sequence; identical to SEQ ID NO: 24731
  Description of Artificial Sequence: Synthetic polypeptide
  VL of XENP022619

SEQ ID NO: 28721 - protein, 11 aa, Artificial Sequence
  Description of Artificial Sequence: Synthetic peptide
  XENP022619 vlCDR1
QASQDIGNYLN

SEQ ID NO: 28722 - protein, 7 aa, Artificial Sequence
  Description of Artificial Sequence: Synthetic peptide
  XENP022619 vlCDR2
YTSRLHS

SEQ ID NO: 28723 - protein, 9 aa, Artificial Sequence
  Description of Artificial Sequence: Synthetic peptide
  XENP022619 vlCDR3
QQGNTLPYT

SEQ ID NO: 28724 - protein, 223 aa, Artificial Sequence; identical to SEQ ID NO: 27734
  Description of Artificial Sequence: Synthetic polypeptide
  XENP022620 2A11_H1.125_L2.126_Fab Heavy Chain

SEQ ID NO: 28725 - protein, 118 aa, Artificial Sequence; identical to SEQ ID NO: 22065
  Description of Artificial Sequence: Synthetic polypeptide
  VH of XENP022620

SEQ ID NO: 28726 - protein, 5 aa, Artificial Sequence
  Description of Artificial Sequence: Synthetic peptide
  XENP022620 vhCDR1
HYFMH

SEQ ID NO: 28727 - protein, 17 aa, Artificial Sequence
  Description of Artificial Sequence: Synthetic peptide
  XENP022620 vhCDR2
WIDPYLGDTEYAPKFQG

SEQ ID NO: 28728 - protein, 9 aa, Artificial Sequence
  Description of Artificial Sequence: Synthetic peptide
  XENP022620 vhCDR3
RGVYQALDY

SEQ ID NO: 28729 - protein, 214 aa, Artificial Sequence; identical to SEQ ID NO: 22259
  Description of Artificial Sequence: Synthetic polypeptide
  XENP022620 2A11_H1.125_L2.126_Fab Light Chain

SEQ ID NO: 28730 - protein, 107 aa, Artificial Sequence; identical to SEQ ID NO: 22260
  Description of Artificial Sequence: Synthetic polypeptide
  VL of XENP022620

SEQ ID NO: 28731 - protein, 11 aa, Artificial Sequence
  Description of Artificial Sequence: Synthetic peptide
  XENP022620 vlCDR1
QASQDIGNYLN

SEQ ID NO: 28732 - protein, 7 aa, Artificial Sequence
  Description of Artificial Sequence: Synthetic peptide
  XENP022620 vlCDR2
FTSYLHS

SEQ ID NO: 28733 - protein, 9 aa, Artificial Sequence
  Description of Artificial Sequence: Synthetic peptide
  XENP022620 vlCDR3
QEGNTLPYT

SEQ ID NO: 28734 - protein, 223 aa, Artificial Sequence; identical to SEQ ID NO: 27734
  Description of Artificial Sequence: Synthetic polypeptide
  XENP022621 2A11_H1.125_L2.91_Fab Heavy Chain

SEQ ID NO: 28735 - protein, 118 aa, Artificial Sequence; identical to SEQ ID NO: 22065
  Description of Artificial Sequence: Synthetic polypeptide
  VH of XENP022621

SEQ ID NO: 28736 - protein, 5 aa, Artificial Sequence
  Description of Artificial Sequence: Synthetic peptide
  XENP022621 vhCDR1
HYFMH

SEQ ID NO: 28737 - protein, 17 aa, Artificial Sequence
  Description of Artificial Sequence: Synthetic peptide
  XENP022621 vhCDR2
WIDPYLGDTEYAPKFQG

SEQ ID NO: 28738 - protein, 9 aa, Artificial Sequence
  Description of Artificial Sequence: Synthetic peptide
  XENP022621 vhCDR3
RGVYQALDY

SEQ ID NO: 28739 - protein, 321 aa, Artificial Sequence; identical to SEQ ID NO: 28689
  Description of Artificial Sequence: Synthetic polypeptide
  XENP022621 2A11_H1.125_L2.91_Fab Light Chain

SEQ ID NO: 28740 - protein, 214 aa, Artificial Sequence; identical to SEQ ID NO: 28690
  Description of Artificial Sequence: Synthetic polypeptide
  VL of XENP022621

SEQ ID NO: 28741 - protein, 11 aa, Artificial Sequence
  Description of Artificial Sequence: Synthetic peptide
  XENP022621 vlCDR1
QASQDIGNYLN

SEQ ID NO: 28742 - protein, 7 aa, Artificial Sequence
  Description of Artificial Sequence: Synthetic peptide
  XENP022621 vlCDR2
YTSRLHS

SEQ ID NO: 28743 - protein, 9 aa, Artificial Sequence
  Description of Artificial Sequence: Synthetic peptide
  XENP022621 vlCDR3
QQGNTLPYT

SEQ ID NO: 28744 - protein, 223 aa, Artificial Sequence; identical to SEQ ID NO: 27734
  Description of Artificial Sequence: Synthetic polypeptide
  XENP022622 2A11_H1.125_L2.93_Fab Heavy Chain

SEQ ID NO: 28745 - protein, 118 aa, Artificial Sequence; identical to SEQ ID NO: 22065
  Description of Artificial Sequence: Synthetic polypeptide
  VH of XENP022622

SEQ ID NO: 28746 - protein, 5 aa, Artificial Sequence
  Description of Artificial Sequence: Synthetic peptide
  XENP022622 vhCDR1
HYFMH

SEQ ID NO: 28747 - protein, 17 aa, Artificial Sequence
  Description of Artificial Sequence: Synthetic peptide
  XENP022622 vhCDR2
WIDPYLGDTEYAPKFQG

SEQ ID NO: 28748 - protein, 9 aa, Artificial Sequence
  Description of Artificial Sequence: Synthetic peptide
  XENP022622 vhCDR3
RGVYQALDY

SEQ ID NO: 28749 - protein, 535 aa, Artificial Sequence; identical to SEQ ID NO: 28699
  Description of Artificial Sequence: Synthetic polypeptide
  XENP022622 2A11_H1.125_L2.93_Fab Light Chain

SEQ ID NO: 28750 - protein, 428 aa, Artificial Sequence; identical to SEQ ID NO: 28700
  Description of Artificial Sequence: Synthetic polypeptide
  VL of XENP022622

SEQ ID NO: 28751 - protein, 11 aa, Artificial Sequence
  Description of Artificial Sequence: Synthetic peptide
  XENP022622 vlCDR1
QASQDIGNYLN

SEQ ID NO: 28752 - protein, 7 aa, Artificial Sequence
  Description of Artificial Sequence: Synthetic peptide
  XENP022622 vlCDR2
YTSRLHS

SEQ ID NO: 28753 - protein, 9 aa, Artificial Sequence
  Description of Artificial Sequence: Synthetic peptide
  XENP022622 vlCDR3
QQGNTLPYT

SEQ ID NO: 28754 - protein, 223 aa, Artificial Sequence; identical to SEQ ID NO: 27734
  Description of Artificial Sequence: Synthetic polypeptide
  XENP022623 2A11_H1.125_L2.122_Fab Heavy Chain

SEQ ID NO: 28755 - protein, 118 aa, Artificial Sequence; identical to SEQ ID NO: 22065
  Description of Artificial Sequence: Synthetic polypeptide
  VH of XENP022623

SEQ ID NO: 28756 - protein, 5 aa, Artificial Sequence
  Description of Artificial Sequence: Synthetic peptide
  XENP022623 vhCDR1
HYFMH

SEQ ID NO: 28757 - protein, 17 aa, Artificial Sequence
  Description of Artificial Sequence: Synthetic peptide
  XENP022623 vhCDR2
WIDPYLGDTEYAPKFQG

SEQ ID NO: 28758 - protein, 9 aa, Artificial Sequence
  Description of Artificial Sequence: Synthetic peptide
  XENP022623 vhCDR3
RGVYQALDY

SEQ ID NO: 28759 - protein, 214 aa, Artificial Sequence; identical to SEQ ID NO: 24690
  Description of Artificial Sequence: Synthetic polypeptide
  XENP022623 2A11_H1.125_L2.122_Fab Light Chain

SEQ ID NO: 28760 - protein, 107 aa, Artificial Sequence; identical to SEQ ID NO: 24691
  Description of Artificial Sequence: Synthetic polypeptide
  VL of XENP022623

SEQ ID NO: 28761 - protein, 11 aa, Artificial Sequence
  Description of Artificial Sequence: Synthetic peptide
  XENP022623 vlCDR1
QASQDIGNYLN

SEQ ID NO: 28762 - protein, 7 aa, Artificial Sequence
  Description of Artificial Sequence: Synthetic peptide
  XENP022623 vlCDR2
YTSRLHS

SEQ ID NO: 28763 - protein, 9 aa, Artificial Sequence
  Description of Artificial Sequence: Synthetic peptide
  XENP022623 vlCDR3
QQGNTLPYT

SEQ ID NO: 28764 - protein, 223 aa, Artificial Sequence; identical to SEQ ID NO: 27734
  Description of Artificial Sequence: Synthetic polypeptide
  XENP022624 2A11_H1.125_L2.124_Fab Heavy Chain

SEQ ID NO: 28765 - protein, 118 aa, Artificial Sequence; identical to SEQ ID NO: 22065
  Description of Artificial Sequence: Synthetic polypeptide
  VH of XENP022624

SEQ ID NO: 28766 - protein, 5 aa, Artificial Sequence
  Description of Artificial Sequence: Synthetic peptide
  XENP022624 vhCDR1
HYFMH

SEQ ID NO: 28767 - protein, 17 aa, Artificial Sequence
  Description of Artificial Sequence: Synthetic peptide
  XENP022624 vhCDR2
WIDPYLGDTEYAPKFQG

SEQ ID NO: 28768 - protein, 9 aa, Artificial Sequence
  Description of Artificial Sequence: Synthetic peptide
  XENP022624 vhCDR3
RGVYQALDY

SEQ ID NO: 28769 - protein, 214 aa, Artificial Sequence; identical to SEQ ID NO: 24730
  Description of Artificial Sequence: Synthetic polypeptide
  XENP022624 2A11_H1.125_L2.124_Fab Light Chain

SEQ ID NO: 28770 - protein, 107 aa, Artificial Sequence; identical to SEQ ID NO: 24731
  Description of Artificial Sequence: Synthetic polypeptide
  VL of XENP022624

SEQ ID NO: 28771 - protein, 11 aa, Artificial Sequence
  Description of Artificial Sequence: Synthetic peptide
  XENP022624 vlCDR1
QASQDIGNYLN

SEQ ID NO: 28772 - protein, 7 aa, Artificial Sequence
  Description of Artificial Sequence: Synthetic peptide
  XENP022624 vlCDR2
YTSRLHS

SEQ ID NO: 28773 - protein, 9 aa, Artificial Sequence
  Description of Artificial Sequence: Synthetic peptide
  XENP022624 vlCDR3
QQGNTLPYT

SEQ ID NO: 28774 - protein, 223 aa, Artificial Sequence; identical to SEQ ID NO: 27634
  Description of Artificial Sequence: Synthetic polypeptide
  XENP022652 2A11_H1.144_L2.138_Fab Heavy Chain

SEQ ID NO: 28775 - protein, 118 aa, Artificial Sequence; identical to SEQ ID NO: 22085
  Description of Artificial Sequence: Synthetic polypeptide
  VH of XENP022652

SEQ ID NO: 28776 - protein, 5 aa, Artificial Sequence
  Description of Artificial Sequence: Synthetic peptide
  XENP022652 vhCDR1
DYFMH

SEQ ID NO: 28777 - protein, 17 aa, Artificial Sequence
  Description of Artificial Sequence: Synthetic peptide
  XENP022652 vhCDR2
WIDPELGDTEYAPKFQG

SEQ ID NO: 28778 - protein, 9 aa, Artificial Sequence
  Description of Artificial Sequence: Synthetic peptide
  XENP022652 vhCDR3
RGVYQALDY

SEQ ID NO: 28779 - protein, 214 aa, Artificial Sequence
  Description of Artificial Sequence: Synthetic polypeptide
  XENP022652 2A11_H1.144_L2.138_Fab Light Chain
DIQMTQSPAFLSVTPGEKVTITCQASQDIGNYLNWFQQKPGQTVKLLIYYTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28780 - protein, 107 aa, Artificial Sequence
  Description of Artificial Sequence: Synthetic polypeptide
  VL of XENP022652
DIQMTQSPAFLSVTPGEKVTITCQASQDIGNYLNWFQQKPGQTVKLLIYYTSYLHSGVPSRFSGSGSGTDYTFTISSLEAEDAATYFCQQGNTLPYTFGGGTKVEIK

SEQ ID NO: 28781 - protein, 11 aa, Artificial Sequence
  Description of Artificial Sequence: Synthetic peptide
  XENP022652 vlCDR1
QASQDIGNYLN

SEQ ID NO: 28782 - protein, 7 aa, Artificial Sequence
  Description of Artificial Sequence: Synthetic peptide
  XENP022652 vlCDR2
YTSYLHS

SEQ ID NO: 28783 - protein, 9 aa, Artificial Sequence
  Description of Artificial Sequence: Synthetic peptide
  XENP022652 vlCDR3
QQGNTLPYT

SEQ ID NO: 28784 - protein, 223 aa, Artificial Sequence; identical to SEQ ID NO: 27634
  Description of Artificial Sequence: Synthetic polypeptide
  XENP022653 2A11_H1.144_L2.139_Fab Heavy Chain

SEQ ID NO: 28785 - protein, 118 aa, Artificial Sequence; identical to SEQ ID NO: 22085
  Description of Artificial Sequence: Synthetic polypeptide
  VH of XENP022653

SEQ ID NO: 28786 - protein, 5 aa, Artificial Sequence
  Description of Artificial Sequence: Synthetic peptide
  XENP022653 vhCDR1
DYFMH

SEQ ID NO: 28787 - protein, 17 aa, Artificial Sequence
  Description of Artificial Sequence: Synthetic peptide
  XENP022653 vhCDR2
WIDPELGDTEYAPKFQG

SEQ ID NO: 28788 - protein, 9 aa, Artificial Sequence
  Description of Artificial Sequence: Synthetic peptide
  XENP022653 vhCDR3
RGVYQALDY

SEQ ID NO: 28789 - protein, 214 aa, Artificial Sequence
  Description of Artificial Sequence: Synthetic polypeptide
  XENP022653 2A11_H1.144_L2.139_Fab Light Chain
DIQMTQSPAFLSVTPGEKVTITCQASQDIGNYLNWFQQKPDQTPKLLIYYTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28790 - protein, 107 aa, Artificial Sequence
  Description of Artificial Sequence: Synthetic polypeptide
  VL of XENP022653
DIQMTQSPAFLSVTPGEKVTITCQASQDIGNYLNWFQQKPDQTPKLLIYYTSYLHSGVPSRFSGSGSGTDYTFTISSLEAEDAATYFCQQGNTLPYTFGGGTKVEIK

SEQ ID NO: 28791 - protein, 11 aa, Artificial Sequence
  Description of Artificial Sequence: Synthetic peptide
  XENP022653 vlCDR1
QASQDIGNYLN

SEQ ID NO: 28792 - protein, 7 aa, Artificial Sequence
  Description of Artificial Sequence: Synthetic peptide
  XENP022653 vlCDR2
YTSYLHS

SEQ ID NO: 28793 - protein, 9 aa, Artificial Sequence
  Description of Artificial Sequence: Synthetic peptide
  XENP022653 vlCDR3
QQGNTLPYT

SEQ ID NO: 28794 - protein, 223 aa, Artificial Sequence; identical to SEQ ID NO: 27634
  Description of Artificial Sequence: Synthetic polypeptide
  XENP022654 2A11_H1.144_L2.140_Fab Heavy Chain

SEQ ID NO: 28795 - protein, 118 aa, Artificial Sequence; identical to SEQ ID NO: 22085
  Description of Artificial Sequence: Synthetic polypeptide
  VH of XENP022654

SEQ ID NO: 28796 - protein, 5 aa, Artificial Sequence
  Description of Artificial Sequence: Synthetic peptide
  XENP022654 vhCDR1
DYFMH

SEQ ID NO: 28797 - protein, 17 aa, Artificial Sequence
  Description of Artificial Sequence: Synthetic peptide
  XENP022654 vhCDR2
WIDPELGDTEYAPKFQG

SEQ ID NO: 28798 - protein, 9 aa, Artificial Sequence
  Description of Artificial Sequence: Synthetic peptide
  XENP022654 vhCDR3
RGVYQALDY

SEQ ID NO: 28799 - protein, 214 aa, Artificial Sequence
  Description of Artificial Sequence: Synthetic polypeptide
  XENP022654 2A11_H1.144_L2.140_Fab Light Chain
DIQMTQSPAFLSVTPGEKVTITCQASQDIGNYLNWFQQKPGQTPKLLIYYTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28800 - protein, 107 aa, Artificial Sequence
  Description of Artificial Sequence: Synthetic polypeptide
  VL of XENP022654
DIQMTQSPAFLSVTPGEKVTITCQASQDIGNYLNWFQQKPGQTPKLLIYYTSYLHSGVPSRFSGSGSGTDYTFTISSLEAEDAATYFCQQGNTLPYTFGGGTKVEIK

SEQ ID NO: 28801 - protein, 11 aa, Artificial Sequence
  Description of Artificial Sequence: Synthetic peptide
  XENP022654 vlCDR1
QASQDIGNYLN

SEQ ID NO: 28802 - protein, 7 aa, Artificial Sequence
  Description of Artificial Sequence: Synthetic peptide
  XENP022654 vlCDR2
YTSYLHS

SEQ ID NO: 28803 - protein, 9 aa, Artificial Sequence
  Description of Artificial Sequence: Synthetic peptide
  XENP022654 vlCDR3
QQGNTLPYT

SEQ ID NO: 28804 - protein, 223 aa, Artificial Sequence; identical to SEQ ID NO: 27634
  Description of Artificial Sequence: Synthetic polypeptide
  XENP022655 2A11_H1.144_L2.141_Fab Heavy Chain

SEQ ID NO: 28805 - protein, 118 aa, Artificial Sequence; identical to SEQ ID NO: 22085
  Description of Artificial Sequence: Synthetic polypeptide
  VH of XENP022655

SEQ ID NO: 28806 - protein, 5 aa, Artificial Sequence
  Description of Artificial Sequence: Synthetic peptide
  XENP022655 vhCDR1
DYFMH

SEQ ID NO: 28807 - protein, 17 aa, Artificial Sequence
  Description of Artificial Sequence: Synthetic peptide
  XENP022655 vhCDR2
WIDPELGDTEYAPKFQG

SEQ ID NO: 28808 - protein, 9 aa, Artificial Sequence
  Description of Artificial Sequence: Synthetic peptide
  XENP022655 vhCDR3
RGVYQALDY

SEQ ID NO: 28809 - protein, 214 aa, Artificial Sequence
  Description of Artificial Sequence: Synthetic polypeptide
  XENP022655 2A11_H1.144_L2.141_Fab Light Chain
DIQMTQSPAFLSVTPGEKVTITCQASQDIGNYLNWFQQKPGKVPKLLIYYTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28810 - protein, 107 aa, Artificial Sequence
  Description of Artificial Sequence: Synthetic polypeptide
  VL of XENP022655
DIQMTQSPAFLSVTPGEKVTITCQASQDIGNYLNWFQQKPGKVPKLLIYYTSYLHSGVPSRFSGSGSGTDYTFTISSLEAEDAATYFCQQGNTLPYTFGGGTKVEIK

SEQ ID NO: 28811 - protein, 11 aa, Artificial Sequence
  Description of Artificial Sequence: Synthetic peptide
  XENP022655 vlCDR1
QASQDIGNYLN

SEQ ID NO: 28812 - protein, 7 aa, Artificial Sequence
  Description of Artificial Sequence: Synthetic peptide
  XENP022655 vlCDR2
YTSYLHS

SEQ ID NO: 28813 - protein, 9 aa, Artificial Sequence
  Description of Artificial Sequence: Synthetic peptide
  XENP022655 vlCDR3
QQGNTLPYT

SEQ ID NO: 28814 - protein, 223 aa, Artificial Sequence; identical to SEQ ID NO: 27634
  Description of Artificial Sequence: Synthetic polypeptide
  XENP022656 2A11_H1.144_L2.142_Fab Heavy Chain

SEQ ID NO: 28815 - protein, 118 aa, Artificial Sequence; identical to SEQ ID NO: 22085
  Description of Artificial Sequence: Synthetic polypeptide
  VH of XENP022656

SEQ ID NO: 28816 - protein, 5 aa, Artificial Sequence
  Description of Artificial Sequence: Synthetic peptide
  XENP022656 vhCDR1
DYFMH

SEQ ID NO: 28817 - protein, 17 aa, Artificial Sequence
  Description of Artificial Sequence: Synthetic peptide
  XENP022656 vhCDR2
WIDPELGDTEYAPKFQG

SEQ ID NO: 28818 - protein, 9 aa, Artificial Sequence
  Description of Artificial Sequence: Synthetic peptide
  XENP022656 vhCDR3
RGVYQALDY

SEQ ID NO: 28819 - protein, 214 aa, Artificial Sequence; identical to SEQ ID NO: 22279
  Description of Artificial Sequence: Synthetic polypeptide
  XENP022656 2A11_H1.144_L2.142_Fab Light Chain

SEQ ID NO: 28820 - protein, 107 aa, Artificial Sequence; identical to SEQ ID NO: 22280
  Description of Artificial Sequence: Synthetic polypeptide
  VL of XENP022656

SEQ ID NO: 28821 - protein, 11 aa, Artificial Sequence
  Description of Artificial Sequence: Synthetic peptide
  XENP022656 vlCDR1
QASQDIGNYLN

SEQ ID NO: 28822 - protein, 7 aa, Artificial Sequence
  Description of Artificial Sequence: Synthetic peptide
  XENP022656 vlCDR2
FTSYLHS

SEQ ID NO: 28823 - protein, 9 aa, Artificial Sequence
  Description of Artificial Sequence: Synthetic peptide
  XENP022656 vlCDR3
QQGNTLPYT

SEQ ID NO: 28824 - protein, 223 aa, Artificial Sequence; identical to SEQ ID NO: 27634
  Description of Artificial Sequence: Synthetic polypeptide
  XENP022657 2A11_H1.144_L2.143_Fab Heavy Chain

SEQ ID NO: 28825 - protein, 118 aa, Artificial Sequence; identical to SEQ ID NO: 22085
  Description of Artificial Sequence: Synthetic polypeptide
  VH of XENP022657

SEQ ID NO: 28826 - protein, 5 aa, Artificial Sequence
  Description of Artificial Sequence: Synthetic peptide
  XENP022657 vhCDR1
DYFMH

SEQ ID NO: 28827 - protein, 17 aa, Artificial Sequence
  Description of Artificial Sequence: Synthetic peptide
  XENP022657 vhCDR2
WIDPELGDTEYAPKFQG

SEQ ID NO: 28828 - protein, 9 aa, Artificial Sequence
  Description of Artificial Sequence: Synthetic peptide
  XENP022657 vhCDR3
RGVYQALDY

SEQ ID NO: 28829 - protein, 214 aa, Artificial Sequence
  Description of Artificial Sequence: Synthetic polypeptide
  XENP022657 2A11_H1.144_L2.143_Fab Light Chain
DIQMTQSPAFLSVTPGEKVTITCQASQDIGNYLNWFQQKPDQTPKLLIYFTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28830 - protein, 107 aa, Artificial Sequence
  Description of Artificial Sequence: Synthetic polypeptide
  VL of XENP022657
DIQMTQSPAFLSVTPGEKVTITCQASQDIGNYLNWFQQKPDQTPKLLIYFTSYLHSGVPSRFSGSGSGTDYTFTISSLEAEDAATYFCQQGNTLPYTFGGGTKVEIK

SEQ ID NO: 28831 - protein, 11 aa, Artificial Sequence
  Description of Artificial Sequence: Synthetic peptide
  XENP022657 vlCDR1
QASQDIGNYLN

SEQ ID NO: 28832 - protein, 7 aa, Artificial Sequence
  Description of Artificial Sequence: Synthetic peptide
  XENP022657 vlCDR2
FTSYLHS

SEQ ID NO: 28833 - protein, 9 aa, Artificial Sequence
  Description of Artificial Sequence: Synthetic peptide
  XENP022657 vlCDR3
QQGNTLPYT

SEQ ID NO: 28834 - protein, 223 aa, Artificial Sequence; identical to SEQ ID NO: 27634
  Description of Artificial Sequence: Synthetic polypeptide
  XENP022658 2A11_H1.144_L2.144_Fab Heavy Chain

SEQ ID NO: 28835 - protein, 118 aa, Artificial Sequence; identical to SEQ ID NO: 22085
  Description of Artificial Sequence: Synthetic polypeptide
  VH of XENP022658

SEQ ID NO: 28836 - protein, 5 aa, Artificial Sequence
  Description of Artificial Sequence: Synthetic peptide
  XENP022658 vhCDR1
DYFMH

SEQ ID NO: 28837 - protein, 17 aa, Artificial Sequence
  Description of Artificial Sequence: Synthetic peptide
  XENP022658 vhCDR2
WIDPELGDTEYAPKFQG

SEQ ID NO: 28838 - protein, 9 aa, Artificial Sequence
  Description of Artificial Sequence: Synthetic peptide
  XENP022658 vhCDR3
RGVYQALDY

SEQ ID NO: 28839 - protein, 214 aa, Artificial Sequence
  Description of Artificial Sequence: Synthetic polypeptide
  XENP022658 2A11_H1.144_L2.144_Fab Light Chain
DIQMTQSPAFLSVTPGEKVTITCQASQDIGNYLNWFQQKPGQTPKLLIYFTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28840 - protein, 107 aa, Artificial Sequence
  Description of Artificial Sequence: Synthetic polypeptide
  VL of XENP022658
DIQMTQSPAFLSVTPGEKVTITCQASQDIGNYLNWFQQKPGQTPKLLIYFTSYLHSGVPSRFSGSGSGTDYTFTISSLEAEDAATYFCQQGNTLPYTFGGGTKVEIK

SEQ ID NO: 28841 - protein, 11 aa, Artificial Sequence
  Description of Artificial Sequence: Synthetic peptide
  XENP022658 vlCDR1
QASQDIGNYLN

SEQ ID NO: 28842 - protein, 7 aa, Artificial Sequence
  Description of Artificial Sequence: Synthetic peptide
  XENP022658 vlCDR2
FTSYLHS

SEQ ID NO: 28843 - protein, 9 aa, Artificial Sequence
  Description of Artificial Sequence: Synthetic peptide
  XENP022658 vlCDR3
QQGNTLPYT

SEQ ID NO: 28844 - protein, 223 aa, Artificial Sequence; identical to SEQ ID NO: 27634
  Description of Artificial Sequence: Synthetic polypeptide
  XENP022659 2A11_H1.144_L2.145_Fab Heavy Chain

SEQ ID NO: 28845 - protein, 118 aa, Artificial Sequence; identical to SEQ ID NO: 22085
  Description of Artificial Sequence: Synthetic polypeptide
  VH of XENP022659

SEQ ID NO: 28846 - protein, 5 aa, Artificial Sequence
  Description of Artificial Sequence: Synthetic peptide
  XENP022659 vhCDR1
DYFMH

SEQ ID NO: 28847 - protein, 17 aa, Artificial Sequence
  Description of Artificial Sequence: Synthetic peptide
  XENP022659 vhCDR2
WIDPELGDTEYAPKFQG

SEQ ID NO: 28848 - protein, 9 aa, Artificial Sequence
  Description of Artificial Sequence: Synthetic peptide
  XENP022659 vhCDR3
RGVYQALDY

SEQ ID NO: 28849 - protein, 214 aa, Artificial Sequence
  Description of Artificial Sequence: Synthetic polypeptide
  XENP022659 2A11_H1.144_L2.145_Fab Light Chain
DIQMTQSPAFLSVTPGEKVTITCQASQDIGNYLNWFQQKPGKVPKLLIYFTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28850 - protein, 107 aa, Artificial Sequence
  Description of Artificial Sequence: Synthetic polypeptide
  VL of XENP022659
DIQMTQSPAFLSVTPGEKVTITCQASQDIGNYLNWFQQKPGKVPKLLIYFTSYLHSGVPSRFSGSGSGTDYTFTISSLEAEDAATYFCQQGNTLPYTFGGGTKVEIK

SEQ ID NO: 28851 - protein, 11 aa, Artificial Sequence
  Description of Artificial Sequence: Synthetic peptide
  XENP022659 vlCDR1
QASQDIGNYLN

SEQ ID NO: 28852 - protein, 7 aa, Artificial Sequence
  Description of Artificial Sequence: Synthetic peptide
  XENP022659 vlCDR2
FTSYLHS

SEQ ID NO: 28853 - protein, 9 aa, Artificial Sequence
  Description of Artificial Sequence: Synthetic peptide
  XENP022659 vlCDR3
QQGNTLPYT

SEQ ID NO: 28854 - protein, 223 aa, Artificial Sequence; identical to SEQ ID NO: 27734
  Description of Artificial Sequence: Synthetic polypeptide
  XENP022660 2A11_H1.125_L2.138_Fab Heavy Chain

SEQ ID NO: 28855 - protein, 118 aa, Artificial Sequence; identical to SEQ ID NO: 22065
  Description of Artificial Sequence: Synthetic polypeptide
  VH of XENP022660

SEQ ID NO: 28856 - protein, 5 aa, Artificial Sequence
  Description of Artificial Sequence: Synthetic peptide
  XENP022660 vhCDR1
HYFMH

SEQ ID NO: 28857 - protein, 17 aa, Artificial Sequence
  Description of Artificial Sequence: Synthetic peptide
  XENP022660 vhCDR2
WIDPYLGDTEYAPKFQG

SEQ ID NO: 28858 - protein, 9 aa, Artificial Sequence
  Description of Artificial Sequence: Synthetic peptide
  XENP022660 vhCDR3
RGVYQALDY

SEQ ID NO: 28859 - protein, 214 aa, Artificial Sequence; identical to SEQ ID NO: 28779
  Description of Artificial Sequence: Synthetic polypeptide
  XENP022660 2A11_H1.125_L2.138_Fab Light Chain

SEQ ID NO: 28860 - protein, 107 aa, Artificial Sequence; identical to SEQ ID NO: 28780
  Description of Artificial Sequence: Synthetic polypeptide
  VL of XENP022660

SEQ ID NO: 28861 - protein, 11 aa, Artificial Sequence
  Description of Artificial Sequence: Synthetic peptide
  XENP022660 vlCDR1
QASQDIGNYLN

SEQ ID NO: 28862 - protein, 7 aa, Artificial Sequence
  Description of Artificial Sequence: Synthetic peptide
  XENP022660 vlCDR2
YTSYLHS

SEQ ID NO: 28863 - protein, 9 aa, Artificial Sequence
  Description of Artificial Sequence: Synthetic peptide
  XENP022660 vlCDR3
QQGNTLPYT

SEQ ID NO: 28864 - protein, 223 aa, Artificial Sequence; identical to SEQ ID NO: 27734
  Description of Artificial Sequence: Synthetic polypeptide
  XENP022661 2A11_H1.125_L2.139_Fab Heavy Chain

SEQ ID NO: 28865 - protein, 118 aa, Artificial Sequence; identical to SEQ ID NO: 22065
  Description of Artificial Sequence: Synthetic polypeptide
  VH of XENP022661

SEQ ID NO: 28866 - protein, 5 aa, Artificial Sequence
  Description of Artificial Sequence: Synthetic peptide
  XENP022661 vhCDR1
HYFMH

SEQ ID NO: 28867 - protein, 17 aa, Artificial Sequence
  Description of Artificial Sequence: Synthetic peptide
  XENP022661 vhCDR2
WIDPYLGDTEYAPKFQG

SEQ ID NO: 28868 - protein, 9 aa, Artificial Sequence
  Description of Artificial Sequence: Synthetic peptide
  XENP022661 vhCDR3
RGVYQALDY

SEQ ID NO: 28869 - protein, 214 aa, Artificial Sequence; identical to SEQ ID NO: 28789
  Description of Artificial Sequence: Synthetic polypeptide
  XENP022661 2A11_H1.125_L2.139_Fab Light Chain

SEQ ID NO: 28870 - protein, 107 aa, Artificial Sequence; identical to SEQ ID NO: 28790
  Description of Artificial Sequence: Synthetic polypeptide
  VL of XENP022661

SEQ ID NO: 28871 - protein, 11 aa, Artificial Sequence
  Description of Artificial Sequence: Synthetic peptide
  XENP022661 vlCDR1
QASQDIGNYLN

SEQ ID NO: 28872 - protein, 7 aa, Artificial Sequence
  Description of Artificial Sequence: Synthetic peptide
  XENP022661 vlCDR2
YTSYLHS

SEQ ID NO: 28873 - protein, 9 aa, Artificial Sequence
  Description of Artificial Sequence: Synthetic peptide
  XENP022661 vlCDR3
QQGNTLPYT

SEQ ID NO: 28874 - protein, 223 aa, Artificial Sequence; identical to SEQ ID NO: 27734
  Description of Artificial Sequence: Synthetic polypeptide
  XENP022662 2A11_H1.125_L2.140_Fab Heavy Chain

SEQ ID NO: 28875 - protein, 118 aa, Artificial Sequence; identical to SEQ ID NO: 22065
  Description of Artificial Sequence: Synthetic polypeptide
  VH of XENP022662

SEQ ID NO: 28876 - protein, 5 aa, Artificial Sequence
  Description of Artificial Sequence: Synthetic peptide
  XENP022662 vhCDR1
HYFMH

SEQ ID NO: 28877 - protein, 17 aa, Artificial Sequence
  Description of Artificial Sequence: Synthetic peptide
  XENP022662 vhCDR2
WIDPYLGDTEYAPKFQG

SEQ ID NO: 28878 - protein, 9 aa, Artificial Sequence
  Description of Artificial Sequence: Synthetic peptide
  XENP022662 vhCDR3
RGVYQALDY

SEQ ID NO: 28879 - protein, 214 aa, Artificial Sequence; identical to SEQ ID NO: 28799
  Description of Artificial Sequence: Synthetic polypeptide
  XENP022662 2A11_H1.125_L2.140_Fab Light Chain

SEQ ID NO: 28880 - protein, 107 aa, Artificial Sequence; identical to SEQ ID NO: 28800
  Description of Artificial Sequence: Synthetic polypeptide
  VL of XENP022662

SEQ ID NO: 28881 - protein, 11 aa, Artificial Sequence
  Description of Artificial Sequence: Synthetic peptide
  XENP022662 vlCDR1
QASQDIGNYLN

SEQ ID NO: 28882 - protein, 7 aa, Artificial Sequence
  Description of Artificial Sequence: Synthetic peptide
  XENP022662 vlCDR2
YTSYLHS

SEQ ID NO: 28883 - protein, 9 aa, Artificial Sequence
  Description of Artificial Sequence: Synthetic peptide
  XENP022662 vlCDR3
QQGNTLPYT

SEQ ID NO: 28884 - protein, 223 aa, Artificial Sequence; identical to SEQ ID NO: 27734
  Description of Artificial Sequence: Synthetic polypeptide
  XENP022663 2A11_H1.125_L2.141_Fab Heavy Chain

SEQ ID NO: 28885 - protein, 118 aa, Artificial Sequence; identical to SEQ ID NO: 22065
  Description of Artificial Sequence: Synthetic polypeptide
  VH of XENP022663

SEQ ID NO: 28886 - protein, 5 aa, Artificial Sequence
  Description of Artificial Sequence: Synthetic peptide
  XENP022663 vhCDR1
HYFMH

SEQ ID NO: 28887 - protein, 17 aa, Artificial Sequence
  Description of Artificial Sequence: Synthetic peptide
  XENP022663 vhCDR2
WIDPYLGDTEYAPKFQG

SEQ ID NO: 28888 - protein, 9 aa, Artificial Sequence
  Description of Artificial Sequence: Synthetic peptide
  XENP022663 vhCDR3
RGVYQALDY

SEQ ID NO: 28889 - protein, 214 aa, Artificial Sequence; identical to SEQ ID NO: 28809
  Description of Artificial Sequence: Synthetic polypeptide
  XENP022663 2A11_H1.125_L2.141_Fab Light Chain

SEQ ID NO: 28890 - protein, 107 aa, Artificial Sequence; identical to SEQ ID NO: 28810
  Description of Artificial Sequence: Synthetic polypeptide
  VL of XENP022663

SEQ ID NO: 28891 - protein, 11 aa, Artificial Sequence
  Description of Artificial Sequence: Synthetic peptide
  XENP022663 vlCDR1
QASQDIGNYLN

SEQ ID NO: 28892 - protein, 7 aa, Artificial Sequence
  Description of Artificial Sequence: Synthetic peptide
  XENP022663 vlCDR2
YTSYLHS

SEQ ID NO: 28893 - protein, 9 aa, Artificial Sequence
  Description of Artificial Sequence: Synthetic peptide
  XENP022663 vlCDR3
QQGNTLPYT

SEQ ID NO: 28894 - protein, 223 aa, Artificial Sequence; identical to SEQ ID NO: 27734
  Description of Artificial Sequence: Synthetic polypeptide
  XENP022664 2A11_H1.125_L2.142_Fab Heavy Chain

SEQ ID NO: 28895 - protein, 118 aa, Artificial Sequence; identical to SEQ ID NO: 22065
  Description of Artificial Sequence: Synthetic polypeptide
  VH of XENP022664

SEQ ID NO: 28896 - protein, 5 aa, Artificial Sequence
  Description of Artificial Sequence: Synthetic peptide
  XENP022664 vhCDR1
HYFMH

SEQ ID NO: 28897 - protein, 17 aa, Artificial Sequence
  Description of Artificial Sequence: Synthetic peptide
  XENP022664 vhCDR2
WIDPYLGDTEYAPKFQG

SEQ ID NO: 28898 - protein, 9 aa, Artificial Sequence
  Description of Artificial Sequence: Synthetic peptide
  XENP022664 vhCDR3
RGVYQALDY

SEQ ID NO: 28899 - protein, 214 aa, Artificial Sequence; identical to SEQ ID NO: 22279
  Description of Artificial Sequence: Synthetic polypeptide
  XENP022664 2A11_H1.125_L2.142_Fab Light Chain

SEQ ID NO: 28900 - protein, 107 aa, Artificial Sequence; identical to SEQ ID NO: 22280
  Description of Artificial Sequence: Synthetic polypeptide
  VL of XENP022664

SEQ ID NO: 28901 - protein, 11 aa, Artificial Sequence
  Description of Artificial Sequence: Synthetic peptide
  XENP022664 vlCDR1
QASQDIGNYLN

SEQ ID NO: 28902 - protein, 7 aa, Artificial Sequence
  Description of Artificial Sequence: Synthetic peptide
  XENP022664 vlCDR2
FTSYLHS

SEQ ID NO: 28903 - protein, 9 aa, Artificial Sequence
  Description of Artificial Sequence: Synthetic peptide
  XENP022664 vlCDR3
QQGNTLPYT

SEQ ID NO: 28904 - protein, 223 aa, Artificial Sequence; identical to SEQ ID NO: 27734
  Description of Artificial Sequence: Synthetic polypeptide
  XENP022665 2A11_H1.125_L2.143_Fab Heavy Chain

SEQ ID NO: 28905 - protein, 118 aa, Artificial Sequence; identical to SEQ ID NO: 22065
  Description of Artificial Sequence: Synthetic polypeptide
  VH of XENP022665

SEQ ID NO: 28906 - protein, 5 aa, Artificial Sequence
  Description of Artificial Sequence: Synthetic peptide
  XENP022665 vhCDR1
HYFMH

SEQ ID NO: 28907 - protein, 17 aa, Artificial Sequence
  Description of Artificial Sequence: Synthetic peptide
  XENP022665 vhCDR2
WIDPYLGDTEYAPKFQG

SEQ ID NO: 28908 - protein, 9 aa, Artificial Sequence
  Description of Artificial Sequence: Synthetic peptide
  XENP022665 vhCDR3
RGVYQALDY

SEQ ID NO: 28909 - protein, 214 aa, Artificial Sequence; identical to SEQ ID NO: 28829
  Description of Artificial Sequence: Synthetic polypeptide
  XENP022665 2A11_H1.125_L2.143_Fab Light Chain

SEQ ID NO: 28910 - protein, 107 aa, Artificial Sequence; identical to SEQ ID NO: 28830
  Description of Artificial Sequence: Synthetic polypeptide
  VL of XENP022665

SEQ ID NO: 28911 - protein, 11 aa, Artificial Sequence
  Description of Artificial Sequence: Synthetic peptide
  XENP022665 vlCDR1
QASQDIGNYLN

SEQ ID NO: 28912 - protein, 7 aa, Artificial Sequence
  Description of Artificial Sequence: Synthetic peptide
  XENP022665 vlCDR2
FTSYLHS

SEQ ID NO: 28913 - protein, 9 aa, Artificial Sequence
  Description of Artificial Sequence: Synthetic peptide
  XENP022665 vlCDR3
QQGNTLPYT

SEQ ID NO: 28914 - protein, 223 aa, Artificial Sequence; identical to SEQ ID NO: 27734
  Description of Artificial Sequence: Synthetic polypeptide
  XENP022666 2A11_H1.125_L2.144_Fab Heavy Chain

SEQ ID NO: 28915 - protein, 118 aa, Artificial Sequence; identical to SEQ ID NO: 22065
  Description of Artificial Sequence: Synthetic polypeptide
  VH of XENP022666

SEQ ID NO: 28916 - protein, 5 aa, Artificial Sequence
  Description of Artificial Sequence: Synthetic peptide
  XENP022666 vhCDR1
HYFMH

SEQ ID NO: 28917 - protein, 17 aa, Artificial Sequence
  Description of Artificial Sequence: Synthetic peptide
  XENP022666 vhCDR2
WIDPYLGDTEYAPKFQG

SEQ ID NO: 28918 - protein, 9 aa, Artificial Sequence
  Description of Artificial Sequence: Synthetic peptide
  XENP022666 vhCDR3
RGVYQALDY

SEQ ID NO: 28919 - protein, 214 aa, Artificial Sequence; identical to SEQ ID NO: 28839
  Description of Artificial Sequence: Synthetic polypeptide
  XENP022666 2A11_H1.125_L2.144_Fab Light Chain

SEQ ID NO: 28920 - protein, 107 aa, Artificial Sequence; identical to SEQ ID NO: 28840
  Description of Artificial Sequence: Synthetic polypeptide
  VL of XENP022666

SEQ ID NO: 28921 - protein, 11 aa, Artificial Sequence
  Description of Artificial Sequence: Synthetic peptide
  XENP022666 vlCDR1
QASQDIGNYLN

SEQ ID NO: 28922 - protein, 7 aa, Artificial Sequence
  Description of Artificial Sequence: Synthetic peptide
  XENP022666 vlCDR2
FTSYLHS

SEQ ID NO: 28923 - protein, 9 aa, Artificial Sequence
  Description of Artificial Sequence: Synthetic peptide
  XENP022666 vlCDR3
QQGNTLPYT

SEQ ID NO: 28924 - protein, 223 aa, Artificial Sequence; identical to SEQ ID NO: 27734
  Description of Artificial Sequence: Synthetic polypeptide
  XENP022667 2A11_H1.125_L2.145_Fab Heavy Chain

SEQ ID NO: 28925 - protein, 118 aa, Artificial Sequence; identical to SEQ ID NO: 22065
  Description of Artificial Sequence: Synthetic polypeptide
  VH of XENP022667

SEQ ID NO: 28926 - protein, 5 aa, Artificial Sequence
  Description of Artificial Sequence: Synthetic peptide
  XENP022667 vhCDR1
HYFMH

SEQ ID NO: 28927 - protein, 17 aa, Artificial Sequence
  Description of Artificial Sequence: Synthetic peptide
  XENP022667 vhCDR2
WIDPYLGDTEYAPKFQG

SEQ ID NO: 28928 - protein, 9 aa, Artificial Sequence
  Description of Artificial Sequence: Synthetic peptide
  XENP022667 vhCDR3
RGVYQALDY

SEQ ID NO: 28929 - protein, 214 aa, Artificial Sequence; identical to SEQ ID NO: 28849
  Description of Artificial Sequence: Synthetic polypeptide
  XENP022667 2A11_H1.125_L2.145_Fab Light Chain

SEQ ID NO: 28930 - protein, 107 aa, Artificial Sequence; identical to SEQ ID NO: 28850
  Description of Artificial Sequence: Synthetic polypeptide
  VL of XENP022667

SEQ ID NO: 28931 - protein, 11 aa, Artificial Sequence
  Description of Artificial Sequence: Synthetic peptide
  XENP022667 vlCDR1
QASQDIGNYLN

SEQ ID NO: 28932 - protein, 7 aa, Artificial Sequence
  Description of Artificial Sequence: Synthetic peptide
  XENP022667 vlCDR2
FTSYLHS

SEQ ID NO: 28933 - protein, 9 aa, Artificial Sequence
  Description of Artificial Sequence: Synthetic peptide
  XENP022667 vlCDR3
QQGNTLPYT

SEQ ID NO: 28934 - protein, 226 aa, Artificial Sequence
  Description of Artificial Sequence: Synthetic polypeptide
  XENP020844 7G8_H3L1_Fab Heavy Chain
EVQLVESGGGLVQPGGSLRLSCAASGFTFSDAWMDWVRQAPGKGLEWVAEIRTKANNHATYYAESVKGRFTISRDDSKSSVYLQMNSLRAEDTAVYYCTRLANWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28935 - protein, 121 aa, Artificial Sequence; identical to SEQ ID NO: 17806
  Description of Artificial Sequence: Synthetic polypeptide
  VH of XENP020844

SEQ ID NO: 28936 - protein, 5 aa, Artificial Sequence
  Description of Artificial Sequence: Synthetic peptide
  XENP020844 vhCDR1
DAWMD

SEQ ID NO: 28937 - protein, 19 aa, Artificial Sequence
  Description of Artificial Sequence: Synthetic peptide
  XENP020844 vhCDR2
EIRTKANNHATYYAESVKG

SEQ ID NO: 28938 - protein, 10 aa, Artificial Sequence
  Description of Artificial Sequence: Synthetic peptide
  XENP020844 vhCDR3
LANWDWYFDV

SEQ ID NO: 28939 - protein, 218 aa, Artificial Sequence; identical to SEQ ID NO: 17600
  Description of Artificial Sequence: Synthetic polypeptide
  XENP020844 7G8_H3L1_Fab Light Chain

SEQ ID NO: 28940 - protein, 111 aa, Artificial Sequence; identical to SEQ ID NO: 17601
  Description of Artificial Sequence: Synthetic polypeptide
  VL of XENP020844

SEQ ID NO: 28941 - protein, 15 aa, Artificial Sequence
  Description of Artificial Sequence: Synthetic peptide
  XENP020844 vlCDR1
RASQSVDYDGDSYMN

SEQ ID NO: 28942 - protein, 7 aa, Artificial Sequence
  Description of Artificial Sequence: Synthetic peptide
  XENP020844 vlCDR2
AASNLES

SEQ ID NO: 28943 - protein, 9 aa, Artificial Sequence
  Description of Artificial Sequence: Synthetic peptide
  XENP020844 vlCDR3
QQSNEDPFT

SEQ ID NO: 28944 - protein, 226 aa, Artificial Sequence
  Description of Artificial Sequence: Synthetic polypeptide
  XENP020911 7G8_H3.1_L1_Fab Heavy Chain
EVQLVESGGGLVQPGGSLRLSCAASGDTFDDAWMDWVRQAPGKGLEWVAEIRTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28945 - protein, 121 aa, Artificial Sequence
  Description of Artificial Sequence: Synthetic polypeptide
  VH of XENP020911
EVQLVESGGGLVQPGGSLRLSCAASGDTFDDAWMDWVRQAPGKGLEWVAEIRTKANNHATYYAESVKGRFTISRDDSKSSVYLQMNSLRAEDTAVYYCTRLATWDWYFDVWGQGTTVTVSS

SEQ ID NO: 28946 - protein, 5 aa, Artificial Sequence
  Description of Artificial Sequence: Synthetic peptide
  XENP020911 vhCDR1
DAWMD

SEQ ID NO: 28947 - protein, 19 aa, Artificial Sequence
  Description of Artificial Sequence: Synthetic peptide
  XENP020911 vhCDR2
EIRTKANNHATYYAESVKG

SEQ ID NO: 28948 - protein, 10 aa, Artificial Sequence
  Description of Artificial Sequence: Synthetic peptide
  XENP020911 vhCDR3
LATWDWYFDV

SEQ ID NO: 28949 - protein, 218 aa, Artificial Sequence; identical to SEQ ID NO: 17600
  Description of Artificial Sequence: Synthetic polypeptide
  XENP020911 7G8_H3.1_L1_Fab Light Chain

SEQ ID NO: 28950 - protein, 111 aa, Artificial Sequence; identical to SEQ ID NO: 17601
  Description of Artificial Sequence: Synthetic polypeptide
  VL of XENP020911

SEQ ID NO: 28951 - protein, 15 aa, Artificial Sequence
  Description of Artificial Sequence: Synthetic peptide
  XENP020911 vlCDR1
RASQSVDYDGDSYMN

SEQ ID NO: 28952 - protein, 7 aa, Artificial Sequence
  Description of Artificial Sequence: Synthetic peptide
  XENP020911 vlCDR2
AASNLES

SEQ ID NO: 28953 - protein, 9 aa, Artificial Sequence
  Description of Artificial Sequence: Synthetic peptide
  XENP020911 vlCDR3
QQSNEDPFT

SEQ ID NO: 28954 - protein, 226 aa, Artificial Sequence
  Description of Artificial Sequence: Synthetic polypeptide
  XENP020912 7G8_H3.2_L1_Fab Heavy Chain
EVQLVESGGGLVQPGGSLRLSCAASGDTFDDAWMDWVRQAPGKGLEWVAEIRTKANNHATYYAESVKGRFTISRDDSKSSVYLQMNSLRAEDTAVYYCTRLANWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28955 - protein, 121 aa, Artificial Sequence
  Description of Artificial Sequence: Synthetic polypeptide
  VH of XENP020912
EVQLVESGGGLVQPGGSLRLSCAASGDTFDDAWMDWVRQAPGKGLEWVAEIRTKANNHATYYAESVKGRFTISRDDSKSSVYLQMNSLRAEDTAVYYCTRLANWDWYFDVWGQGTTVTVSS

SEQ ID NO: 28956 - protein, 5 aa, Artificial Sequence
  Description of Artificial Sequence: Synthetic peptide
  XENP020912 vhCDR1
DAWMD

SEQ ID NO: 28957 - protein, 19 aa, Artificial Sequence
  Description of Artificial Sequence: Synthetic peptide
  XENP020912 vhCDR2
EIRTKANNHATYYAESVKG

SEQ ID NO: 28958 - protein, 10 aa, Artificial Sequence
  Description of Artificial Sequence: Synthetic peptide
  XENP020912 vhCDR3
LANWDWYFDV

SEQ ID NO: 28959 - protein, 218 aa, Artificial Sequence; identical to SEQ ID NO: 17600
  Description of Artificial Sequence: Synthetic polypeptide
  XENP020912 7G8_H3.2_L1_Fab Light Chain

SEQ ID NO: 28960 - protein, 111 aa, Artificial Sequence; identical to SEQ ID NO: 17601
  Description of Artificial Sequence: Synthetic polypeptide
  VL of XENP020912

SEQ ID NO: 28961 - protein, 15 aa, Artificial Sequence
  Description of Artificial Sequence: Synthetic peptide
  XENP020912 vlCDR1
RASQSVDYDGDSYMN

SEQ ID NO: 28962 - protein, 7 aa, Artificial Sequence
  Description of Artificial Sequence: Synthetic peptide
  XENP020912 vlCDR2
AASNLES

SEQ ID NO: 28963 - protein, 9 aa, Artificial Sequence
  Description of Artificial Sequence: Synthetic peptide
  XENP020912 vlCDR3
QQSNEDPFT

SEQ ID NO: 28964 - protein, 226 aa, Artificial Sequence
  Description of Artificial Sequence: Synthetic polypeptide
  XENP020913 7G8_H3.3_L1_Fab Heavy Chain
EVQLVESGGGLVQPGGSLRLSCAASGDTFSDAWMDWVRQAPGKGLEWVAEIRTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28965 - protein, 121 aa, Artificial Sequence
  Description of Artificial Sequence: Synthetic polypeptide
  VH of XENP020913
EVQLVESGGGLVQPGGSLRLSCAASGDTFSDAWMDWVRQAPGKGLEWVAEIRTKANNHATYYAESVKGRFTISRDDSKSSVYLQMNSLRAEDTAVYYCTRLATWDWYFDVWGQGTTVTVSS

SEQ ID NO: 28966 - protein, 5 aa, Artificial Sequence
  Description of Artificial Sequence: Synthetic peptide
  XENP020913 vhCDR1
DAWMD

SEQ ID NO: 28967 - protein, 19 aa, Artificial Sequence
  Description of Artificial Sequence: Synthetic peptide
  XENP020913 vhCDR2
EIRTKANNHATYYAESVKG

SEQ ID NO: 28968 - protein, 10 aa, Artificial Sequence
  Description of Artificial Sequence: Synthetic peptide
  XENP020913 vhCDR3
LATWDWYFDV

SEQ ID NO: 28969 - protein, 218 aa, Artificial Sequence; identical to SEQ ID NO: 17600
  Description of Artificial Sequence: Synthetic polypeptide
  XENP020913 7G8_H3.3_L1_Fab Light Chain

SEQ ID NO: 28970 - protein, 111 aa, Artificial Sequence; identical to SEQ ID NO: 17601
  Description of Artificial Sequence: Synthetic polypeptide
  VL of XENP020913

SEQ ID NO: 28971 - protein, 15 aa, Artificial Sequence
  Description of Artificial Sequence: Synthetic peptide
  XENP020913 vlCDR1
RASQSVDYDGDSYMN

SEQ ID NO: 28972 - protein, 7 aa, Artificial Sequence
  Description of Artificial Sequence: Synthetic peptide
  XENP020913 vlCDR2
AASNLES

SEQ ID NO: 28973 - protein, 9 aa, Artificial Sequence
  Description of Artificial Sequence: Synthetic peptide
  XENP020913 vlCDR3
QQSNEDPFT

SEQ ID NO: 28974 - protein, 226 aa, Artificial Sequence
  Description of Artificial Sequence: Synthetic polypeptide
  XENP020914 7G8_H3.4_L1_Fab Heavy Chain
EVQLVESGGGLVQPGGSLRLSCAASGFTFDDAWMDWVRQAPGKGLEWVAEIRTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28975 - protein, 121 aa, Artificial Sequence
  Description of Artificial Sequence: Synthetic polypeptide
  VH of XENP020914
EVQLVESGGGLVQPGGSLRLSCAASGFTFDDAWMDWVRQAPGKGLEWVAEIRTKANNHATYYAESVKGRFTISRDDSKSSVYLQMNSLRAEDTAVYYCTRLATWDWYFDVWGQGTTVTVSS

SEQ ID NO: 28976 - protein, 5 aa, Artificial Sequence
  Description of Artificial Sequence: Synthetic peptide
  XENP020914 vhCDR1
DAWMD

SEQ ID NO: 28977 - protein, 19 aa, Artificial Sequence
  Description of Artificial Sequence: Synthetic peptide
  XENP020914 vhCDR2
EIRTKANNHATYYAESVKG

SEQ ID NO: 28978 - protein, 10 aa, Artificial Sequence
  Description of Artificial Sequence: Synthetic peptide
  XENP020914 vhCDR3
LATWDWYFDV

SEQ ID NO: 28979 - protein, 218 aa, Artificial Sequence; identical to SEQ ID NO: 17600
  Description of Artificial Sequence: Synthetic polypeptide
  XENP020914 7G8_H3.4_L1_Fab Light Chain

SEQ ID NO: 28980 - protein, 111 aa, Artificial Sequence; identical to SEQ ID NO: 17601
  Description of Artificial Sequence: Synthetic polypeptide
  VL of XENP020914

SEQ ID NO: 28981 - protein, 15 aa, Artificial Sequence
  Description of Artificial Sequence: Synthetic peptide
  XENP020914 vlCDR1
RASQSVDYDGDSYMN

SEQ ID NO: 28982 - protein, 7 aa, Artificial Sequence
  Description of Artificial Sequence: Synthetic peptide
  XENP020914 vlCDR2
AASNLES

SEQ ID NO: 28983 - protein, 9 aa, Artificial Sequence
  Description of Artificial Sequence: Synthetic peptide
  XENP020914 vlCDR3
QQSNEDPFT

SEQ ID NO: 28984 - protein, 226 aa, Artificial Sequence
  Description of Artificial Sequence: Synthetic polypeptide
  XENP020915 7G8_H3.5_L1_Fab Heavy Chain
EVQLVESGGGLVQPGGSLRLSCAASGDTFTDAWMDWVRQAPGKGLEWVAEIRTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28985 - protein, 121 aa, Artificial Sequence
  Description of Artificial Sequence: Synthetic polypeptide
  VH of XENP020915
EVQLVESGGGLVQPGGSLRLSCAASGDTFTDAWMDWVRQAPGKGLEWVAEIRTKANNHATYYAESVKGRFTISRDDSKSSVYLQMNSLRAEDTAVYYCTRLATWDWYFDVWGQGTTVTVSS

SEQ ID NO: 28986 - protein, 5 aa, Artificial Sequence
  Description of Artificial Sequence: Synthetic peptide
  XENP020915 vhCDR1
DAWMD

SEQ ID NO: 28987 - protein, 19 aa, Artificial Sequence
  Description of Artificial Sequence: Synthetic peptide
  XENP020915 vhCDR2
EIRTKANNHATYYAESVKG

SEQ ID NO: 28988 - protein, 10 aa, Artificial Sequence
  Description of Artificial Sequence: Synthetic peptide
  XENP020915 vhCDR3
LATWDWYFDV

SEQ ID NO: 28989 - protein, 218 aa, Artificial Sequence; identical to SEQ ID NO: 17600
  Description of Artificial Sequence: Synthetic polypeptide
  XENP020915 7G8_H3.5_L1_Fab Light Chain

SEQ ID NO: 28990 - protein, 111 aa, Artificial Sequence; identical to SEQ ID NO: 17601
  Description of Artificial Sequence: Synthetic polypeptide
  VL of XENP020915

SEQ ID NO: 28991 - protein, 15 aa, Artificial Sequence
  Description of Artificial Sequence: Synthetic peptide
  XENP020915 vlCDR1
RASQSVDYDGDSYMN

SEQ ID NO: 28992 - protein, 7 aa, Artificial Sequence
  Description of Artificial Sequence: Synthetic peptide
  XENP020915 vlCDR2
AASNLES

SEQ ID NO: 28993 - protein, 9 aa, Artificial Sequence
  Description of Artificial Sequence: Synthetic peptide
  XENP020915 vlCDR3
QQSNEDPFT

SEQ ID NO: 28994 - protein, 226 aa, Artificial Sequence
  Description of Artificial Sequence: Synthetic polypeptide
  XENP020916 7G8_H3.6_L1_Fab Heavy Chain
EVQLVESGGGLVQPGGSLRLSCAASGDTFTDAWMDWVRQAPGKGLEWVAEIRTKANNHATYYAESVKGRFTISRDDSKSSVYLQMNSLRAEDTAVYYCTRLANWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28995 - protein, 121 aa, Artificial Sequence
  Description of Artificial Sequence: Synthetic polypeptide
  VH of XENP020916
EVQLVESGGGLVQPGGSLRLSCAASGDTFTDAWMDWVRQAPGKGLEWVAEIRTKANNHATYYAESVKGRFTISRDDSKSSVYLQMNSLRAEDTAVYYCTRLANWDWYFDVWGQGTTVTVSS

SEQ ID NO: 28996 - protein, 5 aa, Artificial Sequence
  Description of Artificial Sequence: Synthetic peptide
  XENP020916 vhCDR1
DAWMD

SEQ ID NO: 28997 - protein, 19 aa, Artificial Sequence
  Description of Artificial Sequence: Synthetic peptide
  XENP020916 vhCDR2
EIRTKANNHATYYAESVKG

SEQ ID NO: 28998 - protein, 10 aa, Artificial Sequence
  Description of Artificial Sequence: Synthetic peptide
  XENP020916 vhCDR3
LANWDWYFDV

SEQ ID NO: 28999 - protein, 218 aa, Artificial Sequence; identical to SEQ ID NO: 17600
  Description of Artificial Sequence: Synthetic polypeptide
  XENP020916 7G8_H3.6_L1_Fab Light Chain

SEQ ID NO: 29000 - protein, 111 aa, Artificial Sequence; identical to SEQ ID NO: 17601
  Description of Artificial Sequence: Synthetic polypeptide
  VL of XENP020916

SEQ ID NO: 29001 - protein, 15 aa, Artificial Sequence
  Description of Artificial Sequence: Synthetic peptide
  XENP020916 vlCDR1
RASQSVDYDGDSYMN

SEQ ID NO: 29002 - protein, 7 aa, Artificial Sequence
  Description of Artificial Sequence: Synthetic peptide
  XENP020916 vlCDR2
AASNLES

SEQ ID NO: 29003 - protein, 9 aa, Artificial Sequence
  Description of Artificial Sequence: Synthetic peptide
  XENP020916 vlCDR3
QQSNEDPFT

SEQ ID NO: 29004 - protein, 226 aa, Artificial Sequence
  Description of Artificial Sequence: Synthetic polypeptide
  XENP020917 7G8_H3.8_L1_Fab Heavy Chain
EVQLVESGGGLVQPGGSLRLSCAASGFTFTDAWMDWVRQAPGKGLEWVAEIRTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29005 - protein, 121 aa, Artificial Sequence
  Description of Artificial Sequence: Synthetic polypeptide
  VH of XENP020917
EVQLVESGGGLVQPGGSLRLSCAASGFTFTDAWMDWVRQAPGKGLEWVAEIRTKANNHATYYAESVKGRFTISRDDSKSSVYLQMNSLRAEDTAVYYCTRLATWDWYFDVWGQGTTVTVSS

SEQ ID NO: 29006 - protein, 5 aa, Artificial Sequence
  Description of Artificial Sequence: Synthetic peptide
  XENP020917 vhCDR1
DAWMD

SEQ ID NO: 29007 - protein, 19 aa, Artificial Sequence
  Description of Artificial Sequence: Synthetic peptide
  XENP020917 vhCDR2
EIRTKANNHATYYAESVKG

SEQ ID NO: 29008 - protein, 10 aa, Artificial Sequence
  Description of Artificial Sequence: Synthetic peptide
  XENP020917 vhCDR3
LATWDWYFDV

SEQ ID NO: 29009 - protein, 218 aa, Artificial Sequence; identical to SEQ ID NO: 17600
  Description of Artificial Sequence: Synthetic polypeptide
  XENP020917 7G8_H3.8_L1_Fab Light Chain

SEQ ID NO: 29010 - protein, 111 aa, Artificial Sequence; identical to SEQ ID NO: 17601
  Description of Artificial Sequence: Synthetic polypeptide
  VL of XENP020917

SEQ ID NO: 29011 - protein, 15 aa, Artificial Sequence
  Description of Artificial Sequence: Synthetic peptide
  XENP020917 vlCDR1
RASQSVDYDGDSYMN

SEQ ID NO: 29012 - protein, 7 aa, Artificial Sequence
  Description of Artificial Sequence: Synthetic peptide
  XENP020917 vlCDR2
AASNLES

SEQ ID NO: 29013 - protein, 9 aa, Artificial Sequence
  Description of Artificial Sequence: Synthetic peptide
  XENP020917 vlCDR3
QQSNEDPFT

SEQ ID NO: 29014 - protein, 226 aa, Artificial Sequence; identical to SEQ ID NO: 28934
  Description of Artificial Sequence: Synthetic polypeptide
  XENP020918 7G8_H3_L1.1_Fab Heavy Chain

SEQ ID NO: 29015 - protein, 121 aa, Artificial Sequence; identical to SEQ ID NO: 17806
  Description of Artificial Sequence: Synthetic polypeptide
  VH of XENP020918

SEQ ID NO: 29016 - protein, 5 aa, Artificial Sequence
  Description of Artificial Sequence: Synthetic peptide
  XENP020918 vhCDR1
DAWMD

SEQ ID NO: 29017 - protein, 19 aa, Artificial Sequence
  Description of Artificial Sequence: Synthetic peptide
  XENP020918 vhCDR2
EIRTKANNHATYYAESVKG

SEQ ID NO: 29018 - protein, 10 aa, Artificial Sequence
  Description of Artificial Sequence: Synthetic peptide
  XENP020918 vhCDR3
LANWDWYFDV

SEQ ID NO: 29019 - protein, 218 aa, Artificial Sequence
  Description of Artificial Sequence: Synthetic polypeptide
  XENP020918 7G8_H3_L1.1_Fab Light Chain
DTVLTQSPSSLSASVGDRVTITCRASQSVDYDDDSYMNWYQQKPGKPPKLLIYGASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29020 - protein, 111 aa, Artificial Sequence
  Description of Artificial Sequence: Synthetic polypeptide
  VL of XENP020918
DTVLTQSPSSLSASVGDRVTITCRASQSVDYDDDSYMNWYQQKPGKPPKLLIYGASELESGIPARLSGSGSGTDFTLTISSLQPEDFATYYCQQSNEDPFTFGSGTKLEIK

SEQ ID NO: 29021 - protein, 15 aa, Artificial Sequence
  Description of Artificial Sequence: Synthetic peptide
  XENP020918 vlCDR1
RASQSVDYDDDSYMN

SEQ ID NO: 29022 - protein, 7 aa, Artificial Sequence
  Description of Artificial Sequence: Synthetic peptide
  XENP020918 vlCDR2
GASELES

SEQ ID NO: 29023 - protein, 9 aa, Artificial Sequence
  Description of Artificial Sequence: Synthetic peptide
  XENP020918 vlCDR3
QQSNEDPFT

SEQ ID NO: 29024 - protein, 226 aa, Artificial Sequence; identical to SEQ ID NO: 28934
  Description of Artificial Sequence: Synthetic polypeptide
  XENP020919 7G8_H3_L1.2_Fab Heavy Chain

SEQ ID NO: 29025 - protein, 121 aa, Artificial Sequence; identical to SEQ ID NO: 17806
  Description of Artificial Sequence: Synthetic polypeptide
  VH of XENP020919

SEQ ID NO: 29026 - protein, 5 aa, Artificial Sequence
  Description of Artificial Sequence: Synthetic peptide
  XENP020919 vhCDR1
DAWMD

SEQ ID NO: 29027 - protein, 19 aa, Artificial Sequence
  Description of Artificial Sequence: Synthetic peptide
  XENP020919 vhCDR2
EIRTKANNHATYYAESVKG

SEQ ID NO: 29028 - protein, 10 aa, Artificial Sequence
  Description of Artificial Sequence: Synthetic peptide
  XENP020919 vhCDR3
LANWDWYFDV

SEQ ID NO: 29029 - protein, 218 aa, Artificial Sequence
  Description of Artificial Sequence: Synthetic polypeptide
  XENP020919 7G8_H3_L1.2_Fab Light Chain
DTVLTQSPSSLSASVGDRVTITCRASQSVDYDDDSYMNWYQQKPGKPPKLLIYGASNLESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29030 - protein, 111 aa, Artificial Sequence
  Description of Artificial Sequence: Synthetic polypeptide
  VL of XENP020919
DTVLTQSPSSLSASVGDRVTITCRASQSVDYDDDSYMNWYQQKPGKPPKLLIYGASNLESGIPARLSGSGSGTDFTLTISSLQPEDFATYYCQQSNEDPFTFGSGTKLEIK

SEQ ID NO: 29031 - protein, 15 aa, Artificial Sequence
  Description of Artificial Sequence: Synthetic peptide
  XENP020919 vlCDR1
RASQSVDYDDDSYMN

SEQ ID NO: 29032 - protein, 7 aa, Artificial Sequence
  Description of Artificial Sequence: Synthetic peptide
  XENP020919 vlCDR2
GASNLES

SEQ ID NO: 29033 - protein, 9 aa, Artificial Sequence
  Description of Artificial Sequence: Synthetic peptide
  XENP020919 vlCDR3
QQSNEDPFT

SEQ ID NO: 29034 - protein, 226 aa, Artificial Sequence; identical to SEQ ID NO: 28934
  Description of Artificial Sequence: Synthetic polypeptide
  XENP020920 7G8_H3_L1.3_Fab Heavy Chain

SEQ ID NO: 29035 - protein, 121 aa, Artificial Sequence; identical to SEQ ID NO: 17806
  Description of Artificial Sequence: Synthetic polypeptide
  VH of XENP020920

SEQ ID NO: 29036 - protein, 5 aa, Artificial Sequence
  Description of Artificial Sequence: Synthetic peptide
  XENP020920 vhCDR1
DAWMD

SEQ ID NO: 29037 - protein, 19 aa, Artificial Sequence
  Description of Artificial Sequence: Synthetic peptide
  XENP020920 vhCDR2
EIRTKANNHATYYAESVKG

SEQ ID NO: 29038 - protein, 10 aa, Artificial Sequence
  Description of Artificial Sequence: Synthetic peptide
  XENP020920 vhCDR3
LANWDWYFDV

SEQ ID NO: 29039 - protein, 218 aa, Artificial Sequence
  Description of Artificial Sequence: Synthetic polypeptide
  XENP020920 7G8_H3_L1.3_Fab Light Chain
DTVLTQSPSSLSASVGDRVTITCRASQSVDYDDDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29040 - protein, 111 aa, Artificial Sequence
  Description of Artificial Sequence: Synthetic polypeptide
  VL of XENP020920
DTVLTQSPSSLSASVGDRVTITCRASQSVDYDDDSYMNWYQQKPGKPPKLLIYAASELESGIPARLSGSGSGTDFTLTISSLQPEDFATYYCQQSNEDPFTFGSGTKLEIK

SEQ ID NO: 29041 - protein, 15 aa, Artificial Sequence
  Description of Artificial Sequence: Synthetic peptide
  XENP020920 vlCDR1
RASQSVDYDDDSYMN

SEQ ID NO: 29042 - protein, 7 aa, Artificial Sequence
  Description of Artificial Sequence: Synthetic peptide
  XENP020920 vlCDR2
AASELES

SEQ ID NO: 29043 - protein, 9 aa, Artificial Sequence
  Description of Artificial Sequence: Synthetic peptide
  XENP020920 vlCDR3
QQSNEDPFT

SEQ ID NO: 29044 - protein, 226 aa, Artificial Sequence; identical to SEQ ID NO: 28934
  Description of Artificial Sequence: Synthetic polypeptide
  XENP020921 7G8_H3_L1.4_Fab Heavy Chain

SEQ ID NO: 29045 - protein, 121 aa, Artificial Sequence; identical to SEQ ID NO: 17806
  Description of Artificial Sequence: Synthetic polypeptide
  VH of XENP020921

SEQ ID NO: 29046 - protein, 5 aa, Artificial Sequence
  Description of Artificial Sequence: Synthetic peptide
  XENP020921 vhCDR1
DAWMD

SEQ ID NO: 29047 - protein, 19 aa, Artificial Sequence
  Description of Artificial Sequence: Synthetic peptide
  XENP020921 vhCDR2
EIRTKANNHATYYAESVKG

SEQ ID NO: 29048 - protein, 10 aa, Artificial Sequence
  Description of Artificial Sequence: Synthetic peptide
  XENP020921 vhCDR3
LANWDWYFDV

SEQ ID NO: 29049 - protein, 218 aa, Artificial Sequence
  Description of Artificial Sequence: Synthetic polypeptide
  XENP020921 7G8_H3_L1.4_Fab Light Chain
DTVLTQSPSSLSASVGDRVTITCRASQSVDYDGDSYMNWYQQKPGKPPKLLIYGASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29050 - protein, 111 aa, Artificial Sequence
  Description of Artificial Sequence: Synthetic polypeptide
  VL of XENP020921
DTVLTQSPSSLSASVGDRVTITCRASQSVDYDGDSYMNWYQQKPGKPPKLLIYGASELESGIPARLSGSGSGTDFTLTISSLQPEDFATYYCQQSNEDPFTFGSGTKLEIK

SEQ ID NO: 29051 - protein, 15 aa, Artificial Sequence
  Description of Artificial Sequence: Synthetic peptide
  XENP020921 vlCDR1
RASQSVDYDGDSYMN

SEQ ID NO: 29052 - protein, 7 aa, Artificial Sequence
  Description of Artificial Sequence: Synthetic peptide
  XENP020921 vlCDR2
GASELES

SEQ ID NO: 29053 - protein, 9 aa, Artificial Sequence
  Description of Artificial Sequence: Synthetic peptide
  XENP020921 vlCDR3
QQSNEDPFT

SEQ ID NO: 29054 - protein, 226 aa, Artificial Sequence; identical to SEQ ID NO: 28934
  Description of Artificial Sequence: Synthetic polypeptide
  XENP020922 7G8_H3_L1.5_Fab Heavy Chain

SEQ ID NO: 29055 - protein, 121 aa, Artificial Sequence; identical to SEQ ID NO: 17806
  Description of Artificial Sequence: Synthetic polypeptide
  VH of XENP020922

SEQ ID NO: 29056 - protein, 5 aa, Artificial Sequence
  Description of Artificial Sequence: Synthetic peptide
  XENP020922 vhCDR1
DAWMD

SEQ ID NO: 29057 - protein, 19 aa, Artificial Sequence
  Description of Artificial Sequence: Synthetic peptide
  XENP020922 vhCDR2
EIRTKANNHATYYAESVKG

SEQ ID NO: 29058 - protein, 10 aa, Artificial Sequence
  Description of Artificial Sequence: Synthetic peptide
  XENP020922 vhCDR3
LANWDWYFDV

SEQ ID NO: 29059 - protein, 218 aa, Artificial Sequence
  Description of Artificial Sequence: Synthetic polypeptide
  XENP020922 7G8_H3_L1.5_Fab Light Chain
DTVLTQSPSSLSASVGDRVTITCRASQSVDYDDDSYMNWYQQKPGKPPKLLIYSASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29060 - protein, 111 aa, Artificial Sequence
  Description of Artificial Sequence: Synthetic polypeptide
  VL of XENP020922
DTVLTQSPSSLSASVGDRVTITCRASQSVDYDDDSYMNWYQQKPGKPPKLLIYSASELESGIPARLSGSGSGTDFTLTISSLQPEDFATYYCQQSNEDPFTFGSGTKLEIK

SEQ ID NO: 29061 - protein, 15 aa, Artificial Sequence
  Description of Artificial Sequence: Synthetic peptide
  XENP020922 vlCDR1
RASQSVDYDDDSYMN

SEQ ID NO: 29062 - protein, 7 aa, Artificial Sequence
  Description of Artificial Sequence: Synthetic peptide
  XENP020922 vlCDR2
SASELES

SEQ ID NO: 29063 - protein, 9 aa, Artificial Sequence
  Description of Artificial Sequence: Synthetic peptide
  XENP020922 vlCDR3
QQSNEDPFT

SEQ ID NO: 29064 - protein, 226 aa, Artificial Sequence; identical to SEQ ID NO: 28934
  Description of Artificial Sequence: Synthetic polypeptide
  XENP020923 7G8_H3_L1.6_Fab Heavy Chain

SEQ ID NO: 29065 - protein, 121 aa, Artificial Sequence; identical to SEQ ID NO: 17806
  Description of Artificial Sequence: Synthetic polypeptide
  VH of XENP020923

SEQ ID NO: 29066 - protein, 5 aa, Artificial Sequence
  Description of Artificial Sequence: Synthetic peptide
  XENP020923 vhCDR1
DAWMD

SEQ ID NO: 29067 - protein, 19 aa, Artificial Sequence
  Description of Artificial Sequence: Synthetic peptide
  XENP020923 vhCDR2
EIRTKANNHATYYAESVKG

SEQ ID NO: 29068 - protein, 10 aa, Artificial Sequence
  Description of Artificial Sequence: Synthetic peptide
  XENP020923 vhCDR3
LANWDWYFDV

SEQ ID NO: 29069 - protein, 218 aa, Artificial Sequence
  Description of Artificial Sequence: Synthetic polypeptide
  XENP020923 7G8_H3_L1.6_Fab Light Chain
DTVLTQSPSSLSASVGDRVTITCRASQSVDYDDDSYMNWYQQKPGKPPKLLIYSASNLESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29070 - protein, 111 aa, Artificial Sequence
  Description of Artificial Sequence: Synthetic polypeptide
  VL of XENP020923
DTVLTQSPSSLSASVGDRVTITCRASQSVDYDDDSYMNWYQQKPGKPPKLLIYSASNLESGIPARLSGSGSGTDFTLTISSLQPEDFATYYCQQSNEDPFTFGSGTKLEIK

SEQ ID NO: 29071 - protein, 15 aa, Artificial Sequence
  Description of Artificial Sequence: Synthetic peptide
  XENP020923 vlCDR1
RASQSVDYDDDSYMN

SEQ ID NO: 29072 - protein, 7 aa, Artificial Sequence
  Description of Artificial Sequence: Synthetic peptide
  XENP020923 vlCDR2
SASNLES

SEQ ID NO: 29073 - protein, 9 aa, Artificial Sequence
  Description of Artificial Sequence: Synthetic peptide
  XENP020923 vlCDR3
QQSNEDPFT

SEQ ID NO: 29074 - protein, 226 aa, Artificial Sequence; identical to SEQ ID NO: 28934
  Description of Artificial Sequence: Synthetic polypeptide
  XENP020924 7G8_H3_L1.8_Fab Heavy Chain

SEQ ID NO: 29075 - protein, 121 aa, Artificial Sequence; identical to SEQ ID NO: 17806
  Description of Artificial Sequence: Synthetic polypeptide
  VH of XENP020924

SEQ ID NO: 29076 - protein, 5 aa, Artificial Sequence
  Description of Artificial Sequence: Synthetic peptide
  XENP020924 vhCDR1
DAWMD

SEQ ID NO: 29077 - protein, 19 aa, Artificial Sequence
  Description of Artificial Sequence: Synthetic peptide
  XENP020924 vhCDR2
EIRTKANNHATYYAESVKG

SEQ ID NO: 29078 - protein, 10 aa, Artificial Sequence
  Description of Artificial Sequence: Synthetic peptide
  XENP020924 vhCDR3
LANWDWYFDV

SEQ ID NO: 29079 - protein, 218 aa, Artificial Sequence
  Description of Artificial Sequence: Synthetic polypeptide
  XENP020924 7G8_H3_L1.8_Fab Light Chain
DTVLTQSPSSLSASVGDRVTITCRASQSVDYDGDSYMNWYQQKPGKPPKLLIYSASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29080 - protein, 111 aa, Artificial Sequence
  Description of Artificial Sequence: Synthetic polypeptide
  VL of XENP020924
DTVLTQSPSSLSASVGDRVTITCRASQSVDYDGDSYMNWYQQKPGKPPKLLIYSASELESGIPARLSGSGSGTDFTLTISSLQPEDFATYYCQQSNEDPFTFGSGTKLEIK

SEQ ID NO: 29081 - protein, 15 aa, Artificial Sequence
  Description of Artificial Sequence: Synthetic peptide
  XENP020924 vlCDR1
RASQSVDYDGDSYMN

SEQ ID NO: 29082 - protein, 7 aa, Artificial Sequence
  Description of Artificial Sequence: Synthetic peptide
  XENP020924 vlCDR2
SASELES

SEQ ID NO: 29083 - protein, 9 aa, Artificial Sequence
  Description of Artificial Sequence: Synthetic peptide
  XENP020924 vlCDR3
QQSNEDPFT

SEQ ID NO: 29084 - protein, 226 aa, Artificial Sequence; identical to SEQ ID NO: 28944
  Description of Artificial Sequence: Synthetic polypeptide
  XENP020925 7G8_H3.1_L1.1_Fab Heavy Chain

SEQ ID NO: 29085 - protein, 121 aa, Artificial Sequence; identical to SEQ ID NO: 28945
  Description of Artificial Sequence: Synthetic polypeptide
  VH of XENP020925

SEQ ID NO: 29086 - protein, 5 aa, Artificial Sequence
  Description of Artificial Sequence: Synthetic peptide
  XENP020925 vhCDR1
DAWMD

SEQ ID NO: 29087 - protein, 19 aa, Artificial Sequence
  Description of Artificial Sequence: Synthetic peptide
  XENP020925 vhCDR2
EIRTKANNHATYYAESVKG

SEQ ID NO: 29088 - protein, 10 aa, Artificial Sequence
  Description of Artificial Sequence: Synthetic peptide
  XENP020925 vhCDR3
LATWDWYFDV

SEQ ID NO: 29089 - protein, 218 aa, Artificial Sequence; identical to SEQ ID NO: 29019
  Description of Artificial Sequence: Synthetic polypeptide
  XENP020925 7G8_H3.1_L1.1_Fab Light Chain

SEQ ID NO: 29090 - protein, 111 aa, Artificial Sequence; identical to SEQ ID NO: 29020
  Description of Artificial Sequence: Synthetic polypeptide
  VL of XENP020925

SEQ ID NO: 29091 - protein, 15 aa, Artificial Sequence
  Description of Artificial Sequence: Synthetic peptide
  XENP020925 vlCDR1
RASQSVDYDDDSYMN

SEQ ID NO: 29092 - protein, 7 aa, Artificial Sequence
  Description of Artificial Sequence: Synthetic peptide
  XENP020925 vlCDR2
GASELES

SEQ ID NO: 29093 - protein, 9 aa, Artificial Sequence
  Description of Artificial Sequence: Synthetic peptide
  XENP020925 vlCDR3
QQSNEDPFT

SEQ ID NO: 29094 - protein, 226 aa, Artificial Sequence; identical to SEQ ID NO: 28944
  Description of Artificial Sequence: Synthetic polypeptide
  XENP020926 7G8_H3.1_L1.5_Fab Heavy Chain

SEQ ID NO: 29095 - protein, 121 aa, Artificial Sequence; identical to SEQ ID NO: 28945
  Description of Artificial Sequence: Synthetic polypeptide
  VH of XENP020926

SEQ ID NO: 29096 - protein, 5 aa, Artificial Sequence
  Description of Artificial Sequence: Synthetic peptide
  XENP020926 vhCDR1
DAWMD

SEQ ID NO: 29097 - protein, 19 aa, Artificial Sequence
  Description of Artificial Sequence: Synthetic peptide
  XENP020926 vhCDR2
EIRTKANNHATYYAESVKG

SEQ ID NO: 29098 - protein, 10 aa, Artificial Sequence
  Description of Artificial Sequence: Synthetic peptide
  XENP020926 vhCDR3
LATWDWYFDV

SEQ ID NO: 29099 - protein, 218 aa, Artificial Sequence; identical to SEQ ID NO: 29059
  Description of Artificial Sequence: Synthetic polypeptide
  XENP020926 7G8_H3.1_L1.5_Fab Light Chain

SEQ ID NO: 29100 - protein, 111 aa, Artificial Sequence; identical to SEQ ID NO: 29060
  Description of Artificial Sequence: Synthetic polypeptide
  VL of XENP020926

SEQ ID NO: 29101 - protein, 15 aa, Artificial Sequence
  Description of Artificial Sequence: Synthetic peptide
  XENP020926 vlCDR1
RASQSVDYDDDSYMN

SEQ ID NO: 29102 - protein, 7 aa, Artificial Sequence
  Description of Artificial Sequence: Synthetic peptide
  XENP020926 vlCDR2
SASELES

SEQ ID NO: 29103 - protein, 9 aa, Artificial Sequence
  Description of Artificial Sequence: Synthetic peptide
  XENP020926 vlCDR3
QQSNEDPFT

SEQ ID NO: 29104 - protein, 226 aa, Artificial Sequence; identical to SEQ ID NO: 28984
  Description of Artificial Sequence: Synthetic polypeptide
  XENP020927 7G8_H3.5_L1.1_Fab Heavy Chain

SEQ ID NO: 29105 - protein, 121 aa, Artificial Sequence; identical to SEQ ID NO: 28985
  Description of Artificial Sequence: Synthetic polypeptide
  VH of XENP020927

SEQ ID NO: 29106 - protein, 5 aa, Artificial Sequence
  Description of Artificial Sequence: Synthetic peptide
  XENP020927 vhCDR1
DAWMD

SEQ ID NO: 29107 - protein, 19 aa, Artificial Sequence
  Description of Artificial Sequence: Synthetic peptide
  XENP020927 vhCDR2
EIRTKANNHATYYAESVKG

SEQ ID NO: 29108 - protein, 10 aa, Artificial Sequence
  Description of Artificial Sequence: Synthetic peptide
  XENP020927 vhCDR3
LATWDWYFDV

SEQ ID NO: 29109 - protein, 218 aa, Artificial Sequence; identical to SEQ ID NO: 29019
  Description of Artificial Sequence: Synthetic polypeptide
  XENP020927 7G8_H3.5_L1.1_Fab Light Chain

SEQ ID NO: 29110 - protein, 111 aa, Artificial Sequence; identical to SEQ ID NO: 29020
  Description of Artificial Sequence: Synthetic polypeptide
  VL of XENP020927

SEQ ID NO: 29111 - protein, 15 aa, Artificial Sequence
  Description of Artificial Sequence: Synthetic peptide
  XENP020927 vlCDR1
RASQSVDYDDDSYMN

SEQ ID NO: 29112 - protein, 7 aa, Artificial Sequence
  Description of Artificial Sequence: Synthetic peptide
  XENP020927 vlCDR2
GASELES

SEQ ID NO: 29113 - protein, 9 aa, Artificial Sequence
  Description of Artificial Sequence: Synthetic peptide
  XENP020927 vlCDR3
QQSNEDPFT

SEQ ID NO: 29114 - protein, 226 aa, Artificial Sequence; identical to SEQ ID NO: 28984
  Description of Artificial Sequence: Synthetic polypeptide
  XENP020928 7G8_H3.5_L1.5_Fab Heavy Chain

SEQ ID NO: 29115 - protein, 121 aa, Artificial Sequence; identical to SEQ ID NO: 28985
  Description of Artificial Sequence: Synthetic polypeptide
  VH of XENP020928

SEQ ID NO: 29116 - protein, 5 aa, Artificial Sequence
  Description of Artificial Sequence: Synthetic peptide
  XENP020928 vhCDR1
DAWMD

SEQ ID NO: 29117 - protein, 19 aa, Artificial Sequence
  Description of Artificial Sequence: Synthetic peptide
  XENP020928 vhCDR2
EIRTKANNHATYYAESVKG

SEQ ID NO: 29118 - protein, 10 aa, Artificial Sequence
  Description of Artificial Sequence: Synthetic peptide
  XENP020928 vhCDR3
LATWDWYFDV

SEQ ID NO: 29119 - protein, 218 aa, Artificial Sequence; identical to SEQ ID NO: 29059
  Description of Artificial Sequence: Synthetic polypeptide
  XENP020928 7G8_H3.5_L1.5_Fab Light Chain

SEQ ID NO: 29120 - protein, 111 aa, Artificial Sequence; identical to SEQ ID NO: 29060
  Description of Artificial Sequence: Synthetic polypeptide
  VL of XENP020928

SEQ ID NO: 29121 - protein, 15 aa, Artificial Sequence
  Description of Artificial Sequence: Synthetic peptide
  XENP020928 vlCDR1
RASQSVDYDDDSYMN

SEQ ID NO: 29122 - protein, 7 aa, Artificial Sequence
  Description of Artificial Sequence: Synthetic peptide
  XENP020928 vlCDR2
SASELES

SEQ ID NO: 29123 - protein, 9 aa, Artificial Sequence
  Description of Artificial Sequence: Synthetic peptide
  XENP020928 vlCDR3
QQSNEDPFT

SEQ ID NO: 29124 - protein, 226 aa, Artificial Sequence; identical to SEQ ID NO: 28934
  Description of Artificial Sequence: Synthetic polypeptide
  XENP020929 7G8_H3L0_Fab Heavy Chain

SEQ ID NO: 29125 - protein, 121 aa, Artificial Sequence; identical to SEQ ID NO: 17806
  Description of Artificial Sequence: Synthetic polypeptide
  VH of XENP020929

SEQ ID NO: 29126 - protein, 5 aa, Artificial Sequence
  Description of Artificial Sequence: Synthetic peptide
  XENP020929 vhCDR1
DAWMD

SEQ ID NO: 29127 - protein, 19 aa, Artificial Sequence
  Description of Artificial Sequence: Synthetic peptide
  XENP020929 vhCDR2
EIRTKANNHATYYAESVKG

SEQ ID NO: 29128 - protein, 10 aa, Artificial Sequence
  Description of Artificial Sequence: Synthetic peptide
  XENP020929 vhCDR3
LANWDWYFDV

SEQ ID NO: 29129 - protein, 218 aa, Artificial Sequence; identical to SEQ ID NO: 17590
  Description of Artificial Sequence: Synthetic polypeptide
  XENP020929 7G8_H3L0_Fab Light Chain

SEQ ID NO: 29130 - protein, 111 aa, Artificial Sequence; identical to SEQ ID NO: 17591
  Description of Artificial Sequence: Synthetic polypeptide
  VL of XENP020929

SEQ ID NO: 29131 - protein, 15 aa, Artificial Sequence
  Description of Artificial Sequence: Synthetic peptide
  XENP020929 vlCDR1
KASQSVDYDGDSYMN

SEQ ID NO: 29132 - protein, 7 aa, Artificial Sequence
  Description of Artificial Sequence: Synthetic peptide
  XENP020929 vlCDR2
AASNLES

SEQ ID NO: 29133 - protein, 9 aa, Artificial Sequence
  Description of Artificial Sequence: Synthetic peptide
  XENP020929 vlCDR3
QQSNEDPFT

SEQ ID NO: 29134 - protein, 226 aa, Artificial Sequence
  Description of Artificial Sequence: Synthetic polypeptide
  XENP020930 7G8_H0L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29135 - protein, 121 aa, Artificial Sequence; identical to SEQ ID NO: 17586
  Description of Artificial Sequence: Synthetic polypeptide
  VH of XENP020930

SEQ ID NO: 29136 - protein, 5 aa, Artificial Sequence
  Description of Artificial Sequence: Synthetic peptide
  XENP020930 vhCDR1
DAWMD

SEQ ID NO: 29137 - protein, 19 aa, Artificial Sequence
  Description of Artificial Sequence: Synthetic peptide
  XENP020930 vhCDR2
EIRTKANNHATYYAESVKG

SEQ ID NO: 29138 - protein, 10 aa, Artificial Sequence
  Description of Artificial Sequence: Synthetic peptide
  XENP020930 vhCDR3
LANWDWYFDV

SEQ ID NO: 29139 - protein, 218 aa, Artificial Sequence; identical to SEQ ID NO: 17590
  Description of Artificial Sequence: Synthetic polypeptide
  XENP020930 7G8_H0L0_Fab Light Chain

SEQ ID NO: 29140 - protein, 111 aa, Artificial Sequence; identical to SEQ ID NO: 17591
  Description of Artificial Sequence: Synthetic polypeptide
  VL of XENP020930

SEQ ID NO: 29141 - protein, 15 aa, Artificial Sequence
  Description of Artificial Sequence: Synthetic peptide
  XENP020930 vlCDR1
KASQSVDYDGDSYMN

SEQ ID NO: 29142 - protein, 7 aa, Artificial Sequence
  Description of Artificial Sequence: Synthetic peptide
  XENP020930 vlCDR2
AASNLES

SEQ ID NO: 29143 - protein, 9 aa, Artificial Sequence
  Description of Artificial Sequence: Synthetic peptide
  XENP020930 vlCDR3
QQSNEDPFT

SEQ ID NO: 29144 - protein, 226 aa, Artificial Sequence
  Description of Artificial Sequence: Synthetic polypeptide
  XENP020931 7G8_H1L0_Fab Heavy Chain
QVQLVQSGAEVKKPGASVKVSCKASGFTFSDAWMDWVRQAPGQGLEWMGEIRTKANNHATYYAEKFQGRVTMTRDDSTSTVYMELSSLRSEDTAVYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29145 - protein, 121 aa, Artificial Sequence; identical to SEQ ID NO: 17596
  Description of Artificial Sequence: Synthetic polypeptide
  VH of XENP020931

SEQ ID NO: 29146 - protein, 5 aa, Artificial Sequence
  Description of Artificial Sequence: Synthetic peptide
  XENP020931 vhCDR1
DAWMD

SEQ ID NO: 29147 - protein, 19 aa, Artificial Sequence
  Description of Artificial Sequence: Synthetic peptide
  XENP020931 vhCDR2
EIRTKANNHATYYAEKFQG

SEQ ID NO: 29148 - protein, 10 aa, Artificial Sequence
  Description of Artificial Sequence: Synthetic peptide
  XENP020931 vhCDR3
LANWDWYFDV

SEQ ID NO: 29149 - protein, 218 aa, Artificial Sequence; identical to SEQ ID NO: 17590
  Description of Artificial Sequence: Synthetic polypeptide
  XENP020931 7G8_H1L0_Fab Light Chain

SEQ ID NO: 29150 - protein, 111 aa, Artificial Sequence; identical to SEQ ID NO: 17591
  Description of Artificial Sequence: Synthetic polypeptide
  VL of XENP020931

SEQ ID NO: 29151 - protein, 15 aa, Artificial Sequence
  Description of Artificial Sequence: Synthetic peptide
  XENP020931 vlCDR1
KASQSVDYDGDSYMN

SEQ ID NO: 29152 - protein, 7 aa, Artificial Sequence
  Description of Artificial Sequence: Synthetic peptide
  XENP020931 vlCDR2
AASNLES

SEQ ID NO: 29153 - protein, 9 aa, Artificial Sequence
  Description of Artificial Sequence: Synthetic peptide
  XENP020931 vlCDR3
QQSNEDPFT

SEQ ID NO: 29154 - protein, 226 aa, Artificial Sequence
  Description of Artificial Sequence: Synthetic polypeptide
  XENP020932 7G8_H2L0_Fab Heavy Chain
EVQLVESGGGLVQPGGSLRLSCAASGFTFSDAWMDWVRQAPGKGLEWVGEIRTKANNHATYYAESVKGRFTISRDDSKSSVYLQMNSLKTEDTAVYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29155 - protein, 121 aa, Artificial Sequence; identical to SEQ ID NO: 17626
  Description of Artificial Sequence: Synthetic polypeptide
  VH of XENP020932

SEQ ID NO: 29156 - protein, 5 aa, Artificial Sequence
  Description of Artificial Sequence: Synthetic peptide
  XENP020932 vhCDR1
DAWMD

SEQ ID NO: 29157 - protein, 19 aa, Artificial Sequence
  Description of Artificial Sequence: Synthetic peptide
  XENP020932 vhCDR2
EIRTKANNHATYYAESVKG

SEQ ID NO: 29158 - protein, 10 aa, Artificial Sequence
  Description of Artificial Sequence: Synthetic peptide
  XENP020932 vhCDR3
LANWDWYFDV

SEQ ID NO: 29159 - protein, 218 aa, Artificial Sequence; identical to SEQ ID NO: 17590
  Description of Artificial Sequence: Synthetic polypeptide
  XENP020932 7G8_H2L0_Fab Light Chain

SEQ ID NO: 29160 - protein, 111 aa, Artificial Sequence; identical to SEQ ID NO: 17591
  Description of Artificial Sequence: Synthetic polypeptide
  VL of XENP020932

SEQ ID NO: 29161 - protein, 15 aa, Artificial Sequence
  Description of Artificial Sequence: Synthetic peptide
  XENP020932 vlCDR1
KASQSVDYDGDSYMN

SEQ ID NO: 29162 - protein, 7 aa, Artificial Sequence
  Description of Artificial Sequence: Synthetic peptide
  XENP020932 vlCDR2
AASNLES

SEQ ID NO: 29163 - protein, 9 aa, Artificial Sequence
  Description of Artificial Sequence: Synthetic peptide
  XENP020932 vlCDR3
QQSNEDPFT

SEQ ID NO: 29164 - protein, 226 aa, Artificial Sequence
  Description of Artificial Sequence: Synthetic polypeptide
  XENP020933 7G8_H0.1_L0_Fab Heavy Chain
EVKLEESGGGLVQPGGSMKLSCAASGYTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29165 - protein, 121 aa, Artificial Sequence; identical to SEQ ID NO: 18216
  Description of Artificial Sequence: Synthetic polypeptide
  VH of XENP020933

SEQ ID NO: 29166 - protein, 5 aa, Artificial Sequence
  Description of Artificial Sequence: Synthetic peptide
  XENP020933 vhCDR1
DAWMD

SEQ ID NO: 29167 - protein, 19 aa, Artificial Sequence
  Description of Artificial Sequence: Synthetic peptide
  XENP020933 vhCDR2
EIRTKANNHATYYAESVKG

SEQ ID NO: 29168 - protein, 10 aa, Artificial Sequence
  Description of Artificial Sequence: Synthetic peptide
  XENP020933 vhCDR3
LANWDWYFDV

SEQ ID NO: 29169 - protein, 218 aa, Artificial Sequence; identical to SEQ ID NO: 17590
  Description of Artificial Sequence: Synthetic polypeptide
  XENP020933 7G8_H0.1_L0_Fab Light Chain

SEQ ID NO: 29170 - protein, 111 aa, Artificial Sequence; identical to SEQ ID NO: 17591
  Description of Artificial Sequence: Synthetic polypeptide
  VL of XENP020933

SEQ ID NO: 29171 - protein, 15 aa, Artificial Sequence
  Description of Artificial Sequence: Synthetic peptide
  XENP020933 vlCDR1
KASQSVDYDGDSYMN

SEQ ID NO: 29172 - protein, 7 aa, Artificial Sequence
  Description of Artificial Sequence: Synthetic peptide
  XENP020933 vlCDR2
AASNLES

SEQ ID NO: 29173 - protein, 9 aa, Artificial Sequence
  Description of Artificial Sequence: Synthetic peptide
  XENP020933 vlCDR3
QQSNEDPFT

SEQ ID NO: 29174 - protein, 226 aa, Artificial Sequence
  Description of Artificial Sequence: Synthetic polypeptide
  XENP020934 7G8_H0.2_L0_Fab Heavy Chain
EVKLEESGGGLVQPGGSMKLSCAASGGTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29175 - protein, 121 aa, Artificial Sequence; identical to SEQ ID NO: 18226
  Description of Artificial Sequence: Synthetic polypeptide
  VH of XENP020934

SEQ ID NO: 29176 - protein, 5 aa, Artificial Sequence
  Description of Artificial Sequence: Synthetic peptide
  XENP020934 vhCDR1
DAWMD

SEQ ID NO: 29177 - protein, 19 aa, Artificial Sequence
  Description of Artificial Sequence: Synthetic peptide
  XENP020934 vhCDR2
EIRTKANNHATYYAESVKG

SEQ ID NO: 29178 - protein, 10 aa, Artificial Sequence
  Description of Artificial Sequence: Synthetic peptide
  XENP020934 vhCDR3
LANWDWYFDV

SEQ ID NO: 29179 - protein, 218 aa, Artificial Sequence; identical to SEQ ID NO: 17590
  Description of Artificial Sequence: Synthetic polypeptide
  XENP020934 7G8_H0.2_L0_Fab Light Chain

SEQ ID NO: 29180 - protein, 111 aa, Artificial Sequence; identical to SEQ ID NO: 17591
  Description of Artificial Sequence: Synthetic polypeptide
  VL of XENP020934

SEQ ID NO: 29181 - protein, 15 aa, Artificial Sequence
  Description of Artificial Sequence: Synthetic peptide
  XENP020934 vlCDR1
KASQSVDYDGDSYMN

SEQ ID NO: 29182 - protein, 7 aa, Artificial Sequence
  Description of Artificial Sequence: Synthetic peptide
  XENP020934 vlCDR2
AASNLES

SEQ ID NO: 29183 - protein, 9 aa, Artificial Sequence
  Description of Artificial Sequence: Synthetic peptide
  XENP020934 vlCDR3
QQSNEDPFT

SEQ ID NO: 29184 - protein, 226 aa, Artificial Sequence
  Description of Artificial Sequence: Synthetic polypeptide
  XENP020935 7G8_H0.3_L0_Fab Heavy Chain
EVKLEESGGGLVQPGGSMKLSCAASGDTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29185 - protein, 121 aa, Artificial Sequence; identical to SEQ ID NO: 18236
  Description of Artificial Sequence: Synthetic polypeptide
  VH of XENP020935

SEQ ID NO: 29186 - protein, 5 aa, Artificial Sequence
  Description of Artificial Sequence: Synthetic peptide
  XENP020935 vhCDR1
DAWMD

SEQ ID NO: 29187 - protein, 19 aa, Artificial Sequence
  Description of Artificial Sequence: Synthetic peptide
  XENP020935 vhCDR2
EIRTKANNHATYYAESVKG

SEQ ID NO: 29188 - protein, 10 aa, Artificial Sequence
  Description of Artificial Sequence: Synthetic peptide
  XENP020935 vhCDR3
LANWDWYFDV

SEQ ID NO: 29189 - protein, 218 aa, Artificial Sequence; identical to SEQ ID NO: 17590
  Description of Artificial Sequence: Synthetic polypeptide
  XENP020935 7G8_H0.3_L0_Fab Light Chain

SEQ ID NO: 29190 - protein, 111 aa, Artificial Sequence; identical to SEQ ID NO: 17591
  Description of Artificial Sequence: Synthetic polypeptide
  VL of XENP020935

SEQ ID NO: 29191 - protein, 15 aa, Artificial Sequence
  Description of Artificial Sequence: Synthetic peptide
  XENP020935 vlCDR1
KASQSVDYDGDSYMN

SEQ ID NO: 29192 - protein, 7 aa, Artificial Sequence
  Description of Artificial Sequence: Synthetic peptide
  XENP020935 vlCDR2
AASNLES

SEQ ID NO: 29193 - protein, 9 aa, Artificial Sequence
  Description of Artificial Sequence: Synthetic peptide
  XENP020935 vlCDR3
QQSNEDPFT

SEQ ID NO: 29194 - protein, 226 aa, Artificial Sequence
  Description of Artificial Sequence: Synthetic polypeptide
  XENP020936 7G8_H0.4_L0_Fab Heavy Chain
EVKLEESGGGLVQPGGSMKLSCAASGFSFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29195 - protein, 121 aa, Artificial Sequence; identical to SEQ ID NO: 18246
  Description of Artificial Sequence: Synthetic polypeptide
  VH of XENP020936

SEQ ID NO: 29196 - protein, 5 aa, Artificial Sequence
  Description of Artificial Sequence: Synthetic peptide
  XENP020936 vhCDR1
DAWMD

SEQ ID NO: 29197 - protein, 19 aa, Artificial Sequence
  Description of Artificial Sequence: Synthetic peptide
  XENP020936 vhCDR2
EIRTKANNHATYYAESVKG

SEQ ID NO: 29198 - protein, 10 aa, Artificial Sequence
  Description of Artificial Sequence: Synthetic peptide
  XENP020936 vhCDR3
LANWDWYFDV

SEQ ID NO: 29199 - protein, 218 aa, Artificial Sequence; identical to SEQ ID NO: 17590
  Description of Artificial Sequence: Synthetic polypeptide
  XENP020936 7G8_H0.4_L0_Fab Light Chain

SEQ ID NO: 29200 - protein, 111 aa, Artificial Sequence; identical to SEQ ID NO: 17591
  Description of Artificial Sequence: Synthetic polypeptide
  VL of XENP020936

SEQ ID NO: 29201 - protein, 15 aa, Artificial Sequence
  Description of Artificial Sequence: Synthetic peptide
  XENP020936 vlCDR1
KASQSVDYDGDSYMN

SEQ ID NO: 29202 - protein, 7 aa, Artificial Sequence
  Description of Artificial Sequence: Synthetic peptide
  XENP020936 vlCDR2
AASNLES

SEQ ID NO: 29203 - protein, 9 aa, Artificial Sequence
  Description of Artificial Sequence: Synthetic peptide
  XENP020936 vlCDR3
QQSNEDPFT

SEQ ID NO: 29204 - protein, 226 aa, Artificial Sequence
  Description of Artificial Sequence: Synthetic polypeptide
  XENP020937 7G8_H0.5_L0_Fab Heavy Chain
EVKLEESGGGLVQPGGSMKLSCAASGFTFTDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29205 - protein, 121 aa, Artificial Sequence; identical to SEQ ID NO: 18256
  Description of Artificial Sequence: Synthetic polypeptide
  VH of XENP020937

SEQ ID NO: 29206 - protein, 5 aa, Artificial Sequence
  Description of Artificial Sequence: Synthetic peptide
  XENP020937 vhCDR1
DAWMD

SEQ ID NO: 29207 - protein, 19 aa, Artificial Sequence
  Description of Artificial Sequence: Synthetic peptide
  XENP020937 vhCDR2
EIRTKANNHATYYAESVKG

SEQ ID NO: 29208 - protein, 10 aa, Artificial Sequence
  Description of Artificial Sequence: Synthetic peptide
  XENP020937 vhCDR3
LANWDWYFDV

SEQ ID NO: 29209 - protein, 218 aa, Artificial Sequence; identical to SEQ ID NO: 17590
  Description of Artificial Sequence: Synthetic polypeptide
  XENP020937 7G8_H0.5_L0_Fab Light Chain

SEQ ID NO: 29210 - protein, 111 aa, Artificial Sequence; identical to SEQ ID NO: 17591
  Description of Artificial Sequence: Synthetic polypeptide
  VL of XENP020937

SEQ ID NO: 29211 - protein, 15 aa, Artificial Sequence
  Description of Artificial Sequence: Synthetic peptide
  XENP020937 vlCDR1
KASQSVDYDGDSYMN

SEQ ID NO: 29212 - protein, 7 aa, Artificial Sequence
  Description of Artificial Sequence: Synthetic peptide
  XENP020937 vlCDR2
AASNLES

SEQ ID NO: 29213 - protein, 9 aa, Artificial Sequence
  Description of Artificial Sequence: Synthetic peptide
  XENP020937 vlCDR3
QQSNEDPFT

SEQ ID NO: 29214 - protein, 226 aa, Artificial Sequence
  Description of Artificial Sequence: Synthetic polypeptide
  XENP020938 7G8_H0.6_L0_Fab Heavy Chain
EVKLEESGGGLVQPGGSMKLSCAASGFTFDDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29215 - protein, 121 aa, Artificial Sequence; identical to SEQ ID NO: 18266
  Description of Artificial Sequence: Synthetic polypeptide
  VH of XENP020938

SEQ ID NO: 29216 - protein, 5 aa, Artificial Sequence
  Description of Artificial Sequence: Synthetic peptide
  XENP020938 vhCDR1
DAWMD

SEQ ID NO: 29217 - protein, 19 aa, Artificial Sequence
  Description of Artificial Sequence: Synthetic peptide
  XENP020938 vhCDR2
EIRTKANNHATYYAESVKG

SEQ ID NO: 29218 - protein, 10 aa, Artificial Sequence
  Description of Artificial Sequence: Synthetic peptide
  XENP020938 vhCDR3
LANWDWYFDV

SEQ ID NO: 29219 - protein, 218 aa, Artificial Sequence; identical to SEQ ID NO: 17590
  Description of Artificial Sequence: Synthetic polypeptide
  XENP020938 7G8_H0.6_L0_Fab Light Chain

SEQ ID NO: 29220 - protein, 111 aa, Artificial Sequence; identical to SEQ ID NO: 17591
  Description of Artificial Sequence: Synthetic polypeptide
  VL of XENP020938

SEQ ID NO: 29221 - protein, 15 aa, Artificial Sequence
  Description of Artificial Sequence: Synthetic peptide
  XENP020938 vlCDR1
KASQSVDYDGDSYMN

SEQ ID NO: 29222 - protein, 7 aa, Artificial Sequence
  Description of Artificial Sequence: Synthetic peptide
  XENP020938 vlCDR2
AASNLES

SEQ ID NO: 29223 - protein, 9 aa, Artificial Sequence
  Description of Artificial Sequence: Synthetic peptide
  XENP020938 vlCDR3
QQSNEDPFT

SEQ ID NO: 29224 - protein, 226 aa, Artificial Sequence
  Description of Artificial Sequence: Synthetic polypeptide
  XENP020939 7G8_H0.7_L0_Fab Heavy Chain
EVKLEESGGGLVQPGGSMKLSCAASGFTFGDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29225 - protein, 121 aa, Artificial Sequence; identical to SEQ ID NO: 18276
  Description of Artificial Sequence: Synthetic polypeptide
  VH of XENP020939

SEQ ID NO: 29226 - protein, 5 aa, Artificial Sequence
  Description of Artificial Sequence: Synthetic peptide
  XENP020939 vhCDR1
DAWMD

SEQ ID NO: 29227 - protein, 19 aa, Artificial Sequence
  Description of Artificial Sequence: Synthetic peptide
  XENP020939 vhCDR2
EIRTKANNHATYYAESVKG

SEQ ID NO: 29228 - protein, 10 aa, Artificial Sequence
  Description of Artificial Sequence: Synthetic peptide
  XENP020939 vhCDR3
LANWDWYFDV

SEQ ID NO: 29229 - protein, 218 aa, Artificial Sequence; identical to SEQ ID NO: 17590
  Description of Artificial Sequence: Synthetic polypeptide
  XENP020939 7G8_H0.7_L0_Fab Light Chain

SEQ ID NO: 29230 - protein, 111 aa, Artificial Sequence; identical to SEQ ID NO: 17591
  Description of Artificial Sequence: Synthetic polypeptide
  VL of XENP020939

SEQ ID NO: 29231 - protein, 15 aa, Artificial Sequence
  Description of Artificial Sequence: Synthetic peptide
  XENP020939 vlCDR1
KASQSVDYDGDSYMN

SEQ ID NO: 29232 - protein, 7 aa, Artificial Sequence
  Description of Artificial Sequence: Synthetic peptide
  XENP020939 vlCDR2
AASNLES

SEQ ID NO: 29233 - protein, 9 aa, Artificial Sequence
  Description of Artificial Sequence: Synthetic peptide
  XENP020939 vlCDR3
QQSNEDPFT

SEQ ID NO: 29234 - protein, 226 aa, Artificial Sequence
  Description of Artificial Sequence: Synthetic polypeptide
  XENP020940 7G8_H0.8_L0_Fab Heavy Chain
EVKLEESGGGLVQPGGSMKLSCAASGFTFSNAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29235 - protein, 121 aa, Artificial Sequence; identical to SEQ ID NO: 18286
  Description of Artificial Sequence: Synthetic polypeptide
  VH of XENP020940

SEQ ID NO: 29236 - protein, 5 aa, Artificial Sequence
  Description of Artificial Sequence: Synthetic peptide
  XENP020940 vhCDR1
NAWMD

SEQ ID NO: 29237 - protein, 19 aa, Artificial Sequence
  Description of Artificial Sequence: Synthetic peptide
  XENP020940 vhCDR2
EIRTKANNHATYYAESVKG

SEQ ID NO: 29238 - protein, 10 aa, Artificial Sequence
  Description of Artificial Sequence: Synthetic peptide
  XENP020940 vhCDR3
LANWDWYFDV

SEQ ID NO: 29239 - protein, 218 aa, Artificial Sequence; identical to SEQ ID NO: 17590
  Description of Artificial Sequence: Synthetic polypeptide
  XENP020940 7G8_H0.8_L0_Fab Light Chain

SEQ ID NO: 29240 - protein, 111 aa, Artificial Sequence; identical to SEQ ID NO: 17591
  Description of Artificial Sequence: Synthetic polypeptide
  VL of XENP020940

SEQ ID NO: 29241 - protein, 15 aa, Artificial Sequence
  Description of Artificial Sequence: Synthetic peptide
  XENP020940 vlCDR1
KASQSVDYDGDSYMN

SEQ ID NO: 29242 - protein, 7 aa, Artificial Sequence
  Description of Artificial Sequence: Synthetic peptide
  XENP020940 vlCDR2
AASNLES

SEQ ID NO: 29243 - protein, 9 aa, Artificial Sequence
  Description of Artificial Sequence: Synthetic peptide
  XENP020940 vlCDR3
QQSNEDPFT

SEQ ID NO: 29244 - protein, 226 aa, Artificial Sequence
  Description of Artificial Sequence: Synthetic polypeptide
  XENP020941 7G8_H0.9_L0_Fab Heavy Chain
EVKLEESGGGLVQPGGSMKLSCAASGFTFSEAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29245 - protein, 121 aa, Artificial Sequence; identical to SEQ ID NO: 18296
  Description of Artificial Sequence: Synthetic polypeptide
  VH of XENP020941

SEQ ID NO: 29246 - protein, 5 aa, Artificial Sequence
  Description of Artificial Sequence: Synthetic peptide
  XENP020941 vhCDR1
EAWMD

SEQ ID NO: 29247 - protein, 19 aa, Artificial Sequence
  Description of Artificial Sequence: Synthetic peptide
  XENP020941 vhCDR2
EIRTKANNHATYYAESVKG

SEQ ID NO: 29248 - protein, 10 aa, Artificial Sequence
  Description of Artificial Sequence: Synthetic peptide
  XENP020941 vhCDR3
LANWDWYFDV

SEQ ID NO: 29249 - protein, 218 aa, Artificial Sequence; identical to SEQ ID NO: 17590
  Description of Artificial Sequence: Synthetic polypeptide
  XENP020941 7G8_H0.9_L0_Fab Light Chain

SEQ ID NO: 29250 - protein, 111 aa, Artificial Sequence; identical to SEQ ID NO: 17591
  Description of Artificial Sequence: Synthetic polypeptide
  VL of XENP020941

SEQ ID NO: 29251 - protein, 15 aa, Artificial Sequence
  Description of Artificial Sequence: Synthetic peptide
  XENP020941 vlCDR1
KASQSVDYDGDSYMN

SEQ ID NO: 29252 - protein, 7 aa, Artificial Sequence
  Description of Artificial Sequence: Synthetic peptide
  XENP020941 vlCDR2
AASNLES

SEQ ID NO: 29253 - protein, 9 aa, Artificial Sequence
  Description of Artificial Sequence: Synthetic peptide
  XENP020941 vlCDR3
QQSNEDPFT

SEQ ID NO: 29254 - protein, 226 aa, Artificial Sequence
  Description of Artificial Sequence: Synthetic polypeptide
  XENP020942 7G8_H0.10_L0_Fab Heavy Chain
EVKLEESGGGLVQPGGSMKLSCAASGFTFSHAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29255 - protein, 121 aa, Artificial Sequence; identical to SEQ ID NO: 18306
  Description of Artificial Sequence: Synthetic polypeptide
  VH of XENP020942

SEQ ID NO: 29256 - protein, 5 aa, Artificial Sequence
  Description of Artificial Sequence: Synthetic peptide
  XENP020942 vhCDR1
HAWMD

SEQ ID NO: 29257 - protein, 19 aa, Artificial Sequence
  Description of Artificial Sequence: Synthetic peptide
  XENP020942 vhCDR2
EIRTKANNHATYYAESVKG

SEQ ID NO: 29258 - protein, 10 aa, Artificial Sequence
  Description of Artificial Sequence: Synthetic peptide
  XENP020942 vhCDR3
LANWDWYFDV

SEQ ID NO: 29259 - protein, 218 aa, Artificial Sequence; identical to SEQ ID NO: 17590
  Description of Artificial Sequence: Synthetic polypeptide
  XENP020942 7G8_H0.10_L0_Fab Light Chain

SEQ ID NO: 29260 - protein, 111 aa, Artificial Sequence; identical to SEQ ID NO: 17591
  Description of Artificial Sequence: Synthetic polypeptide
  VL of XENP020942

SEQ ID NO: 29261 - protein, 15 aa, Artificial Sequence
  Description of Artificial Sequence: Synthetic peptide
  XENP020942 vlCDR1
KASQSVDYDGDSYMN

SEQ ID NO: 29262 - protein, 7 aa, Artificial Sequence
  Description of Artificial Sequence: Synthetic peptide
  XENP020942 vlCDR2
AASNLES

SEQ ID NO: 29263 - protein, 9 aa, Artificial Sequence
  Description of Artificial Sequence: Synthetic peptide
  XENP020942 vlCDR3
QQSNEDPFT

SEQ ID NO: 29264 - protein, 226 aa, Artificial Sequence
  Description of Artificial Sequence: Synthetic polypeptide
  XENP020943 7G8_H0.11_L0_Fab Heavy Chain
EVKLEESGGGLVQPGGSMKLSCAASGFTFSSAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29265 - protein, 121 aa, Artificial Sequence; identical to SEQ ID NO: 18316
  Description of Artificial Sequence: Synthetic polypeptide
  VH of XENP020943

SEQ ID NO: 29266 - protein, 5 aa, Artificial Sequence
  Description of Artificial Sequence: Synthetic peptide
  XENP020943 vhCDR1
SAWMD

SEQ ID NO: 29267 - protein, 19 aa, Artificial Sequence
  Description of Artificial Sequence: Synthetic peptide
  XENP020943 vhCDR2
EIRTKANNHATYYAESVKG

SEQ ID NO: 29268 - protein, 10 aa, Artificial Sequence
  Description of Artificial Sequence: Synthetic peptide
  XENP020943 vhCDR3
LANWDWYFDV

SEQ ID NO: 29269 - protein, 218 aa, Artificial Sequence; identical to SEQ ID NO: 17590
  Description of Artificial Sequence: Synthetic polypeptide
  XENP020943 7G8_H0.11_L0_Fab Light Chain

SEQ ID NO: 29270 - protein, 111 aa, Artificial Sequence; identical to SEQ ID NO: 17591
  Description of Artificial Sequence: Synthetic polypeptide
  VL of XENP020943

SEQ ID NO: 29271 - protein, 15 aa, Artificial Sequence
  Description of Artificial Sequence: Synthetic peptide
  XENP020943 vlCDR1
KASQSVDYDGDSYMN

SEQ ID NO: 29272 - protein, 7 aa, Artificial Sequence
  Description of Artificial Sequence: Synthetic peptide
  XENP020943 vlCDR2
AASNLES

SEQ ID NO: 29273 - protein, 9 aa, Artificial Sequence
  Description of Artificial Sequence: Synthetic peptide
  XENP020943 vlCDR3
QQSNEDPFT

SEQ ID NO: 29274 - protein, 226 aa, Artificial Sequence
  Description of Artificial Sequence: Synthetic polypeptide
  XENP020944 7G8_H0.12_L0_Fab Heavy Chain
EVKLEESGGGLVQPGGSMKLSCAASGFTFSRAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29275 - protein, 121 aa, Artificial Sequence; identical to SEQ ID NO: 18326
  Description of Artificial Sequence: Synthetic polypeptide
  VH of XENP020944

SEQ ID NO: 29276 - protein, 5 aa, Artificial Sequence
  Description of Artificial Sequence: Synthetic peptide
  XENP020944 vhCDR1
RAWMD

SEQ ID NO: 29277 - protein, 19 aa, Artificial Sequence
  Description of Artificial Sequence: Synthetic peptide
  XENP020944 vhCDR2
EIRTKANNHATYYAESVKG

SEQ ID NO: 29278 - protein, 10 aa, Artificial Sequence
  Description of Artificial Sequence: Synthetic peptide
  XENP020944 vhCDR3
LANWDWYFDV

SEQ ID NO: 29279 - protein, 218 aa, Artificial Sequence; identical to SEQ ID NO: 17590
  Description of Artificial Sequence: Synthetic polypeptide
  XENP020944 7G8_H0.12_L0_Fab Light Chain

SEQ ID NO: 29280 - protein, 111 aa, Artificial Sequence; identical to SEQ ID NO: 17591
  Description of Artificial Sequence: Synthetic polypeptide
  VL of XENP020944

SEQ ID NO: 29281 - protein, 15 aa, Artificial Sequence
  Description of Artificial Sequence: Synthetic peptide
  XENP020944 vlCDR1
KASQSVDYDGDSYMN

SEQ ID NO: 29282 - protein, 7 aa, Artificial Sequence
  Description of Artificial Sequence: Synthetic peptide
  XENP020944 vlCDR2
AASNLES

SEQ ID NO: 29283 - protein, 9 aa, Artificial Sequence
  Description of Artificial Sequence: Synthetic peptide
  XENP020944 vlCDR3
QQSNEDPFT

SEQ ID NO: 29284 - protein, 226 aa, Artificial Sequence
  Description of Artificial Sequence: Synthetic polypeptide
  XENP020945 7G8_H0.13_L0_Fab Heavy Chain
EVKLEESGGGLVQPGGSMKLSCAASGFTFSLAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29285 - protein, 121 aa, Artificial Sequence; identical to SEQ ID NO: 18336
  Description of Artificial Sequence: Synthetic polypeptide
  VH of XENP020945

SEQ ID NO: 29286 - protein, 5 aa, Artificial Sequence
  Description of Artificial Sequence: Synthetic peptide
  XENP020945 vhCDR1
LAWMD

SEQ ID NO: 29287 - protein, 19 aa, Artificial Sequence
  Description of Artificial Sequence: Synthetic peptide
  XENP020945 vhCDR2
EIRTKANNHATYYAESVKG

SEQ ID NO: 29288 - protein, 10 aa, Artificial Sequence
  Description of Artificial Sequence: Synthetic peptide
  XENP020945 vhCDR3
LANWDWYFDV

SEQ ID NO: 29289 - protein, 218 aa, Artificial Sequence; identical to SEQ ID NO: 17590
  Description of Artificial Sequence: Synthetic polypeptide
  XENP020945 7G8_H0.13_L0_Fab Light Chain

SEQ ID NO: 29290 - protein, 111 aa, Artificial Sequence; identical to SEQ ID NO: 17591
  Description of Artificial Sequence: Synthetic polypeptide
  VL of XENP020945

SEQ ID NO: 29291 - protein, 15 aa, Artificial Sequence
  Description of Artificial Sequence: Synthetic peptide
  XENP020945 vlCDR1
KASQSVDYDGDSYMN

SEQ ID NO: 29292 - protein, 7 aa, Artificial Sequence
  Description of Artificial Sequence: Synthetic peptide
  XENP020945 vlCDR2
AASNLES

SEQ ID NO: 29293 - protein, 9 aa, Artificial Sequence
  Description of Artificial Sequence: Synthetic peptide
  XENP020945 vlCDR3
QQSNEDPFT

SEQ ID NO: 29294 - protein, 226 aa, Artificial Sequence
  Description of Artificial Sequence: Synthetic polypeptide
  XENP020946 7G8_H0.14_L0_Fab Heavy Chain
EVKLEESGGGLVQPGGSMKLSCAASGFTFSTAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29295 - protein, 121 aa, Artificial Sequence; identical to SEQ ID NO: 18346
  Description of Artificial Sequence: Synthetic polypeptide
  VH of XENP020946

SEQ ID NO: 29296 - protein, 5 aa, Artificial Sequence
  Description of Artificial Sequence: Synthetic peptide
  XENP020946 vhCDR1
TAWMD

SEQ ID NO: 29297 - protein, 19 aa, Artificial Sequence
  Description of Artificial Sequence: Synthetic peptide
  XENP020946 vhCDR2
EIRTKANNHATYYAESVKG

SEQ ID NO: 29298 - protein, 10 aa, Artificial Sequence
  Description of Artificial Sequence: Synthetic peptide
  XENP020946 vhCDR3
LANWDWYFDV

SEQ ID NO: 29299 - protein, 218 aa, Artificial Sequence; identical to SEQ ID NO: 17590
  Description of Artificial Sequence: Synthetic polypeptide
  XENP020946 7G8_H0.14_L0_Fab Light Chain

SEQ ID NO: 29300 - protein, 111 aa, Artificial Sequence; identical to SEQ ID NO: 17591
  Description of Artificial Sequence: Synthetic polypeptide
  VL of XENP020946

SEQ ID NO: 29301 - protein, 15 aa, Artificial Sequence
  Description of Artificial Sequence: Synthetic peptide
  XENP020946 vlCDR1
KASQSVDYDGDSYMN

SEQ ID NO: 29302 - protein, 7 aa, Artificial Sequence
  Description of Artificial Sequence: Synthetic peptide
  XENP020946 vlCDR2
AASNLES

SEQ ID NO: 29303 - protein, 9 aa, Artificial Sequence
  Description of Artificial Sequence: Synthetic peptide
  XENP020946 vlCDR3
QQSNEDPFT

SEQ ID NO: 29304 - protein, 226 aa, Artificial Sequence
  Description of Artificial Sequence: Synthetic polypeptide
  XENP020947 7G8_H0.15_L0_Fab Heavy Chain
EVKLEESGGGLVQPGGSMKLSCAASGFTFSGAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29305 - protein, 121 aa, Artificial Sequence; identical to SEQ ID NO: 18356
  Description of Artificial Sequence: Synthetic polypeptide
  VH of XENP020947

SEQ ID NO: 29306 - protein, 5 aa, Artificial Sequence
  Description of Artificial Sequence: Synthetic peptide
  XENP020947 vhCDR1
GAWMD

SEQ ID NO: 29307 - protein, 19 aa, Artificial Sequence
  Description of Artificial Sequence: Synthetic peptide
  XENP020947 vhCDR2
EIRTKANNHATYYAESVKG

SEQ ID NO: 29308 - protein, 10 aa, Artificial Sequence
  Description of Artificial Sequence: Synthetic peptide
  XENP020947 vhCDR3
LANWDWYFDV

SEQ ID NO: 29309 - protein, 218 aa, Artificial Sequence; identical to SEQ ID NO: 17590
  Description of Artificial Sequence: Synthetic polypeptide
  XENP020947 7G8_H0.15_L0_Fab Light Chain

SEQ ID NO: 29310 - protein, 111 aa, Artificial Sequence; identical to SEQ ID NO: 17591
  Description of Artificial Sequence: Synthetic polypeptide
  VL of XENP020947

SEQ ID NO: 29311 - protein, 15 aa, Artificial Sequence
  Description of Artificial Sequence: Synthetic peptide
  XENP020947 vlCDR1
KASQSVDYDGDSYMN

SEQ ID NO: 29312 - protein, 7 aa, Artificial Sequence
  Description of Artificial Sequence: Synthetic peptide
  XENP020947 vlCDR2
AASNLES

SEQ ID NO: 29313 - protein, 9 aa, Artificial Sequence
  Description of Artificial Sequence: Synthetic peptide
  XENP020947 vlCDR3
QQSNEDPFT

SEQ ID NO: 29314 - protein, 226 aa, Artificial Sequence
  Description of Artificial Sequence: Synthetic polypeptide
  XENP020948 7G8_H0.17_L0_Fab Heavy Chain
EVKLEESGGGLVQPGGSMKLSCAASGFTFSDSWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29315 - protein, 121 aa, Artificial Sequence; identical to SEQ ID NO: 18376
  Description of Artificial Sequence: Synthetic polypeptide
  VH of XENP020948

SEQ ID NO: 29316 - protein, 5 aa, Artificial Sequence
  Description of Artificial Sequence: Synthetic peptide
  XENP020948 vhCDR1
DSWMD

SEQ ID NO: 29317 - protein, 19 aa, Artificial Sequence
  Description of Artificial Sequence: Synthetic peptide
  XENP020948 vhCDR2
EIRTKANNHATYYAESVKG

SEQ ID NO: 29318 - protein, 10 aa, Artificial Sequence
  Description of Artificial Sequence: Synthetic peptide
  XENP020948 vhCDR3
LANWDWYFDV

SEQ ID NO: 29319 - protein, 218 aa, Artificial Sequence; identical to SEQ ID NO: 17590
  Description of Artificial Sequence: Synthetic polypeptide
  XENP020948 7G8_H0.17_L0_Fab Light Chain

SEQ ID NO: 29320 - protein, 111 aa, Artificial Sequence; identical to SEQ ID NO: 17591
  Description of Artificial Sequence: Synthetic polypeptide
  VL of XENP020948

SEQ ID NO: 29321 - protein, 15 aa, Artificial Sequence
  Description of Artificial Sequence: Synthetic peptide
  XENP020948 vlCDR1
KASQSVDYDGDSYMN

SEQ ID NO: 29322 - protein, 7 aa, Artificial Sequence
  Description of Artificial Sequence: Synthetic peptide
  XENP020948 vlCDR2
AASNLES

SEQ ID NO: 29323 - protein, 9 aa, Artificial Sequence
  Description of Artificial Sequence: Synthetic peptide
  XENP020948 vlCDR3
QQSNEDPFT

SEQ ID NO: 29324 - protein, 226 aa, Artificial Sequence
  Description of Artificial Sequence: Synthetic polypeptide
  XENP020949 7G8_H0.18_L0_Fab Heavy Chain
EVKLEESGGGLVQPGGSMKLSCAASGFTFSDTWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29325 - protein, 121 aa, Artificial Sequence; identical to SEQ ID NO: 18386
  Description of Artificial Sequence: Synthetic polypeptide
  VH of XENP020949

SEQ ID NO: 29326 - protein, 5 aa, Artificial Sequence
  Description of Artificial Sequence: Synthetic peptide
  XENP020949 vhCDR1
DTWMD

SEQ ID NO: 29327 - protein, 19 aa, Artificial Sequence
  Description of Artificial Sequence: Synthetic peptide
  XENP020949 vhCDR2
EIRTKANNHATYYAESVKG

SEQ ID NO: 29328 - protein, 10 aa, Artificial Sequence
  Description of Artificial Sequence: Synthetic peptide
  XENP020949 vhCDR3
LANWDWYFDV

SEQ ID NO: 29329 - protein, 218 aa, Artificial Sequence; identical to SEQ ID NO: 17590
  Description of Artificial Sequence: Synthetic polypeptide
  XENP020949 7G8_H0.18_L0_Fab Light Chain

SEQ ID NO: 29330 - protein, 111 aa, Artificial Sequence; identical to SEQ ID NO: 17591
  Description of Artificial Sequence: Synthetic polypeptide
  VL of XENP020949

SEQ ID NO: 29331 - protein, 15 aa, Artificial Sequence
  Description of Artificial Sequence: Synthetic peptide
  XENP020949 vlCDR1
KASQSVDYDGDSYMN

SEQ ID NO: 29332 - protein, 7 aa, Artificial Sequence
  Description of Artificial Sequence: Synthetic peptide
  XENP020949 vlCDR2
AASNLES

SEQ ID NO: 29333 - protein, 9 aa, Artificial Sequence
  Description of Artificial Sequence: Synthetic peptide
  XENP020949 vlCDR3
QQSNEDPFT

SEQ ID NO: 29334 - protein, 226 aa, Artificial Sequence
  Description of Artificial Sequence: Synthetic polypeptide
  XENP020950 7G8_H0.19_L0_Fab Heavy Chain
EVKLEESGGGLVQPGGSMKLSCAASGFTFSDGWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29335 - protein, 121 aa, Artificial Sequence; identical to SEQ ID NO: 18396
  Description of Artificial Sequence: Synthetic polypeptide
  VH of XENP020950

SEQ ID NO: 29336 - protein, 5 aa, Artificial Sequence
  Description of Artificial Sequence: Synthetic peptide
  XENP020950 vhCDR1
DGWMD

SEQ ID NO: 29337 - protein, 19 aa, Artificial Sequence
  Description of Artificial Sequence: Synthetic peptide
  XENP020950 vhCDR2
EIRTKANNHATYYAESVKG

SEQ ID NO: 29338 - protein, 10 aa, Artificial Sequence
  Description of Artificial Sequence: Synthetic peptide
  XENP020950 vhCDR3
LANWDWYFDV

SEQ ID NO: 29339 - protein, 218 aa, Artificial Sequence; identical to SEQ ID NO: 17590
  Description of Artificial Sequence: Synthetic polypeptide
  XENP020950 7G8_H0.19_L0_Fab Light Chain

SEQ ID NO: 29340 - protein, 111 aa, Artificial Sequence; identical to SEQ ID NO: 17591
  Description of Artificial Sequence: Synthetic polypeptide
  VL of XENP020950

SEQ ID NO: 29341 - protein, 15 aa, Artificial Sequence
  Description of Artificial Sequence: Synthetic peptide
  XENP020950 vlCDR1
KASQSVDYDGDSYMN

SEQ ID NO: 29342 - protein, 7 aa, Artificial Sequence
  Description of Artificial Sequence: Synthetic peptide
  XENP020950 vlCDR2
AASNLES

SEQ ID NO: 29343 - protein, 9 aa, Artificial Sequence
  Description of Artificial Sequence: Synthetic peptide
  XENP020950 vlCDR3
QQSNEDPFT

SEQ ID NO: 29344 - protein, 226 aa, Artificial Sequence
  Description of Artificial Sequence: Synthetic polypeptide
  XENP020951 7G8_H0.20_L0_Fab Heavy Chain
EVKLEESGGGLVQPGGSMKLSCAASGFTFSDHWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29345 - protein, 121 aa, Artificial Sequence; identical to SEQ ID NO: 18406
  Description of Artificial Sequence: Synthetic polypeptide
  VH of XENP020951

SEQ ID NO: 29346 - protein, 5 aa, Artificial Sequence
  Description of Artificial Sequence: Synthetic peptide
  XENP020951 vhCDR1
DHWMD

SEQ ID NO: 29347 - protein, 19 aa, Artificial Sequence
  Description of Artificial Sequence: Synthetic peptide
  XENP020951 vhCDR2
EIRTKANNHATYYAESVKG

SEQ ID NO: 29348 - protein, 10 aa, Artificial Sequence
  Description of Artificial Sequence: Synthetic peptide
  XENP020951 vhCDR3
LANWDWYFDV

SEQ ID NO: 29349 - protein, 218 aa, Artificial Sequence; identical to SEQ ID NO: 17590
  Description of Artificial Sequence: Synthetic polypeptide
  XENP020951 7G8_H0.20_L0_Fab Light Chain

SEQ ID NO: 29350 - protein, 111 aa, Artificial Sequence; identical to SEQ ID NO: 17591
  Description of Artificial Sequence: Synthetic polypeptide
  VL of XENP020951

SEQ ID NO: 29351 - protein, 15 aa, Artificial Sequence
  Description of Artificial Sequence: Synthetic peptide
  XENP020951 vlCDR1
KASQSVDYDGDSYMN

SEQ ID NO: 29352 - protein, 7 aa, Artificial Sequence
  Description of Artificial Sequence: Synthetic peptide
  XENP020951 vlCDR2
AASNLES

SEQ ID NO: 29353 - protein, 9 aa, Artificial Sequence
  Description of Artificial Sequence: Synthetic peptide
  XENP020951 vlCDR3
QQSNEDPFT

SEQ ID NO: 29354 - protein, 226 aa, Artificial Sequence
  Description of Artificial Sequence: Synthetic polypeptide
  XENP020952 7G8_H0.21_L0_Fab Heavy Chain
EVKLEESGGGLVQPGGSMKLSCAASGFTFSDDWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29355 - protein, 121 aa, Artificial Sequence; identical to SEQ ID NO: 18416
  Description of Artificial Sequence: Synthetic polypeptide
  VH of XENP020952

SEQ ID NO: 29356 - protein, 5 aa, Artificial Sequence
  Description of Artificial Sequence: Synthetic peptide
  XENP020952 vhCDR1
DDWMD

SEQ ID NO: 29357 - protein, 19 aa, Artificial Sequence
  Description of Artificial Sequence: Synthetic peptide
  XENP020952 vhCDR2
EIRTKANNHATYYAESVKG

SEQ ID NO: 29358 - protein, 10 aa, Artificial Sequence
  Description of Artificial Sequence: Synthetic peptide
  XENP020952 vhCDR3
LANWDWYFDV

SEQ ID NO: 29359 - protein, 218 aa, Artificial Sequence; identical to SEQ ID NO: 17590
  Description of Artificial Sequence: Synthetic polypeptide
  XENP020952 7G8_H0.21_L0_Fab Light Chain

SEQ ID NO: 29360 - protein, 111 aa, Artificial Sequence; identical to SEQ ID NO: 17591
  Description of Artificial Sequence: Synthetic polypeptide
  VL of XENP020952

SEQ ID NO: 29361 - protein, 15 aa, Artificial Sequence
  Description of Artificial Sequence: Synthetic peptide
  XENP020952 vlCDR1
KASQSVDYDGDSYMN

SEQ ID NO: 29362 - protein, 7 aa, Artificial Sequence
  Description of Artificial Sequence: Synthetic peptide
  XENP020952 vlCDR2
AASNLES

SEQ ID NO: 29363 - protein, 9 aa, Artificial Sequence
  Description of Artificial Sequence: Synthetic peptide
  XENP020952 vlCDR3
QQSNEDPFT

SEQ ID NO: 29364 - protein, 226 aa, Artificial Sequence
  Description of Artificial Sequence: Synthetic polypeptide
  XENP020953 7G8_H0.22_L0_Fab Heavy Chain
EVKLEESGGGLVQPGGSMKLSCAASGFTFSDLWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29365 - protein, 121 aa, Artificial Sequence; identical to SEQ ID NO: 18426
  Description of Artificial Sequence: Synthetic polypeptide
  VH of XENP020953

SEQ ID NO: 29366 - protein, 5 aa, Artificial Sequence
  Description of Artificial Sequence: Synthetic peptide
  XENP020953 vhCDR1
DLWMD

SEQ ID NO: 29367 - protein, 19 aa, Artificial Sequence
  Description of Artificial Sequence: Synthetic peptide
  XENP020953 vhCDR2
EIRTKANNHATYYAESVKG

SEQ ID NO: 29368 - protein, 10 aa, Artificial Sequence
  Description of Artificial Sequence: Synthetic peptide
  XENP020953 vhCDR3
LANWDWYFDV

SEQ ID NO: 29369 - protein, 218 aa, Artificial Sequence; identical to SEQ ID NO: 17590
  Description of Artificial Sequence: Synthetic polypeptide
  XENP020953 7G8_H0.22_L0_Fab Light Chain

SEQ ID NO: 29370 - protein, 111 aa, Artificial Sequence; identical to SEQ ID NO: 17591
  Description of Artificial Sequence: Synthetic polypeptide
  VL of XENP020953

SEQ ID NO: 29371 - protein, 15 aa, Artificial Sequence
  Description of Artificial Sequence: Synthetic peptide
  XENP020953 vlCDR1
KASQSVDYDGDSYMN

SEQ ID NO: 29372 - protein, 7 aa, Artificial Sequence
  Description of Artificial Sequence: Synthetic peptide
  XENP020953 vlCDR2
AASNLES

SEQ ID NO: 29373 - protein, 9 aa, Artificial Sequence
  Description of Artificial Sequence: Synthetic peptide
  XENP020953 vlCDR3
QQSNEDPFT

SEQ ID NO: 29374 - protein, 226 aa, Artificial Sequence
  Description of Artificial Sequence: Synthetic polypeptide
  XENP020954 7G8_H0.23_L0_Fab Heavy Chain
EVKLEESGGGLVQPGGSMKLSCAASGFTFSDKWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29375 - protein, 121 aa, Artificial Sequence; identical to SEQ ID NO: 18436
  Description of Artificial Sequence: Synthetic polypeptide
  VH of XENP020954

SEQ ID NO: 29376 - protein, 5 aa, Artificial Sequence
  Description of Artificial Sequence: Synthetic peptide
  XENP020954 vhCDR1
DKWMD

SEQ ID NO: 29377 - protein, 19 aa, Artificial Sequence
  Description of Artificial Sequence: Synthetic peptide
  XENP020954 vhCDR2
EIRTKANNHATYYAESVKG

SEQ ID NO: 29378 - protein, 10 aa, Artificial Sequence
  Description of Artificial Sequence: Synthetic peptide
  XENP020954 vhCDR3
LANWDWYFDV

SEQ ID NO: 29379 - protein, 218 aa, Artificial Sequence; identical to SEQ ID NO: 17590
  Description of Artificial Sequence: Synthetic polypeptide
  XENP020954 7G8_H0.23_L0_Fab Light Chain

SEQ ID NO: 29380 - protein, 111 aa, Artificial Sequence; identical to SEQ ID NO: 17591
  Description of Artificial Sequence: Synthetic polypeptide
  VL of XENP020954

SEQ ID NO: 29381 - protein, 15 aa, Artificial Sequence
  Description of Artificial Sequence: Synthetic peptide
  XENP020954 vlCDR1
KASQSVDYDGDSYMN

SEQ ID NO: 29382 - protein, 7 aa, Artificial Sequence
  Description of Artificial Sequence: Synthetic peptide
  XENP020954 vlCDR2
AASNLES

SEQ ID NO: 29383 - protein, 9 aa, Artificial Sequence
  Description of Artificial Sequence: Synthetic peptide
  XENP020954 vlCDR3
QQSNEDPFT

SEQ ID NO: 29384 - protein, 226 aa, Artificial Sequence
  Description of Artificial Sequence: Synthetic polypeptide
  XENP020955 7G8_H0.24_L0_Fab Heavy Chain
EVKLEESGGGLVQPGGSMKLSCAASGFTFSDYWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29385 - protein, 121 aa, Artificial Sequence; identical to SEQ ID NO: 18446
  Description of Artificial Sequence: Synthetic polypeptide
  VH of XENP020955

SEQ ID NO: 29386 - protein, 5 aa, Artificial Sequence
  Description of Artificial Sequence: Synthetic peptide
  XENP020955 vhCDR1
DYWMD

SEQ ID NO: 29387 - protein, 19 aa, Artificial Sequence
  Description of Artificial Sequence: Synthetic peptide
  XENP020955 vhCDR2
EIRTKANNHATYYAESVKG

SEQ ID NO: 29388 - protein, 10 aa, Artificial Sequence
  Description of Artificial Sequence: Synthetic peptide
  XENP020955 vhCDR3
LANWDWYFDV

SEQ ID NO: 29389 - protein, 218 aa, Artificial Sequence; identical to SEQ ID NO: 17590
  Description of Artificial Sequence: Synthetic polypeptide
  XENP020955 7G8_H0.24_L0_Fab Light Chain

SEQ ID NO: 29390 - protein, 111 aa, Artificial Sequence; identical to SEQ ID NO: 17591
  Description of Artificial Sequence: Synthetic polypeptide
  VL of XENP020955

SEQ ID NO: 29391 - protein, 15 aa, Artificial Sequence
  Description of Artificial Sequence: Synthetic peptide
  XENP020955 vlCDR1
KASQSVDYDGDSYMN

SEQ ID NO: 29392 - protein, 7 aa, Artificial Sequence
  Description of Artificial Sequence: Synthetic peptide
  XENP020955 vlCDR2
AASNLES

SEQ ID NO: 29393 - protein, 9 aa, Artificial Sequence
  Description of Artificial Sequence: Synthetic peptide
  XENP020955 vlCDR3
QQSNEDPFT

SEQ ID NO: 29394 - protein, 226 aa, Artificial Sequence
  Description of Artificial Sequence: Synthetic polypeptide
  XENP020956 7G8_H0.25_L0_Fab Heavy Chain
EVKLEESGGGLVQPGGSMKLSCAASGFTFSDAYMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29395 - protein, 121 aa, Artificial Sequence; identical to SEQ ID NO: 18456
  Description of Artificial Sequence: Synthetic polypeptide
  VH of XENP020956

SEQ ID NO: 29396 - protein, 5 aa, Artificial Sequence
  Description of Artificial Sequence: Synthetic peptide
  XENP020956 vhCDR1
DAYMD

SEQ ID NO: 29397 - protein, 19 aa, Artificial Sequence
  Description of Artificial Sequence: Synthetic peptide
  XENP020956 vhCDR2
EIRTKANNHATYYAESVKG

SEQ ID NO: 29398 - protein, 10 aa, Artificial Sequence
  Description of Artificial Sequence: Synthetic peptide
  XENP020956 vhCDR3
LANWDWYFDV

SEQ ID NO: 29399 - protein, 218 aa, Artificial Sequence; identical to SEQ ID NO: 17590
  Description of Artificial Sequence: Synthetic polypeptide
  XENP020956 7G8_H0.25_L0_Fab Light Chain

SEQ ID NO: 29400 - protein, 111 aa, Artificial Sequence; identical to SEQ ID NO: 17591
  Description of Artificial Sequence: Synthetic polypeptide
  VL of XENP020956

SEQ ID NO: 29401 - protein, 15 aa, Artificial Sequence
  Description of Artificial Sequence: Synthetic peptide
  XENP020956 vlCDR1
KASQSVDYDGDSYMN

SEQ ID NO: 29402 - protein, 7 aa, Artificial Sequence
  Description of Artificial Sequence: Synthetic peptide
  XENP020956 vlCDR2
AASNLES

SEQ ID NO: 29403 - protein, 9 aa, Artificial Sequence
  Description of Artificial Sequence: Synthetic peptide
  XENP020956 vlCDR3
QQSNEDPFT

SEQ ID NO: 29404 - protein, 226 aa, Artificial Sequence
  Description of Artificial Sequence: Synthetic polypeptide
  XENP020957 7G8_H0.26_L0_Fab Heavy Chain
EVKLEESGGGLVQPGGSMKLSCAASGFTFSDAFMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29405 - protein, 121 aa, Artificial Sequence; identical to SEQ ID NO: 18466
  Description of Artificial Sequence: Synthetic polypeptide
  VH of XENP020957

SEQ ID NO: 29406 - protein, 5 aa, Artificial Sequence
  Description of Artificial Sequence: Synthetic peptide
  XENP020957 vhCDR1
DAFMD

SEQ ID NO: 29407 - protein, 19 aa, Artificial Sequence
  Description of Artificial Sequence: Synthetic peptide
  XENP020957 vhCDR2
EIRTKANNHATYYAESVKG

SEQ ID NO: 29408 - protein, 10 aa, Artificial Sequence
  Description of Artificial Sequence: Synthetic peptide
  XENP020957 vhCDR3
LANWDWYFDV

SEQ ID NO: 29409 - protein, 218 aa, Artificial Sequence; identical to SEQ ID NO: 17590
  Description of Artificial Sequence: Synthetic polypeptide
  XENP020957 7G8_H0.26_L0_Fab Light Chain

SEQ ID NO: 29410 - protein, 111 aa, Artificial Sequence; identical to SEQ ID NO: 17591
  Description of Artificial Sequence: Synthetic polypeptide
  VL of XENP020957

SEQ ID NO: 29411 - protein, 15 aa, Artificial Sequence
  Description of Artificial Sequence: Synthetic peptide
  XENP020957 vlCDR1
KASQSVDYDGDSYMN

SEQ ID NO: 29412 - protein, 7 aa, Artificial Sequence
  Description of Artificial Sequence: Synthetic peptide
  XENP020957 vlCDR2
AASNLES

SEQ ID NO: 29413 - protein, 9 aa, Artificial Sequence
  Description of Artificial Sequence: Synthetic peptide
  XENP020957 vlCDR3
QQSNEDPFT

SEQ ID NO: 29414 - protein, 226 aa, Artificial Sequence
  Description of Artificial Sequence: Synthetic polypeptide
  XENP020958 7G8_H0.27_L0_Fab Heavy Chain
EVKLEESGGGLVQPGGSMKLSCAASGFTFSDAWMDWVRQSPEKGLEWVAEIKTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29415 - protein, 121 aa, Artificial Sequence; identical to SEQ ID NO: 18476
  Description of Artificial Sequence: Synthetic polypeptide
  VH of XENP020958

SEQ ID NO: 29416 - protein, 5 aa, Artificial Sequence
  Description of Artificial Sequence: Synthetic peptide
  XENP020958 vhCDR1
DAWMD

SEQ ID NO: 29417 - protein, 19 aa, Artificial Sequence
  Description of Artificial Sequence: Synthetic peptide
  XENP020958 vhCDR2
EIKTKANNHATYYAESVKG

SEQ ID NO: 29418 - protein, 10 aa, Artificial Sequence
  Description of Artificial Sequence: Synthetic peptide
  XENP020958 vhCDR3
LANWDWYFDV

SEQ ID NO: 29419 - protein, 218 aa, Artificial Sequence; identical to SEQ ID NO: 17590
  Description of Artificial Sequence: Synthetic polypeptide
  XENP020958 7G8_H0.27_L0_Fab Light Chain

SEQ ID NO: 29420 - protein, 111 aa, Artificial Sequence; identical to SEQ ID NO: 17591
  Description of Artificial Sequence: Synthetic polypeptide
  VL of XENP020958

SEQ ID NO: 29421 - protein, 15 aa, Artificial Sequence
  Description of Artificial Sequence: Synthetic peptide
  XENP020958 vlCDR1
KASQSVDYDGDSYMN

SEQ ID NO: 29422 - protein, 7 aa, Artificial Sequence
  Description of Artificial Sequence: Synthetic peptide
  XENP020958 vlCDR2
AASNLES

SEQ ID NO: 29423 - protein, 9 aa, Artificial Sequence
  Description of Artificial Sequence: Synthetic peptide
  XENP020958 vlCDR3
QQSNEDPFT

SEQ ID NO: 29424 - protein, 226 aa, Artificial Sequence
  Description of Artificial Sequence: Synthetic polypeptide
  XENP020959 7G8_H0.28_L0_Fab Heavy Chain
EVKLEESGGGLVQPGGSMKLSCAASGFTFSDAWMDWVRQSPEKGLEWVAEIETKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29425 - protein, 121 aa, Artificial Sequence; identical to SEQ ID NO: 18486
  Description of Artificial Sequence: Synthetic polypeptide
  VH of XENP020959

SEQ ID NO: 29426 - protein, 5 aa, Artificial Sequence
  Description of Artificial Sequence: Synthetic peptide
  XENP020959 vhCDR1
DAWMD

SEQ ID NO: 29427 - protein, 19 aa, Artificial Sequence
  Description of Artificial Sequence: Synthetic peptide
  XENP020959 vhCDR2
EIETKANNHATYYAESVKG

SEQ ID NO: 29428 - protein, 10 aa, Artificial Sequence
  Description of Artificial Sequence: Synthetic peptide
  XENP020959 vhCDR3
LANWDWYFDV

SEQ ID NO: 29429 - protein, 218 aa, Artificial Sequence; identical to SEQ ID NO: 17590
  Description of Artificial Sequence: Synthetic polypeptide
  XENP020959 7G8_H0.28_L0_Fab Light Chain

SEQ ID NO: 29430 - protein, 111 aa, Artificial Sequence; identical to SEQ ID NO: 17591
  Description of Artificial Sequence: Synthetic polypeptide
  VL of XENP020959

SEQ ID NO: 29431 - protein, 15 aa, Artificial Sequence
  Description of Artificial Sequence: Synthetic peptide
  XENP020959 vlCDR1
KASQSVDYDGDSYMN

SEQ ID NO: 29432 - protein, 7 aa, Artificial Sequence
  Description of Artificial Sequence: Synthetic peptide
  XENP020959 vlCDR2
AASNLES

SEQ ID NO: 29433 - protein, 9 aa, Artificial Sequence
  Description of Artificial Sequence: Synthetic peptide
  XENP020959 vlCDR3
QQSNEDPFT

SEQ ID NO: 29434 - protein, 226 aa, Artificial Sequence
  Description of Artificial Sequence: Synthetic polypeptide
  XENP020960 7G8_H0.29_L0_Fab Heavy Chain
EVKLEESGGGLVQPGGSMKLSCAASGFTFSDAWMDWVRQSPEKGLEWVAEIDTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29435 - protein, 121 aa, Artificial Sequence; identical to SEQ ID NO: 18496
  Description of Artificial Sequence: Synthetic polypeptide
  VH of XENP020960

SEQ ID NO: 29436 - protein, 5 aa, Artificial Sequence
  Description of Artificial Sequence: Synthetic peptide
  XENP020960 vhCDR1
DAWMD

SEQ ID NO: 29437 - protein, 19 aa, Artificial Sequence
  Description of Artificial Sequence: Synthetic peptide
  XENP020960 vhCDR2
EIDTKANNHATYYAESVKG

SEQ ID NO: 29438 - protein, 10 aa, Artificial Sequence
  Description of Artificial Sequence: Synthetic peptide
  XENP020960 vhCDR3
LANWDWYFDV

SEQ ID NO: 29439 - protein, 218 aa, Artificial Sequence; identical to SEQ ID NO: 17590
  Description of Artificial Sequence: Synthetic polypeptide
  XENP020960 7G8_H0.29_L0_Fab Light Chain

SEQ ID NO: 29440 - protein, 111 aa, Artificial Sequence; identical to SEQ ID NO: 17591
  Description of Artificial Sequence: Synthetic polypeptide
  VL of XENP020960

SEQ ID NO: 29441 - protein, 15 aa, Artificial Sequence
  Description of Artificial Sequence: Synthetic peptide
  XENP020960 vlCDR1
KASQSVDYDGDSYMN

SEQ ID NO: 29442 - protein, 7 aa, Artificial Sequence
  Description of Artificial Sequence: Synthetic peptide
  XENP020960 vlCDR2
AASNLES

SEQ ID NO: 29443 - protein, 9 aa, Artificial Sequence
  Description of Artificial Sequence: Synthetic peptide
  XENP020960 vlCDR3
QQSNEDPFT

SEQ ID NO: 29444 - protein, 226 aa, Artificial Sequence
  Description of Artificial Sequence: Synthetic polypeptide
  XENP020961 7G8_H0.30_L0_Fab Heavy Chain
EVKLEESGGGLVQPGGSMKLSCAASGFTFSDAWMDWVRQSPEKGLEWVAEIHTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29445 - protein, 121 aa, Artificial Sequence; identical to SEQ ID NO: 18506
  Description of Artificial Sequence: Synthetic polypeptide
  VH of XENP020961

SEQ ID NO: 29446 - protein, 5 aa, Artificial Sequence
  Description of Artificial Sequence: Synthetic peptide
  XENP020961 vhCDR1
DAWMD

SEQ ID NO: 29447 - protein, 19 aa, Artificial Sequence
  Description of Artificial Sequence: Synthetic peptide
  XENP020961 vhCDR2
EIHTKANNHATYYAESVKG

SEQ ID NO: 29448 - protein, 10 aa, Artificial Sequence
  Description of Artificial Sequence: Synthetic peptide
  XENP020961 vhCDR3
LANWDWYFDV

SEQ ID NO: 29449 - protein, 218 aa, Artificial Sequence; identical to SEQ ID NO: 17590
  Description of Artificial Sequence: Synthetic polypeptide
  XENP020961 7G8_H0.30_L0_Fab Light Chain

SEQ ID NO: 29450 - protein, 111 aa, Artificial Sequence; identical to SEQ ID NO: 17591
  Description of Artificial Sequence: Synthetic polypeptide
  VL of XENP020961

SEQ ID NO: 29451 - protein, 15 aa, Artificial Sequence
  Description of Artificial Sequence: Synthetic peptide
  XENP020961 vlCDR1
KASQSVDYDGDSYMN

SEQ ID NO: 29452 - protein, 7 aa, Artificial Sequence
  Description of Artificial Sequence: Synthetic peptide
  XENP020961 vlCDR2
AASNLES

SEQ ID NO: 29453 - protein, 9 aa, Artificial Sequence
  Description of Artificial Sequence: Synthetic peptide
  XENP020961 vlCDR3
QQSNEDPFT

SEQ ID NO: 29454 - protein, 226 aa, Artificial Sequence
  Description of Artificial Sequence: Synthetic polypeptide
  XENP020962 7G8_H0.31_L0_Fab Heavy Chain
EVKLEESGGGLVQPGGSMKLSCAASGFTFSDAWMDWVRQSPEKGLEWVAEISTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29455 - protein, 121 aa, Artificial Sequence; identical to SEQ ID NO: 18516
  Description of Artificial Sequence: Synthetic polypeptide
  VH of XENP020962

SEQ ID NO: 29456 - protein, 5 aa, Artificial Sequence
  Description of Artificial Sequence: Synthetic peptide
  XENP020962 vhCDR1
DAWMD

SEQ ID NO: 29457 - protein, 19 aa, Artificial Sequence
  Description of Artificial Sequence: Synthetic peptide
  XENP020962 vhCDR2
EISTKANNHATYYAESVKG

SEQ ID NO: 29458 - protein, 10 aa, Artificial Sequence
  Description of Artificial Sequence: Synthetic peptide
  XENP020962 vhCDR3
LANWDWYFDV

SEQ ID NO: 29459 - protein, 218 aa, Artificial Sequence; identical to SEQ ID NO: 17590
  Description of Artificial Sequence: Synthetic polypeptide
  XENP020962 7G8_H0.31_L0_Fab Light Chain

SEQ ID NO: 29460 - protein, 111 aa, Artificial Sequence; identical to SEQ ID NO: 17591
  Description of Artificial Sequence: Synthetic polypeptide
  VL of XENP020962

SEQ ID NO: 29461 - protein, 15 aa, Artificial Sequence
  Description of Artificial Sequence: Synthetic peptide
  XENP020962 vlCDR1
KASQSVDYDGDSYMN

SEQ ID NO: 29462 - protein, 7 aa, Artificial Sequence
  Description of Artificial Sequence: Synthetic peptide
  XENP020962 vlCDR2
AASNLES

SEQ ID NO: 29463 - protein, 9 aa, Artificial Sequence
  Description of Artificial Sequence: Synthetic peptide
  XENP020962 vlCDR3
QQSNEDPFT

SEQ ID NO: 29464 - protein, 226 aa, Artificial Sequence
  Description of Artificial Sequence: Synthetic polypeptide
  XENP020963 7G8_H0.32_L0_Fab Heavy Chain
EVKLEESGGGLVQPGGSMKLSCAASGFTFSDAWMDWVRQSPEKGLEWVAEIGTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29465 - protein, 121 aa, Artificial Sequence; identical to SEQ ID NO: 18526
  Description of Artificial Sequence: Synthetic polypeptide
  VH of XENP020963

SEQ ID NO: 29466 - protein, 5 aa, Artificial Sequence
  Description of Artificial Sequence: Synthetic peptide
  XENP020963 vhCDR1
DAWMD

SEQ ID NO: 29467 - protein, 19 aa, Artificial Sequence
  Description of Artificial Sequence: Synthetic peptide
  XENP020963 vhCDR2
EIGTKANNHATYYAESVKG

SEQ ID NO: 29468 - protein, 10 aa, Artificial Sequence
  Description of Artificial Sequence: Synthetic peptide
  XENP020963 vhCDR3
LANWDWYFDV

SEQ ID NO: 29469 - protein, 218 aa, Artificial Sequence; identical to SEQ ID NO: 17590
  Description of Artificial Sequence: Synthetic polypeptide
  XENP020963 7G8_H0.32_L0_Fab Light Chain

SEQ ID NO: 29470 - protein, 111 aa, Artificial Sequence; identical to SEQ ID NO: 17591
  Description of Artificial Sequence: Synthetic polypeptide
  VL of XENP020963

SEQ ID NO: 29471 - protein, 15 aa, Artificial Sequence
  Description of Artificial Sequence: Synthetic peptide
  XENP020963 vlCDR1
KASQSVDYDGDSYMN

SEQ ID NO: 29472 - protein, 7 aa, Artificial Sequence
  Description of Artificial Sequence: Synthetic peptide
  XENP020963 vlCDR2
AASNLES

SEQ ID NO: 29473 - protein, 9 aa, Artificial Sequence
  Description of Artificial Sequence: Synthetic peptide
  XENP020963 vlCDR3
QQSNEDPFT

SEQ ID NO: 29474 - protein, 226 aa, Artificial Sequence
  Description of Artificial Sequence: Synthetic polypeptide
  XENP020964 7G8_H0.33_L0_Fab Heavy Chain
EVKLEESGGGLVQPGGSMKLSCAASGFTFSDAWMDWVRQSPEKGLEWVAEIYTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29475 - protein, 121 aa, Artificial Sequence; identical to SEQ ID NO: 18536
  Description of Artificial Sequence: Synthetic polypeptide
  VH of XENP020964

SEQ ID NO: 29476 - protein, 5 aa, Artificial Sequence
  Description of Artificial Sequence: Synthetic peptide
  XENP020964 vhCDR1
DAWMD

SEQ ID NO: 29477 - protein, 19 aa, Artificial Sequence
  Description of Artificial Sequence: Synthetic peptide
  XENP020964 vhCDR2
EIYTKANNHATYYAESVKG

SEQ ID NO: 29478 - protein, 10 aa, Artificial Sequence
  Description of Artificial Sequence: Synthetic peptide
  XENP020964 vhCDR3
LANWDWYFDV

SEQ ID NO: 29479 - protein, 218 aa, Artificial Sequence; identical to SEQ ID NO: 17590
  Description of Artificial Sequence: Synthetic polypeptide
  XENP020964 7G8_H0.33_L0_Fab Light Chain

SEQ ID NO: 29480 - protein, 111 aa, Artificial Sequence; identical to SEQ ID NO: 17591
  Description of Artificial Sequence: Synthetic polypeptide
  VL of XENP020964

SEQ ID NO: 29481 - protein, 15 aa, Artificial Sequence
  Description of Artificial Sequence: Synthetic peptide
  XENP020964 vlCDR1
KASQSVDYDGDSYMN

SEQ ID NO: 29482 - protein, 7 aa, Artificial Sequence
  Description of Artificial Sequence: Synthetic peptide
  XENP020964 vlCDR2
AASNLES

SEQ ID NO: 29483 - protein, 9 aa, Artificial Sequence
  Description of Artificial Sequence: Synthetic peptide
  XENP020964 vlCDR3
QQSNEDPFT

SEQ ID NO: 29484 - protein, 226 aa, Artificial Sequence
  Description of Artificial Sequence: Synthetic polypeptide
  XENP020965 7G8_H0.34_L0_Fab Heavy Chain
EVKLEESGGGLVQPGGSMKLSCAASGFTFSDAWMDWVRQSPEKGLEWVAEIITKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29485 - protein, 121 aa, Artificial Sequence; identical to SEQ ID NO: 18546
  Description of Artificial Sequence: Synthetic polypeptide
  VH of XENP020965

SEQ ID NO: 29486 - protein, 5 aa, Artificial Sequence
  Description of Artificial Sequence: Synthetic peptide
  XENP020965 vhCDR1
DAWMD

SEQ ID NO: 29487 - protein, 19 aa, Artificial Sequence
  Description of Artificial Sequence: Synthetic peptide
  XENP020965 vhCDR2
EIITKANNHATYYAESVKG

SEQ ID NO: 29488 - protein, 10 aa, Artificial Sequence
  Description of Artificial Sequence: Synthetic peptide
  XENP020965 vhCDR3
LANWDWYFDV

SEQ ID NO: 29489 - protein, 218 aa, Artificial Sequence; identical to SEQ ID NO: 17590
  Description of Artificial Sequence: Synthetic polypeptide
  XENP020965 7G8_H0.34_L0_Fab Light Chain

SEQ ID NO: 29490 - protein, 111 aa, Artificial Sequence; identical to SEQ ID NO: 17591
  Description of Artificial Sequence: Synthetic polypeptide
  VL of XENP020965

SEQ ID NO: 29491 - protein, 15 aa, Artificial Sequence
  Description of Artificial Sequence: Synthetic peptide
  XENP020965 vlCDR1
KASQSVDYDGDSYMN

SEQ ID NO: 29492 - protein, 7 aa, Artificial Sequence
  Description of Artificial Sequence: Synthetic peptide
  XENP020965 vlCDR2
AASNLES

SEQ ID NO: 29493 - protein, 9 aa, Artificial Sequence
  Description of Artificial Sequence: Synthetic peptide
  XENP020965 vlCDR3
QQSNEDPFT

SEQ ID NO: 29494 - protein, 226 aa, Artificial Sequence
  Description of Artificial Sequence: Synthetic polypeptide
  XENP020966 7G8_H0.35_L0_Fab Heavy Chain
EVKLEESGGGLVQPGGSMKLSCAASGFTFSDAWMDWVRQSPEKGLEWVAEIWTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29495 - protein, 121 aa, Artificial Sequence; identical to SEQ ID NO: 18556
  Description of Artificial Sequence: Synthetic polypeptide
  VH of XENP020966

SEQ ID NO: 29496 - protein, 5 aa, Artificial Sequence
  Description of Artificial Sequence: Synthetic peptide
  XENP020966 vhCDR1
DAWMD

SEQ ID NO: 29497 - protein, 19 aa, Artificial Sequence
  Description of Artificial Sequence: Synthetic peptide
  XENP020966 vhCDR2
EIWTKANNHATYYAESVKG

SEQ ID NO: 29498 - protein, 10 aa, Artificial Sequence
  Description of Artificial Sequence: Synthetic peptide
  XENP020966 vhCDR3
LANWDWYFDV

SEQ ID NO: 29499 - protein, 218 aa, Artificial Sequence; identical to SEQ ID NO: 17590
  Description of Artificial Sequence: Synthetic polypeptide
  XENP020966 7G8_H0.35_L0_Fab Light Chain

SEQ ID NO: 29500 - protein, 111 aa, Artificial Sequence; identical to SEQ ID NO: 17591
  Description of Artificial Sequence: Synthetic polypeptide
  VL of XENP020966

SEQ ID NO: 29501 - protein, 15 aa, Artificial Sequence
  Description of Artificial Sequence: Synthetic peptide
  XENP020966 vlCDR1
KASQSVDYDGDSYMN

SEQ ID NO: 29502 - protein, 7 aa, Artificial Sequence
  Description of Artificial Sequence: Synthetic peptide
  XENP020966 vlCDR2
AASNLES

SEQ ID NO: 29503 - protein, 9 aa, Artificial Sequence
  Description of Artificial Sequence: Synthetic peptide
  XENP020966 vlCDR3
QQSNEDPFT

SEQ ID NO: 29504 - protein, 226 aa, Artificial Sequence
  Description of Artificial Sequence: Synthetic polypeptide
  XENP020967 7G8_H0.36_L0_Fab Heavy Chain
EVKLEESGGGLVQPGGSMKLSCAASGFTFSDAWMDWVRQSPEKGLEWVAEIRVKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29505 - protein, 121 aa, Artificial Sequence; identical to SEQ ID NO: 18566
  Description of Artificial Sequence: Synthetic polypeptide
  VH of XENP020967

SEQ ID NO: 29506 - protein, 5 aa, Artificial Sequence
  Description of Artificial Sequence: Synthetic peptide
  XENP020967 vhCDR1
DAWMD

SEQ ID NO: 29507 - protein, 19 aa, Artificial Sequence
  Description of Artificial Sequence: Synthetic peptide
  XENP020967 vhCDR2
EIRVKANNHATYYAESVKG

SEQ ID NO: 29508 - protein, 10 aa, Artificial Sequence
  Description of Artificial Sequence: Synthetic peptide
  XENP020967 vhCDR3
LANWDWYFDV

SEQ ID NO: 29509 - protein, 218 aa, Artificial Sequence; identical to SEQ ID NO: 17590
  Description of Artificial Sequence: Synthetic polypeptide
  XENP020967 7G8_H0.36_L0_Fab Light Chain

SEQ ID NO: 29510 - protein, 111 aa, Artificial Sequence; identical to SEQ ID NO: 17591
  Description of Artificial Sequence: Synthetic polypeptide
  VL of XENP020967

SEQ ID NO: 29511 - protein, 15 aa, Artificial Sequence
  Description of Artificial Sequence: Synthetic peptide
  XENP020967 vlCDR1
KASQSVDYDGDSYMN

SEQ ID NO: 29512 - protein, 7 aa, Artificial Sequence
  Description of Artificial Sequence: Synthetic peptide
  XENP020967 vlCDR2
AASNLES

SEQ ID NO: 29513 - protein, 9 aa, Artificial Sequence
  Description of Artificial Sequence: Synthetic peptide
  XENP020967 vlCDR3
QQSNEDPFT

SEQ ID NO: 29514 - protein, 226 aa, Artificial Sequence
  Description of Artificial Sequence: Synthetic polypeptide
  XENP020968 7G8_H0.37_L0_Fab Heavy Chain
EVKLEESGGGLVQPGGSMKLSCAASGFTFSDAWMDWVRQSPEKGLEWVAEIRSKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29515 - protein, 121 aa, Artificial Sequence; identical to SEQ ID NO: 18576
  Description of Artificial Sequence: Synthetic polypeptide
  VH of XENP020968

SEQ ID NO: 29516 - protein, 5 aa, Artificial Sequence
  Description of Artificial Sequence: Synthetic peptide
  XENP020968 vhCDR1
DAWMD

SEQ ID NO: 29517 - protein, 19 aa, Artificial Sequence
  Description of Artificial Sequence: Synthetic peptide
  XENP020968 vhCDR2
EIRSKANNHATYYAESVKG

SEQ ID NO: 29518 - protein, 10 aa, Artificial Sequence
  Description of Artificial Sequence: Synthetic peptide
  XENP020968 vhCDR3
LANWDWYFDV

SEQ ID NO: 29519 - protein, 218 aa, Artificial Sequence; identical to SEQ ID NO: 17590
  Description of Artificial Sequence: Synthetic polypeptide
  XENP020968 7G8_H0.37_L0_Fab Light Chain

SEQ ID NO: 29520 - protein, 111 aa, Artificial Sequence; identical to SEQ ID NO: 17591
  Description of Artificial Sequence: Synthetic polypeptide
  VL of XENP020968

SEQ ID NO: 29521 - protein, 15 aa, Artificial Sequence
  Description of Artificial Sequence: Synthetic peptide
  XENP020968 vlCDR1
KASQSVDYDGDSYMN

SEQ ID NO: 29522 - protein, 7 aa, Artificial Sequence
  Description of Artificial Sequence: Synthetic peptide
  XENP020968 vlCDR2
AASNLES

SEQ ID NO: 29523 - protein, 9 aa, Artificial Sequence
  Description of Artificial Sequence: Synthetic peptide
  XENP020968 vlCDR3
QQSNEDPFT

SEQ ID NO: 29524 - protein, 226 aa, Artificial Sequence
  Description of Artificial Sequence: Synthetic polypeptide
  XENP020969 7G8_H0.38_L0_Fab Heavy Chain
EVKLEESGGGLVQPGGSMKLSCAASGFTFSDAWMDWVRQSPEKGLEWVAEIRAKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29525 - protein, 121 aa, Artificial Sequence; identical to SEQ ID NO: 18586
  Description of Artificial Sequence: Synthetic polypeptide
  VH of XENP020969

SEQ ID NO: 29526 - protein, 5 aa, Artificial Sequence
  Description of Artificial Sequence: Synthetic peptide
  XENP020969 vhCDR1
DAWMD

SEQ ID NO: 29527 - protein, 19 aa, Artificial Sequence
  Description of Artificial Sequence: Synthetic peptide
  XENP020969 vhCDR2
EIRAKANNHATYYAESVKG

SEQ ID NO: 29528 - protein, 10 aa, Artificial Sequence
  Description of Artificial Sequence: Synthetic peptide
  XENP020969 vhCDR3
LANWDWYFDV

SEQ ID NO: 29529 - protein, 218 aa, Artificial Sequence; identical to SEQ ID NO: 17590
  Description of Artificial Sequence: Synthetic polypeptide
  XENP020969 7G8_H0.38_L0_Fab Light Chain

SEQ ID NO: 29530 - protein, 111 aa, Artificial Sequence; identical to SEQ ID NO: 17591
  Description of Artificial Sequence: Synthetic polypeptide
  VL of XENP020969

SEQ ID NO: 29531 - protein, 15 aa, Artificial Sequence
  Description of Artificial Sequence: Synthetic peptide
  XENP020969 vlCDR1
KASQSVDYDGDSYMN

SEQ ID NO: 29532 - protein, 7 aa, Artificial Sequence
  Description of Artificial Sequence: Synthetic peptide
  XENP020969 vlCDR2
AASNLES

SEQ ID NO: 29533 - protein, 9 aa, Artificial Sequence
  Description of Artificial Sequence: Synthetic peptide
  XENP020969 vlCDR3
QQSNEDPFT

SEQ ID NO: 29534 - protein, 226 aa, Artificial Sequence
  Description of Artificial Sequence: Synthetic polypeptide
  XENP020970 7G8_H0.39_L0_Fab Heavy Chain
EVKLEESGGGLVQPGGSMKLSCAASGFTFSDAWMDWVRQSPEKGLEWVAEIRIKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29535 - protein, 121 aa, Artificial Sequence; identical to SEQ ID NO: 18596
  Description of Artificial Sequence: Synthetic polypeptide
  VH of XENP020970

SEQ ID NO: 29536 - protein, 5 aa, Artificial Sequence
  Description of Artificial Sequence: Synthetic peptide
  XENP020970 vhCDR1
DAWMD

SEQ ID NO: 29537 - protein, 19 aa, Artificial Sequence
  Description of Artificial Sequence: Synthetic peptide
  XENP020970 vhCDR2
EIRIKANNHATYYAESVKG

SEQ ID NO: 29538 - protein, 10 aa, Artificial Sequence
  Description of Artificial Sequence: Synthetic peptide
  XENP020970 vhCDR3
LANWDWYFDV

SEQ ID NO: 29539 - protein, 218 aa, Artificial Sequence; identical to SEQ ID NO: 17590
  Description of Artificial Sequence: Synthetic polypeptide
  XENP020970 7G8_H0.39_L0_Fab Light Chain

SEQ ID NO: 29540 - protein, 111 aa, Artificial Sequence; identical to SEQ ID NO: 17591
  Description of Artificial Sequence: Synthetic polypeptide
  VL of XENP020970

SEQ ID NO: 29541 - protein, 15 aa, Artificial Sequence
  Description of Artificial Sequence: Synthetic peptide
  XENP020970 vlCDR1
KASQSVDYDGDSYMN

SEQ ID NO: 29542 - protein, 7 aa, Artificial Sequence
  Description of Artificial Sequence: Synthetic peptide
  XENP020970 vlCDR2
AASNLES

SEQ ID NO: 29543 - protein, 9 aa, Artificial Sequence
  Description of Artificial Sequence: Synthetic peptide
  XENP020970 vlCDR3
QQSNEDPFT

SEQ ID NO: 29544 - protein, 226 aa, Artificial Sequence
  Description of Artificial Sequence: Synthetic polypeptide
  XENP020971 7G8_H0.40_L0_Fab Heavy Chain
EVKLEESGGGLVQPGGSMKLSCAASGFTFSDAWMDWVRQSPEKGLEWVAEIRQKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29545 - protein, 121 aa, Artificial Sequence; identical to SEQ ID NO: 18606
  Description of Artificial Sequence: Synthetic polypeptide
  VH of XENP020971

SEQ ID NO: 29546 - protein, 5 aa, Artificial Sequence
  Description of Artificial Sequence: Synthetic peptide
  XENP020971 vhCDR1
DAWMD

SEQ ID NO: 29547 - protein, 19 aa, Artificial Sequence
  Description of Artificial Sequence: Synthetic peptide
  XENP020971 vhCDR2
EIRQKANNHATYYAESVKG

SEQ ID NO: 29548 - protein, 10 aa, Artificial Sequence
  Description of Artificial Sequence: Synthetic peptide
  XENP020971 vhCDR3
LANWDWYFDV

SEQ ID NO: 29549 - protein, 218 aa, Artificial Sequence; identical to SEQ ID NO: 17590
  Description of Artificial Sequence: Synthetic polypeptide
  XENP020971 7G8_H0.40_L0_Fab Light Chain

SEQ ID NO: 29550 - protein, 111 aa, Artificial Sequence; identical to SEQ ID NO: 17591
  Description of Artificial Sequence: Synthetic polypeptide
  VL of XENP020971

SEQ ID NO: 29551 - protein, 15 aa, Artificial Sequence
  Description of Artificial Sequence: Synthetic peptide
  XENP020971 vlCDR1
KASQSVDYDGDSYMN

SEQ ID NO: 29552 - protein, 7 aa, Artificial Sequence
  Description of Artificial Sequence: Synthetic peptide
  XENP020971 vlCDR2
AASNLES

SEQ ID NO: 29553 - protein, 9 aa, Artificial Sequence
  Description of Artificial Sequence: Synthetic peptide
  XENP020971 vlCDR3
QQSNEDPFT

SEQ ID NO: 29554 - protein, 226 aa, Artificial Sequence
  Description of Artificial Sequence: Synthetic polypeptide
  XENP020972 7G8_H0.41_L0_Fab Heavy Chain
EVKLEESGGGLVQPGGSMKLSCAASGFTFSDAWMDWVRQSPEKGLEWVAEIRHKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29555 - protein, 121 aa, Artificial Sequence; identical to SEQ ID NO: 18616
  Description of Artificial Sequence: Synthetic polypeptide
  VH of XENP020972

SEQ ID NO: 29556 - protein, 5 aa, Artificial Sequence
  Description of Artificial Sequence: Synthetic peptide
  XENP020972 vhCDR1
DAWMD

SEQ ID NO: 29557 - protein, 19 aa, Artificial Sequence
  Description of Artificial Sequence: Synthetic peptide
  XENP020972 vhCDR2
EIRHKANNHATYYAESVKG

SEQ ID NO: 29558 - protein, 10 aa, Artificial Sequence
  Description of Artificial Sequence: Synthetic peptide
  XENP020972 vhCDR3
LANWDWYFDV

SEQ ID NO: 29559 - protein, 218 aa, Artificial Sequence; identical to SEQ ID NO: 17590
  Description of Artificial Sequence: Synthetic polypeptide
  XENP020972 7G8_H0.41_L0_Fab Light Chain

SEQ ID NO: 29560 - protein, 111 aa, Artificial Sequence; identical to SEQ ID NO: 17591
  Description of Artificial Sequence: Synthetic polypeptide
  VL of XENP020972

SEQ ID NO: 29561 - protein, 15 aa, Artificial Sequence
  Description of Artificial Sequence: Synthetic peptide
  XENP020972 vlCDR1
KASQSVDYDGDSYMN

SEQ ID NO: 29562 - protein, 7 aa, Artificial Sequence
  Description of Artificial Sequence: Synthetic peptide
  XENP020972 vlCDR2
AASNLES

SEQ ID NO: 29563 - protein, 9 aa, Artificial Sequence
  Description of Artificial Sequence: Synthetic peptide
  XENP020972 vlCDR3
QQSNEDPFT

SEQ ID NO: 29564 - protein, 226 aa, Artificial Sequence
  Description of Artificial Sequence: Synthetic polypeptide
  XENP020973 7G8_H0.42_L0_Fab Heavy Chain
EVKLEESGGGLVQPGGSMKLSCAASGFTFSDAWMDWVRQSPEKGLEWVAEIRDKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29565 - protein, 121 aa, Artificial Sequence; identical to SEQ ID NO: 18626
  Description of Artificial Sequence: Synthetic polypeptide
  VH of XENP020973

SEQ ID NO: 29566 - protein, 5 aa, Artificial Sequence
  Description of Artificial Sequence: Synthetic peptide
  XENP020973 vhCDR1
DAWMD

SEQ ID NO: 29567 - protein, 19 aa, Artificial Sequence
  Description of Artificial Sequence: Synthetic peptide
  XENP020973 vhCDR2
EIRDKANNHATYYAESVKG

SEQ ID NO: 29568 - protein, 10 aa, Artificial Sequence
  Description of Artificial Sequence: Synthetic peptide
  XENP020973 vhCDR3
LANWDWYFDV

SEQ ID NO: 29569 - protein, 218 aa, Artificial Sequence; identical to SEQ ID NO: 17590
  Description of Artificial Sequence: Synthetic polypeptide
  XENP020973 7G8_H0.42_L0_Fab Light Chain

SEQ ID NO: 29570 - protein, 111 aa, Artificial Sequence; identical to SEQ ID NO: 17591
  Description of Artificial Sequence: Synthetic polypeptide
  VL of XENP020973

SEQ ID NO: 29571 - protein, 15 aa, Artificial Sequence
  Description of Artificial Sequence: Synthetic peptide
  XENP020973 vlCDR1
KASQSVDYDGDSYMN

SEQ ID NO: 29572 - protein, 7 aa, Artificial Sequence
  Description of Artificial Sequence: Synthetic peptide
  XENP020973 vlCDR2
AASNLES

SEQ ID NO: 29573 - protein, 9 aa, Artificial Sequence
  Description of Artificial Sequence: Synthetic peptide
  XENP020973 vlCDR3
QQSNEDPFT

SEQ ID NO: 29574 - protein, 226 aa, Artificial Sequence
  Description of Artificial Sequence: Synthetic polypeptide
  XENP020974 7G8_H0.43_L0_Fab Heavy Chain
EVKLEESGGGLVQPGGSMKLSCAASGFTFSDAWMDWVRQSPEKGLEWVAEIRKKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29575 - protein, 121 aa, Artificial Sequence; identical to SEQ ID NO: 18636
  Description of Artificial Sequence: Synthetic polypeptide
  VH of XENP020974

SEQ ID NO: 29576 - protein, 5 aa, Artificial Sequence
  Description of Artificial Sequence: Synthetic peptide
  XENP020974 vhCDR1
DAWMD

SEQ ID NO: 29577 - protein, 19 aa, Artificial Sequence
  Description of Artificial Sequence: Synthetic peptide
  XENP020974 vhCDR2
EIRKKANNHATYYAESVKG

SEQ ID NO: 29578 - protein, 10 aa, Artificial Sequence
  Description of Artificial Sequence: Synthetic peptide
  XENP020974 vhCDR3
LANWDWYFDV

SEQ ID NO: 29579 - protein, 218 aa, Artificial Sequence; identical to SEQ ID NO: 17590
  Description of Artificial Sequence: Synthetic polypeptide
  XENP020974 7G8_H0.43_L0_Fab Light Chain

SEQ ID NO: 29580 - protein, 111 aa, Artificial Sequence; identical to SEQ ID NO: 17591
  Description of Artificial Sequence: Synthetic polypeptide
  VL of XENP020974

SEQ ID NO: 29581 - protein, 15 aa, Artificial Sequence
  Description of Artificial Sequence: Synthetic peptide
  XENP020974 vlCDR1
KASQSVDYDGDSYMN

SEQ ID NO: 29582 - protein, 7 aa, Artificial Sequence
  Description of Artificial Sequence: Synthetic peptide
  XENP020974 vlCDR2
AASNLES

SEQ ID NO: 29583 - protein, 9 aa, Artificial Sequence
  Description of Artificial Sequence: Synthetic peptide
  XENP020974 vlCDR3
QQSNEDPFT

SEQ ID NO: 29584 - protein, 226 aa, Artificial Sequence
  Description of Artificial Sequence: Synthetic polypeptide
  XENP020975 7G8_H0.44_L0_Fab Heavy Chain
EVKLEESGGGLVQPGGSMKLSCAASGFTFSDAWMDWVRQSPEKGLEWVAEIRYKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29585 - protein, 121 aa, Artificial Sequence; identical to SEQ ID NO: 18646
  Description of Artificial Sequence: Synthetic polypeptide
  VH of XENP020975

SEQ ID NO: 29586 - protein, 5 aa, Artificial Sequence
  Description of Artificial Sequence: Synthetic peptide
  XENP020975 vhCDR1
DAWMD

SEQ ID NO: 29587 - protein, 19 aa, Artificial Sequence
  Description of Artificial Sequence: Synthetic peptide
  XENP020975 vhCDR2
EIRYKANNHATYYAESVKG

SEQ ID NO: 29588 - protein, 10 aa, Artificial Sequence
  Description of Artificial Sequence: Synthetic peptide
  XENP020975 vhCDR3
LANWDWYFDV

SEQ ID NO: 29589 - protein, 218 aa, Artificial Sequence; identical to SEQ ID NO: 17590
  Description of Artificial Sequence: Synthetic polypeptide
  XENP020975 7G8_H0.44_L0_Fab Light Chain

SEQ ID NO: 29590 - protein, 111 aa, Artificial Sequence; identical to SEQ ID NO: 17591
  Description of Artificial Sequence: Synthetic polypeptide
  VL of XENP020975

SEQ ID NO: 29591 - protein, 15 aa, Artificial Sequence
  Description of Artificial Sequence: Synthetic peptide
  XENP020975 vlCDR1
KASQSVDYDGDSYMN

SEQ ID NO: 29592 - protein, 7 aa, Artificial Sequence
  Description of Artificial Sequence: Synthetic peptide
  XENP020975 vlCDR2
AASNLES

SEQ ID NO: 29593 - protein, 9 aa, Artificial Sequence
  Description of Artificial Sequence: Synthetic peptide
  XENP020975 vlCDR3
QQSNEDPFT

SEQ ID NO: 29594 - protein, 226 aa, Artificial Sequence
  Description of Artificial Sequence: Synthetic polypeptide
  XENP020976 7G8_H0.45_L0_Fab Heavy Chain
EVKLEESGGGLVQPGGSMKLSCAASGFTFSDAWMDWVRQSPEKGLEWVAEIRTRANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29595 - protein, 121 aa, Artificial Sequence; identical to SEQ ID NO: 18656
  Description of Artificial Sequence: Synthetic polypeptide
  VH of XENP020976

SEQ ID NO: 29596 - protein, 5 aa, Artificial Sequence
  Description of Artificial Sequence: Synthetic peptide
  XENP020976 vhCDR1
DAWMD

SEQ ID NO: 29597 - protein, 19 aa, Artificial Sequence
  Description of Artificial Sequence: Synthetic peptide
  XENP020976 vhCDR2
EIRTRANNHATYYAESVKG

SEQ ID NO: 29598 - protein, 10 aa, Artificial Sequence
  Description of Artificial Sequence: Synthetic peptide
  XENP020976 vhCDR3
LANWDWYFDV

SEQ ID NO: 29599 - protein, 218 aa, Artificial Sequence; identical to SEQ ID NO: 17590
  Description of Artificial Sequence: Synthetic polypeptide
  XENP020976 7G8_H0.45_L0_Fab Light Chain

SEQ ID NO: 29600 - protein, 111 aa, Artificial Sequence; identical to SEQ ID NO: 17591
  Description of Artificial Sequence: Synthetic polypeptide
  VL of XENP020976

SEQ ID NO: 29601 - protein, 15 aa, Artificial Sequence
  Description of Artificial Sequence: Synthetic peptide
  XENP020976 vlCDR1
KASQSVDYDGDSYMN

SEQ ID NO: 29602 - protein, 7 aa, Artificial Sequence
  Description of Artificial Sequence: Synthetic peptide
  XENP020976 vlCDR2
AASNLES

SEQ ID NO: 29603 - protein, 9 aa, Artificial Sequence
  Description of Artificial Sequence: Synthetic peptide
  XENP020976 vlCDR3
QQSNEDPFT

SEQ ID NO: 29604 - protein, 226 aa, Artificial Sequence
  Description of Artificial Sequence: Synthetic polypeptide
  XENP020977 7G8_H0.46_L0_Fab Heavy Chain
EVKLEESGGGLVQPGGSMKLSCAASGFTFSDAWMDWVRQSPEKGLEWVAEIRTEANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29605 - protein, 121 aa, Artificial Sequence; identical to SEQ ID NO: 18666
  Description of Artificial Sequence: Synthetic polypeptide
  VH of XENP020977

SEQ ID NO: 29606 - protein, 5 aa, Artificial Sequence
  Description of Artificial Sequence: Synthetic peptide
  XENP020977 vhCDR1
DAWMD

SEQ ID NO: 29607 - protein, 19 aa, Artificial Sequence
  Description of Artificial Sequence: Synthetic peptide
  XENP020977 vhCDR2
EIRTEANNHATYYAESVKG

SEQ ID NO: 29608 - protein, 10 aa, Artificial Sequence
  Description of Artificial Sequence: Synthetic peptide
  XENP020977 vhCDR3
LANWDWYFDV

SEQ ID NO: 29609 - protein, 218 aa, Artificial Sequence; identical to SEQ ID NO: 17590
  Description of Artificial Sequence: Synthetic polypeptide
  XENP020977 7G8_H0.46_L0_Fab Light Chain

SEQ ID NO: 29610 - protein, 111 aa, Artificial Sequence; identical to SEQ ID NO: 17591
  Description of Artificial Sequence: Synthetic polypeptide
  VL of XENP020977

SEQ ID NO: 29611 - protein, 15 aa, Artificial Sequence
  Description of Artificial Sequence: Synthetic peptide
  XENP020977 vlCDR1
KASQSVDYDGDSYMN

SEQ ID NO: 29612 - protein, 7 aa, Artificial Sequence
  Description of Artificial Sequence: Synthetic peptide
  XENP020977 vlCDR2
AASNLES

SEQ ID NO: 29613 - protein, 9 aa, Artificial Sequence
  Description of Artificial Sequence: Synthetic peptide
  XENP020977 vlCDR3
QQSNEDPFT

SEQ ID NO: 29614 - protein, 226 aa, Artificial Sequence
  Description of Artificial Sequence: Synthetic polypeptide
  XENP020978 7G8_H0.47_L0_Fab Heavy Chain
EVKLEESGGGLVQPGGSMKLSCAASGFTFSDAWMDWVRQSPEKGLEWVAEIRTHANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29615 - protein, 121 aa, Artificial Sequence; identical to SEQ ID NO: 18676
  Description of Artificial Sequence: Synthetic polypeptide
  VH of XENP020978

SEQ ID NO: 29616 - protein, 5 aa, Artificial Sequence
  Description of Artificial Sequence: Synthetic peptide
  XENP020978 vhCDR1
DAWMD

SEQ ID NO: 29617 - protein, 19 aa, Artificial Sequence
  Description of Artificial Sequence: Synthetic peptide
  XENP020978 vhCDR2
EIRTHANNHATYYAESVKG

SEQ ID NO: 29618 - protein, 10 aa, Artificial Sequence
  Description of Artificial Sequence: Synthetic peptide
  XENP020978 vhCDR3
LANWDWYFDV

SEQ ID NO: 29619 - protein, 218 aa, Artificial Sequence; identical to SEQ ID NO: 17590
  Description of Artificial Sequence: Synthetic polypeptide
  XENP020978 7G8_H0.47_L0_Fab Light Chain

SEQ ID NO: 29620 - protein, 111 aa, Artificial Sequence; identical to SEQ ID NO: 17591
  Description of Artificial Sequence: Synthetic polypeptide
  VL of XENP020978

SEQ ID NO: 29621 - protein, 15 aa, Artificial Sequence
  Description of Artificial Sequence: Synthetic peptide
  XENP020978 vlCDR1
KASQSVDYDGDSYMN

SEQ ID NO: 29622 - protein, 7 aa, Artificial Sequence
  Description of Artificial Sequence: Synthetic peptide
  XENP020978 vlCDR2
AASNLES

SEQ ID NO: 29623 - protein, 9 aa, Artificial Sequence
  Description of Artificial Sequence: Synthetic peptide
  XENP020978 vlCDR3
QQSNEDPFT

SEQ ID NO: 29624 - protein, 226 aa, Artificial Sequence
  Description of Artificial Sequence: Synthetic polypeptide
  XENP020979 7G8_H0.48_L0_Fab Heavy Chain
EVKLEESGGGLVQPGGSMKLSCAASGFTFSDAWMDWVRQSPEKGLEWVAEIRTSANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29625 - protein, 121 aa, Artificial Sequence; identical to SEQ ID NO: 18686
  Description of Artificial Sequence: Synthetic polypeptide
  VH of XENP020979

SEQ ID NO: 29626 - protein, 5 aa, Artificial Sequence
  Description of Artificial Sequence: Synthetic peptide
  XENP020979 vhCDR1
DAWMD

SEQ ID NO: 29627 - protein, 19 aa, Artificial Sequence
  Description of Artificial Sequence: Synthetic peptide
  XENP020979 vhCDR2
EIRTSANNHATYYAESVKG

SEQ ID NO: 29628 - protein, 10 aa, Artificial Sequence
  Description of Artificial Sequence: Synthetic peptide
  XENP020979 vhCDR3
LANWDWYFDV

SEQ ID NO: 29629 - protein, 218 aa, Artificial Sequence; identical to SEQ ID NO: 17590
  Description of Artificial Sequence: Synthetic polypeptide
  XENP020979 7G8_H0.48_L0_Fab Light Chain

SEQ ID NO: 29630 - protein, 111 aa, Artificial Sequence; identical to SEQ ID NO: 17591
  Description of Artificial Sequence: Synthetic polypeptide
  VL of XENP020979

SEQ ID NO: 29631 - protein, 15 aa, Artificial Sequence
  Description of Artificial Sequence: Synthetic peptide
  XENP020979 vlCDR1
KASQSVDYDGDSYMN

SEQ ID NO: 29632 - protein, 7 aa, Artificial Sequence
  Description of Artificial Sequence: Synthetic peptide
  XENP020979 vlCDR2
AASNLES

SEQ ID NO: 29633 - protein, 9 aa, Artificial Sequence
  Description of Artificial Sequence: Synthetic peptide
  XENP020979 vlCDR3
QQSNEDPFT

SEQ ID NO: 29634 - protein, 226 aa, Artificial Sequence
  Description of Artificial Sequence: Synthetic polypeptide
  XENP020980 7G8_H0.49_L0_Fab Heavy Chain
EVKLEESGGGLVQPGGSMKLSCAASGFTFSDAWMDWVRQSPEKGLEWVAEIRTDANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29635 - protein, 121 aa, Artificial Sequence; identical to SEQ ID NO: 18696
  Description of Artificial Sequence: Synthetic polypeptide
  VH of XENP020980

SEQ ID NO: 29636 - protein, 5 aa, Artificial Sequence
  Description of Artificial Sequence: Synthetic peptide
  XENP020980 vhCDR1
DAWMD

SEQ ID NO: 29637 - protein, 19 aa, Artificial Sequence
  Description of Artificial Sequence: Synthetic peptide
  XENP020980 vhCDR2
EIRTDANNHATYYAESVKG

SEQ ID NO: 29638 - protein, 10 aa, Artificial Sequence
  Description of Artificial Sequence: Synthetic peptide
  XENP020980 vhCDR3
LANWDWYFDV

SEQ ID NO: 29639 - protein, 218 aa, Artificial Sequence; identical to SEQ ID NO: 17590
  Description of Artificial Sequence: Synthetic polypeptide
  XENP020980 7G8_H0.49_L0_Fab Light Chain

SEQ ID NO: 29640 - protein, 111 aa, Artificial Sequence; identical to SEQ ID NO: 17591
  Description of Artificial Sequence: Synthetic polypeptide
  VL of XENP020980

SEQ ID NO: 29641 - protein, 15 aa, Artificial Sequence
  Description of Artificial Sequence: Synthetic peptide
  XENP020980 vlCDR1
KASQSVDYDGDSYMN

SEQ ID NO: 29642 - protein, 7 aa, Artificial Sequence
  Description of Artificial Sequence: Synthetic peptide
  XENP020980 vlCDR2
AASNLES

SEQ ID NO: 29643 - protein, 9 aa, Artificial Sequence
  Description of Artificial Sequence: Synthetic peptide
  XENP020980 vlCDR3
QQSNEDPFT

SEQ ID NO: 29644 - protein, 226 aa, Artificial Sequence
  Description of Artificial Sequence: Synthetic polypeptide
  XENP020981 7G8_H0.50_L0_Fab Heavy Chain
EVKLEESGGGLVQPGGSMKLSCAASGFTFSDAWMDWVRQSPEKGLEWVAEIRTAANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29645 - protein, 121 aa, Artificial Sequence; identical to SEQ ID NO: 18706
  Description of Artificial Sequence: Synthetic polypeptide
  VH of XENP020981

SEQ ID NO: 29646 - protein, 5 aa, Artificial Sequence
  Description of Artificial Sequence: Synthetic peptide
  XENP020981 vhCDR1
DAWMD

SEQ ID NO: 29647 - protein, 19 aa, Artificial Sequence
  Description of Artificial Sequence: Synthetic peptide
  XENP020981 vhCDR2
EIRTAANNHATYYAESVKG

SEQ ID NO: 29648 - protein, 10 aa, Artificial Sequence
  Description of Artificial Sequence: Synthetic peptide
  XENP020981 vhCDR3
LANWDWYFDV

SEQ ID NO: 29649 - protein, 218 aa, Artificial Sequence; identical to SEQ ID NO: 17590
  Description of Artificial Sequence: Synthetic polypeptide
  XENP020981 7G8_H0.50_L0_Fab Light Chain

SEQ ID NO: 29650 - protein, 111 aa, Artificial Sequence; identical to SEQ ID NO: 17591
  Description of Artificial Sequence: Synthetic polypeptide
  VL of XENP020981

SEQ ID NO: 29651 - protein, 15 aa, Artificial Sequence
  Description of Artificial Sequence: Synthetic peptide
  XENP020981 vlCDR1
KASQSVDYDGDSYMN

SEQ ID NO: 29652 - protein, 7 aa, Artificial Sequence
  Description of Artificial Sequence: Synthetic peptide
  XENP020981 vlCDR2
AASNLES

SEQ ID NO: 29653 - protein, 9 aa, Artificial Sequence
  Description of Artificial Sequence: Synthetic peptide
  XENP020981 vlCDR3
QQSNEDPFT

SEQ ID NO: 29654 - protein, 226 aa, Artificial Sequence
  Description of Artificial Sequence: Synthetic polypeptide
  XENP020982 7G8_H0.51_L0_Fab Heavy Chain
EVKLEESGGGLVQPGGSMKLSCAASGFTFSDAWMDWVRQSPEKGLEWVAEIRTGANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29655 - protein, 121 aa, Artificial Sequence; identical to SEQ ID NO: 18716
  Description of Artificial Sequence: Synthetic polypeptide
  VH of XENP020982

SEQ ID NO: 29656 - protein, 5 aa, Artificial Sequence
  Description of Artificial Sequence: Synthetic peptide
  XENP020982 vhCDR1
DAWMD

SEQ ID NO: 29657 - protein, 19 aa, Artificial Sequence
  Description of Artificial Sequence: Synthetic peptide
  XENP020982 vhCDR2
EIRTGANNHATYYAESVKG

SEQ ID NO: 29658 - protein, 10 aa, Artificial Sequence
  Description of Artificial Sequence: Synthetic peptide
  XENP020982 vhCDR3
LANWDWYFDV

SEQ ID NO: 29659 - protein, 218 aa, Artificial Sequence; identical to SEQ ID NO: 17590
  Description of Artificial Sequence: Synthetic polypeptide
  XENP020982 7G8_H0.51_L0_Fab Light Chain

SEQ ID NO: 29660 - protein, 111 aa, Artificial Sequence; identical to SEQ ID NO: 17591
  Description of Artificial Sequence: Synthetic polypeptide
  VL of XENP020982

SEQ ID NO: 29661 - protein, 15 aa, Artificial Sequence
  Description of Artificial Sequence: Synthetic peptide
  XENP020982 vlCDR1
KASQSVDYDGDSYMN

SEQ ID NO: 29662 - protein, 7 aa, Artificial Sequence
  Description of Artificial Sequence: Synthetic peptide
  XENP020982 vlCDR2
AASNLES

SEQ ID NO: 29663 - protein, 9 aa, Artificial Sequence
  Description of Artificial Sequence: Synthetic peptide
  XENP020982 vlCDR3
QQSNEDPFT

SEQ ID NO: 29664 - protein, 226 aa, Artificial Sequence
  Description of Artificial Sequence: Synthetic polypeptide
  XENP020983 7G8_H0.52_L0_Fab Heavy Chain
EVKLEESGGGLVQPGGSMKLSCAASGFTFSDAWMDWVRQSPEKGLEWVAEIRTYANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29665 - protein, 121 aa, Artificial Sequence; identical to SEQ ID NO: 18726
  Description of Artificial Sequence: Synthetic polypeptide
  VH of XENP020983

SEQ ID NO: 29666 - protein, 5 aa, Artificial Sequence
  Description of Artificial Sequence: Synthetic peptide
  XENP020983 vhCDR1
DAWMD

SEQ ID NO: 29667 - protein, 19 aa, Artificial Sequence
  Description of Artificial Sequence: Synthetic peptide
  XENP020983 vhCDR2
EIRTYANNHATYYAESVKG

SEQ ID NO: 29668 - protein, 10 aa, Artificial Sequence
  Description of Artificial Sequence: Synthetic peptide
  XENP020983 vhCDR3
LANWDWYFDV

SEQ ID NO: 29669 - protein, 218 aa, Artificial Sequence; identical to SEQ ID NO: 17590
  Description of Artificial Sequence: Synthetic polypeptide
  XENP020983 7G8_H0.52_L0_Fab Light Chain

SEQ ID NO: 29670 - protein, 111 aa, Artificial Sequence; identical to SEQ ID NO: 17591
  Description of Artificial Sequence: Synthetic polypeptide
  VL of XENP020983

SEQ ID NO: 29671 - protein, 15 aa, Artificial Sequence
  Description of Artificial Sequence: Synthetic peptide
  XENP020983 vlCDR1
KASQSVDYDGDSYMN

SEQ ID NO: 29672 - protein, 7 aa, Artificial Sequence
  Description of Artificial Sequence: Synthetic peptide
  XENP020983 vlCDR2
AASNLES

SEQ ID NO: 29673 - protein, 9 aa, Artificial Sequence
  Description of Artificial Sequence: Synthetic peptide
  XENP020983 vlCDR3
QQSNEDPFT

SEQ ID NO: 29674 - protein, 226 aa, Artificial Sequence
  Description of Artificial Sequence: Synthetic polypeptide
  XENP020984 7G8_H0.53_L0_Fab Heavy Chain
EVKLEESGGGLVQPGGSMKLSCAASGFTFSDAWMDWVRQSPEKGLEWVAEIRTIANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29675 - protein, 121 aa, Artificial Sequence; identical to SEQ ID NO: 18736
  Description of Artificial Sequence: Synthetic polypeptide
  VH of XENP020984

SEQ ID NO: 29676 - protein, 5 aa, Artificial Sequence
  Description of Artificial Sequence: Synthetic peptide
  XENP020984 vhCDR1
DAWMD

SEQ ID NO: 29677 - protein, 19 aa, Artificial Sequence
  Description of Artificial Sequence: Synthetic peptide
  XENP020984 vhCDR2
EIRTIANNHATYYAESVKG

SEQ ID NO: 29678 - protein, 10 aa, Artificial Sequence
  Description of Artificial Sequence: Synthetic peptide
  XENP020984 vhCDR3
LANWDWYFDV

SEQ ID NO: 29679 - protein, 218 aa, Artificial Sequence; identical to SEQ ID NO: 17590
  Description of Artificial Sequence: Synthetic polypeptide
  XENP020984 7G8_H0.53_L0_Fab Light Chain

SEQ ID NO: 29680 - protein, 111 aa, Artificial Sequence; identical to SEQ ID NO: 17591
  Description of Artificial Sequence: Synthetic polypeptide
  VL of XENP020984

SEQ ID NO: 29681 - protein, 15 aa, Artificial Sequence
  Description of Artificial Sequence: Synthetic peptide
  XENP020984 vlCDR1
KASQSVDYDGDSYMN

SEQ ID NO: 29682 - protein, 7 aa, Artificial Sequence
  Description of Artificial Sequence: Synthetic peptide
  XENP020984 vlCDR2
AASNLES

SEQ ID NO: 29683 - protein, 9 aa, Artificial Sequence
  Description of Artificial Sequence: Synthetic peptide
  XENP020984 vlCDR3
QQSNEDPFT

SEQ ID NO: 29684 - protein, 226 aa, Artificial Sequence
  Description of Artificial Sequence: Synthetic polypeptide
  XENP020985 7G8_H0.54_L0_Fab Heavy Chain
EVKLEESGGGLVQPGGSMKLSCAASGFTFSDAWMDWVRQSPEKGLEWVAEIRTKSNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29685 - protein, 121 aa, Artificial Sequence; identical to SEQ ID NO: 18746
  Description of Artificial Sequence: Synthetic polypeptide
  VH of XENP020985

SEQ ID NO: 29686 - protein, 5 aa, Artificial Sequence
  Description of Artificial Sequence: Synthetic peptide
  XENP020985 vhCDR1
DAWMD

SEQ ID NO: 29687 - protein, 19 aa, Artificial Sequence
  Description of Artificial Sequence: Synthetic peptide
  XENP020985 vhCDR2
EIRTKSNNHATYYAESVKG

SEQ ID NO: 29688 - protein, 10 aa, Artificial Sequence
  Description of Artificial Sequence: Synthetic peptide
  XENP020985 vhCDR3
LANWDWYFDV

SEQ ID NO: 29689 - protein, 218 aa, Artificial Sequence; identical to SEQ ID NO: 17590
  Description of Artificial Sequence: Synthetic polypeptide
  XENP020985 7G8_H0.54_L0_Fab Light Chain

SEQ ID NO: 29690 - protein, 111 aa, Artificial Sequence; identical to SEQ ID NO: 17591
  Description of Artificial Sequence: Synthetic polypeptide
  VL of XENP020985

SEQ ID NO: 29691 - protein, 15 aa, Artificial Sequence
  Description of Artificial Sequence: Synthetic peptide
  XENP020985 vlCDR1
KASQSVDYDGDSYMN

SEQ ID NO: 29692 - protein, 7 aa, Artificial Sequence
  Description of Artificial Sequence: Synthetic peptide
  XENP020985 vlCDR2
AASNLES

SEQ ID NO: 29693 - protein, 9 aa, Artificial Sequence
  Description of Artificial Sequence: Synthetic peptide
  XENP020985 vlCDR3
QQSNEDPFT

SEQ ID NO: 29694 - protein, 226 aa, Artificial Sequence
  Description of Artificial Sequence: Synthetic polypeptide
  XENP020986 7G8_H0.55_L0_Fab Heavy Chain
EVKLEESGGGLVQPGGSMKLSCAASGFTFSDAWMDWVRQSPEKGLEWVAEIRTKTNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29695 - protein, 121 aa, Artificial Sequence; identical to SEQ ID NO: 18756
  Description of Artificial Sequence: Synthetic polypeptide
  VH of XENP020986

SEQ ID NO: 29696 - protein, 5 aa, Artificial Sequence
  Description of Artificial Sequence: Synthetic peptide
  XENP020986 vhCDR1
DAWMD

SEQ ID NO: 29697 - protein, 19 aa, Artificial Sequence
  Description of Artificial Sequence: Synthetic peptide
  XENP020986 vhCDR2
EIRTKTNNHATYYAESVKG

SEQ ID NO: 29698 - protein, 10 aa, Artificial Sequence
  Description of Artificial Sequence: Synthetic peptide
  XENP020986 vhCDR3
LANWDWYFDV

SEQ ID NO: 29699 - protein, 218 aa, Artificial Sequence; identical to SEQ ID NO: 17590
  Description of Artificial Sequence: Synthetic polypeptide
  XENP020986 7G8_H0.55_L0_Fab Light Chain

SEQ ID NO: 29700 - protein, 111 aa, Artificial Sequence; identical to SEQ ID NO: 17591
  Description of Artificial Sequence: Synthetic polypeptide
  VL of XENP020986

SEQ ID NO: 29701 - protein, 15 aa, Artificial Sequence
  Description of Artificial Sequence: Synthetic peptide
  XENP020986 vlCDR1
KASQSVDYDGDSYMN

SEQ ID NO: 29702 - protein, 7 aa, Artificial Sequence
  Description of Artificial Sequence: Synthetic peptide
  XENP020986 vlCDR2
AASNLES

SEQ ID NO: 29703 - protein, 9 aa, Artificial Sequence
  Description of Artificial Sequence: Synthetic peptide
  XENP020986 vlCDR3
QQSNEDPFT

SEQ ID NO: 29704 - protein, 226 aa, Artificial Sequence
  Description of Artificial Sequence: Synthetic polypeptide
  XENP020987 7G8_H0.56_L0_Fab Heavy Chain
EVKLEESGGGLVQPGGSMKLSCAASGFTFSDAWMDWVRQSPEKGLEWVAEIRTKGNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29705 - protein, 121 aa, Artificial Sequence; identical to SEQ ID NO: 18766
  Description of Artificial Sequence: Synthetic polypeptide
  VH of XENP020987

SEQ ID NO: 29706 - protein, 5 aa, Artificial Sequence
  Description of Artificial Sequence: Synthetic peptide
  XENP020987 vhCDR1
DAWMD

SEQ ID NO: 29707 - protein, 19 aa, Artificial Sequence
  Description of Artificial Sequence: Synthetic peptide
  XENP020987 vhCDR2
EIRTKGNNHATYYAESVKG

SEQ ID NO: 29708 - protein, 10 aa, Artificial Sequence
  Description of Artificial Sequence: Synthetic peptide
  XENP020987 vhCDR3
LANWDWYFDV

SEQ ID NO: 29709 - protein, 218 aa, Artificial Sequence; identical to SEQ ID NO: 17590
  Description of Artificial Sequence: Synthetic polypeptide
  XENP020987 7G8_H0.56_L0_Fab Light Chain

SEQ ID NO: 29710 - protein, 111 aa, Artificial Sequence; identical to SEQ ID NO: 17591
  Description of Artificial Sequence: Synthetic polypeptide
  VL of XENP020987

SEQ ID NO: 29711 - protein, 15 aa, Artificial Sequence
  Description of Artificial Sequence: Synthetic peptide
  XENP020987 vlCDR1
KASQSVDYDGDSYMN

SEQ ID NO: 29712 - protein, 7 aa, Artificial Sequence
  Description of Artificial Sequence: Synthetic peptide
  XENP020987 vlCDR2
AASNLES

SEQ ID NO: 29713 - protein, 9 aa, Artificial Sequence
  Description of Artificial Sequence: Synthetic peptide
  XENP020987 vlCDR3
QQSNEDPFT

SEQ ID NO: 29714 - protein, 226 aa, Artificial Sequence
  Description of Artificial Sequence: Synthetic polypeptide
  XENP020988 7G8_H0.57_L0_Fab Heavy Chain
EVKLEESGGGLVQPGGSMKLSCAASGFTFSDAWMDWVRQSPEKGLEWVAEIRTKHNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29715 - protein, 121 aa, Artificial Sequence; identical to SEQ ID NO: 18776
  Description of Artificial Sequence: Synthetic polypeptide
  VH of XENP020988

SEQ ID NO: 29716 - protein, 5 aa, Artificial Sequence
  Description of Artificial Sequence: Synthetic peptide
  XENP020988 vhCDR1
DAWMD

SEQ ID NO: 29717 - protein, 19 aa, Artificial Sequence
  Description of Artificial Sequence: Synthetic peptide
  XENP020988 vhCDR2
EIRTKHNNHATYYAESVKG

SEQ ID NO: 29718 - protein, 10 aa, Artificial Sequence
  Description of Artificial Sequence: Synthetic peptide
  XENP020988 vhCDR3
LANWDWYFDV

SEQ ID NO: 29719 - protein, 218 aa, Artificial Sequence; identical to SEQ ID NO: 17590
  Description of Artificial Sequence: Synthetic polypeptide
  XENP020988 7G8_H0.57_L0_Fab Light Chain

SEQ ID NO: 29720 - protein, 111 aa, Artificial Sequence; identical to SEQ ID NO: 17591
  Description of Artificial Sequence: Synthetic polypeptide
  VL of XENP020988

SEQ ID NO: 29721 - protein, 15 aa, Artificial Sequence
  Description of Artificial Sequence: Synthetic peptide
  XENP020988 vlCDR1
KASQSVDYDGDSYMN

SEQ ID NO: 29722 - protein, 7 aa, Artificial Sequence
  Description of Artificial Sequence: Synthetic peptide
  XENP020988 vlCDR2
AASNLES

SEQ ID NO: 29723 - protein, 9 aa, Artificial Sequence
  Description of Artificial Sequence: Synthetic peptide
  XENP020988 vlCDR3
QQSNEDPFT

SEQ ID NO: 29724 - protein, 226 aa, Artificial Sequence
  Description of Artificial Sequence: Synthetic polypeptide
  XENP020989 7G8_H0.58_L0_Fab Heavy Chain
EVKLEESGGGLVQPGGSMKLSCAASGFTFSDAWMDWVRQSPEKGLEWVAEIRTKQNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29725 - protein, 121 aa, Artificial Sequence; identical to SEQ ID NO: 18786
  Description of Artificial Sequence: Synthetic polypeptide
  VH of XENP020989

SEQ ID NO: 29726 - protein, 5 aa, Artificial Sequence
  Description of Artificial Sequence: Synthetic peptide
  XENP020989 vhCDR1
DAWMD

SEQ ID NO: 29727 - protein, 19 aa, Artificial Sequence
  Description of Artificial Sequence: Synthetic peptide
  XENP020989 vhCDR2
EIRTKQNNHATYYAESVKG

SEQ ID NO: 29728 - protein, 10 aa, Artificial Sequence
  Description of Artificial Sequence: Synthetic peptide
  XENP020989 vhCDR3
LANWDWYFDV

SEQ ID NO: 29729 - protein, 218 aa, Artificial Sequence; identical to SEQ ID NO: 17590
  Description of Artificial Sequence: Synthetic polypeptide
  XENP020989 7G8_H0.58_L0_Fab Light Chain

SEQ ID NO: 29730 - protein, 111 aa, Artificial Sequence; identical to SEQ ID NO: 17591
  Description of Artificial Sequence: Synthetic polypeptide
  VL of XENP020989

SEQ ID NO: 29731 - protein, 15 aa, Artificial Sequence
  Description of Artificial Sequence: Synthetic peptide
  XENP020989 vlCDR1
KASQSVDYDGDSYMN

SEQ ID NO: 29732 - protein, 7 aa, Artificial Sequence
  Description of Artificial Sequence: Synthetic peptide
  XENP020989 vlCDR2
AASNLES

SEQ ID NO: 29733 - protein, 9 aa, Artificial Sequence
  Description of Artificial Sequence: Synthetic peptide
  XENP020989 vlCDR3
QQSNEDPFT

SEQ ID NO: 29734 - protein, 226 aa, Artificial Sequence
  Description of Artificial Sequence: Synthetic polypeptide
  XENP020990 7G8_H0.59_L0_Fab Heavy Chain
EVKLEESGGGLVQPGGSMKLSCAASGFTFSDAWMDWVRQSPEKGLEWVAEIRTKDNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29735 - protein, 121 aa, Artificial Sequence; identical to SEQ ID NO: 18796
  Description of Artificial Sequence: Synthetic polypeptide
  VH of XENP020990

SEQ ID NO: 29736 - protein, 5 aa, Artificial Sequence
  Description of Artificial Sequence: Synthetic peptide
  XENP020990 vhCDR1
DAWMD

SEQ ID NO: 29737 - protein, 19 aa, Artificial Sequence
  Description of Artificial Sequence: Synthetic peptide
  XENP020990 vhCDR2
EIRTKDNNHATYYAESVKG

SEQ ID NO: 29738 - protein, 10 aa, Artificial Sequence
  Description of Artificial Sequence: Synthetic peptide
  XENP020990 vhCDR3
LANWDWYFDV

SEQ ID NO: 29739 - protein, 218 aa, Artificial Sequence; identical to SEQ ID NO: 17590
  Description of Artificial Sequence: Synthetic polypeptide
  XENP020990 7G8_H0.59_L0_Fab Light Chain

SEQ ID NO: 29740 - protein, 111 aa, Artificial Sequence; identical to SEQ ID NO: 17591
  Description of Artificial Sequence: Synthetic polypeptide
  VL of XENP020990

SEQ ID NO: 29741 - protein, 15 aa, Artificial Sequence
  Description of Artificial Sequence: Synthetic peptide
  XENP020990 vlCDR1
KASQSVDYDGDSYMN

SEQ ID NO: 29742 - protein, 7 aa, Artificial Sequence
  Description of Artificial Sequence: Synthetic peptide
  XENP020990 vlCDR2
AASNLES

SEQ ID NO: 29743 - protein, 9 aa, Artificial Sequence
  Description of Artificial Sequence: Synthetic peptide
  XENP020990 vlCDR3
QQSNEDPFT

SEQ ID NO: 29744 - protein, 226 aa, Artificial Sequence
  Description of Artificial Sequence: Synthetic polypeptide
  XENP020991 7G8_H0.60_L0_Fab Heavy Chain
EVKLEESGGGLVQPGGSMKLSCAASGFTFSDAWMDWVRQSPEKGLEWVAEIRTKLNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29745 - protein, 121 aa, Artificial Sequence; identical to SEQ ID NO: 18806
  Description of Artificial Sequence: Synthetic polypeptide
  VH of XENP020991

SEQ ID NO: 29746 - protein, 5 aa, Artificial Sequence
  Description of Artificial Sequence: Synthetic peptide
  XENP020991 vhCDR1
DAWMD

SEQ ID NO: 29747 - protein, 19 aa, Artificial Sequence
  Description of Artificial Sequence: Synthetic peptide
  XENP020991 vhCDR2
EIRTKLNNHATYYAESVKG

SEQ ID NO: 29748 - protein, 10 aa, Artificial Sequence
  Description of Artificial Sequence: Synthetic peptide
  XENP020991 vhCDR3
LANWDWYFDV

SEQ ID NO: 29749 - protein, 218 aa, Artificial Sequence; identical to SEQ ID NO: 17590
  Description of Artificial Sequence: Synthetic polypeptide
  XENP020991 7G8_H0.60_L0_Fab Light Chain

SEQ ID NO: 29750 - protein, 111 aa, Artificial Sequence; identical to SEQ ID NO: 17591
  Description of Artificial Sequence: Synthetic polypeptide
  VL of XENP020991

SEQ ID NO: 29751 - protein, 15 aa, Artificial Sequence
  Description of Artificial Sequence: Synthetic peptide
  XENP020991 vlCDR1
KASQSVDYDGDSYMN

SEQ ID NO: 29752 - protein, 7 aa, Artificial Sequence
  Description of Artificial Sequence: Synthetic peptide
  XENP020991 vlCDR2
AASNLES

SEQ ID NO: 29753 - protein, 9 aa, Artificial Sequence
  Description of Artificial Sequence: Synthetic peptide
  XENP020991 vlCDR3
QQSNEDPFT

SEQ ID NO: 29754 - protein, 226 aa, Artificial Sequence
  Description of Artificial Sequence: Synthetic polypeptide
  XENP020992 7G8_H0.61_L0_Fab Heavy Chain
EVKLEESGGGLVQPGGSMKLSCAASGFTFSDAWMDWVRQSPEKGLEWVAEIRTKKNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29755 - protein, 121 aa, Artificial Sequence; identical to SEQ ID NO: 18816
  Description of Artificial Sequence: Synthetic polypeptide
  VH of XENP020992

SEQ ID NO: 29756 - protein, 5 aa, Artificial Sequence
  Description of Artificial Sequence: Synthetic peptide
  XENP020992 vhCDR1
DAWMD

SEQ ID NO: 29757 - protein, 19 aa, Artificial Sequence
  Description of Artificial Sequence: Synthetic peptide
  XENP020992 vhCDR2
EIRTKKNNHATYYAESVKG

SEQ ID NO: 29758 - protein, 10 aa, Artificial Sequence
  Description of Artificial Sequence: Synthetic peptide
  XENP020992 vhCDR3
LANWDWYFDV

SEQ ID NO: 29759 - protein, 218 aa, Artificial Sequence; identical to SEQ ID NO: 17590
  Description of Artificial Sequence: Synthetic polypeptide
  XENP020992 7G8_H0.61_L0_Fab Light Chain

SEQ ID NO: 29760 - protein, 111 aa, Artificial Sequence; identical to SEQ ID NO: 17591
  Description of Artificial Sequence: Synthetic polypeptide
  VL of XENP020992

SEQ ID NO: 29761 - protein, 15 aa, Artificial Sequence
  Description of Artificial Sequence: Synthetic peptide
  XENP020992 vlCDR1
KASQSVDYDGDSYMN

SEQ ID NO: 29762 - protein, 7 aa, Artificial Sequence
  Description of Artificial Sequence: Synthetic peptide
  XENP020992 vlCDR2
AASNLES

SEQ ID NO: 29763 - protein, 9 aa, Artificial Sequence
  Description of Artificial Sequence: Synthetic peptide
  XENP020992 vlCDR3
QQSNEDPFT

SEQ ID NO: 29764 - protein, 226 aa, Artificial Sequence
  Description of Artificial Sequence: Synthetic polypeptide
  XENP020993 7G8_H0.62_L0_Fab Heavy Chain
EVKLEESGGGLVQPGGSMKLSCAASGFTFSDAWMDWVRQSPEKGLEWVAEIRTKYNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29765 - protein, 121 aa, Artificial Sequence; identical to SEQ ID NO: 18826
  Description of Artificial Sequence: Synthetic polypeptide
  VH of XENP020993

SEQ ID NO: 29766 - protein, 5 aa, Artificial Sequence
  Description of Artificial Sequence: Synthetic peptide
  XENP020993 vhCDR1
DAWMD

SEQ ID NO: 29767 - protein, 19 aa, Artificial Sequence
  Description of Artificial Sequence: Synthetic peptide
  XENP020993 vhCDR2
EIRTKYNNHATYYAESVKG

SEQ ID NO: 29768 - protein, 10 aa, Artificial Sequence
  Description of Artificial Sequence: Synthetic peptide
  XENP020993 vhCDR3
LANWDWYFDV

SEQ ID NO: 29769 - protein, 218 aa, Artificial Sequence; identical to SEQ ID NO: 17590
  Description of Artificial Sequence: Synthetic polypeptide
  XENP020993 7G8_H0.62_L0_Fab Light Chain

SEQ ID NO: 29770 - protein, 111 aa, Artificial Sequence; identical to SEQ ID NO: 17591
  Description of Artificial Sequence: Synthetic polypeptide
  VL of XENP020993

SEQ ID NO: 29771 - protein, 15 aa, Artificial Sequence
  Description of Artificial Sequence: Synthetic peptide
  XENP020993 vlCDR1
KASQSVDYDGDSYMN

SEQ ID NO: 29772 - protein, 7 aa, Artificial Sequence
  Description of Artificial Sequence: Synthetic peptide
  XENP020993 vlCDR2
AASNLES

SEQ ID NO: 29773 - protein, 9 aa, Artificial Sequence
  Description of Artificial Sequence: Synthetic peptide
  XENP020993 vlCDR3
QQSNEDPFT

SEQ ID NO: 29774 - protein, 226 aa, Artificial Sequence
  Description of Artificial Sequence: Synthetic polypeptide
  XENP020994 7G8_H0.63_L0_Fab Heavy Chain
EVKLEESGGGLVQPGGSMKLSCAASGFTFSDAWMDWVRQSPEKGLEWVAEIRTKADNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29775 - protein, 121 aa, Artificial Sequence; identical to SEQ ID NO: 18836
  Description of Artificial Sequence: Synthetic polypeptide
  VH of XENP020994

SEQ ID NO: 29776 - protein, 5 aa, Artificial Sequence
  Description of Artificial Sequence: Synthetic peptide
  XENP020994 vhCDR1
DAWMD

SEQ ID NO: 29777 - protein, 19 aa, Artificial Sequence
  Description of Artificial Sequence: Synthetic peptide
  XENP020994 vhCDR2
EIRTKADNHATYYAESVKG

SEQ ID NO: 29778 - protein, 10 aa, Artificial Sequence
  Description of Artificial Sequence: Synthetic peptide
  XENP020994 vhCDR3
LANWDWYFDV

SEQ ID NO: 29779 - protein, 218 aa, Artificial Sequence; identical to SEQ ID NO: 17590
  Description of Artificial Sequence: Synthetic polypeptide
  XENP020994 7G8_H0.63_L0_Fab Light Chain

SEQ ID NO: 29780 - protein, 111 aa, Artificial Sequence; identical to SEQ ID NO: 17591
  Description of Artificial Sequence: Synthetic polypeptide
  VL of XENP020994

SEQ ID NO: 29781 - protein, 15 aa, Artificial Sequence
  Description of Artificial Sequence: Synthetic peptide
  XENP020994 vlCDR1
KASQSVDYDGDSYMN

SEQ ID NO: 29782 - protein, 7 aa, Artificial Sequence
  Description of Artificial Sequence: Synthetic peptide
  XENP020994 vlCDR2
AASNLES

SEQ ID NO: 29783 - protein, 9 aa, Artificial Sequence
  Description of Artificial Sequence: Synthetic peptide
  XENP020994 vlCDR3
QQSNEDPFT

SEQ ID NO: 29784 - protein, 226 aa, Artificial Sequence
  Description of Artificial Sequence: Synthetic polypeptide
  XENP020995 7G8_H0.64_L0_Fab Heavy Chain
EVKLEESGGGLVQPGGSMKLSCAASGFTFSDAWMDWVRQSPEKGLEWVAEIRTKAHNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29785 - protein, 121 aa, Artificial Sequence; identical to SEQ ID NO: 18846
  Description of Artificial Sequence: Synthetic polypeptide
  VH of XENP020995

SEQ ID NO: 29786 - protein, 5 aa, Artificial Sequence
  Description of Artificial Sequence: Synthetic peptide
  XENP020995 vhCDR1
DAWMD

SEQ ID NO: 29787 - protein, 19 aa, Artificial Sequence
  Description of Artificial Sequence: Synthetic peptide
  XENP020995 vhCDR2
EIRTKAHNHATYYAESVKG

SEQ ID NO: 29788 - protein, 10 aa, Artificial Sequence
  Description of Artificial Sequence: Synthetic peptide
  XENP020995 vhCDR3
LANWDWYFDV

SEQ ID NO: 29789 - protein, 218 aa, Artificial Sequence; identical to SEQ ID NO: 17590
  Description of Artificial Sequence: Synthetic polypeptide
  XENP020995 7G8_H0.64_L0_Fab Light Chain

SEQ ID NO: 29790 - protein, 111 aa, Artificial Sequence; identical to SEQ ID NO: 17591
  Description of Artificial Sequence: Synthetic polypeptide
  VL of XENP020995

SEQ ID NO: 29791 - protein, 15 aa, Artificial Sequence
  Description of Artificial Sequence: Synthetic peptide
  XENP020995 vlCDR1
KASQSVDYDGDSYMN

SEQ ID NO: 29792 - protein, 7 aa, Artificial Sequence
  Description of Artificial Sequence: Synthetic peptide
  XENP020995 vlCDR2
AASNLES

SEQ ID NO: 29793 - protein, 9 aa, Artificial Sequence
  Description of Artificial Sequence: Synthetic peptide
  XENP020995 vlCDR3
QQSNEDPFT

SEQ ID NO: 29794 - protein, 226 aa, Artificial Sequence
  Description of Artificial Sequence: Synthetic polypeptide
  XENP020996 7G8_H0.65_L0_Fab Heavy Chain
EVKLEESGGGLVQPGGSMKLSCAASGFTFSDAWMDWVRQSPEKGLEWVAEIRTKAENHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29795 - protein, 121 aa, Artificial Sequence; identical to SEQ ID NO: 18856
  Description of Artificial Sequence: Synthetic polypeptide
  VH of XENP020996

SEQ ID NO: 29796 - protein, 5 aa, Artificial Sequence
  Description of Artificial Sequence: Synthetic peptide
  XENP020996 vhCDR1
DAWMD

SEQ ID NO: 29797 - protein, 19 aa, Artificial Sequence
  Description of Artificial Sequence: Synthetic peptide
  XENP020996 vhCDR2
EIRTKAENHATYYAESVKG

SEQ ID NO: 29798 - protein, 10 aa, Artificial Sequence
  Description of Artificial Sequence: Synthetic peptide
  XENP020996 vhCDR3
LANWDWYFDV

SEQ ID NO: 29799 - protein, 218 aa, Artificial Sequence; identical to SEQ ID NO: 17590
  Description of Artificial Sequence: Synthetic polypeptide
  XENP020996 7G8_H0.65_L0_Fab Light Chain

SEQ ID NO: 29800 - protein, 111 aa, Artificial Sequence; identical to SEQ ID NO: 17591
  Description of Artificial Sequence: Synthetic polypeptide
  VL of XENP020996

SEQ ID NO: 29801 - protein, 15 aa, Artificial Sequence
  Description of Artificial Sequence: Synthetic peptide
  XENP020996 vlCDR1
KASQSVDYDGDSYMN

SEQ ID NO: 29802 - protein, 7 aa, Artificial Sequence
  Description of Artificial Sequence: Synthetic peptide
  XENP020996 vlCDR2
AASNLES

SEQ ID NO: 29803 - protein, 9 aa, Artificial Sequence
  Description of Artificial Sequence: Synthetic peptide
  XENP020996 vlCDR3
QQSNEDPFT

SEQ ID NO: 29804 - protein, 226 aa, Artificial Sequence
  Description of Artificial Sequence: Synthetic polypeptide
  XENP021001 7G8_H0.66_L0_Fab Heavy Chain
EVKLEESGGGLVQPGGSMKLSCAASGFTFSDAWMDWVRQSPEKGLEWVAEIRTKASNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29805 - protein, 121 aa, Artificial Sequence; identical to SEQ ID NO: 18866
  Description of Artificial Sequence: Synthetic polypeptide
  VH of XENP021001

SEQ ID NO: 29806 - protein, 5 aa, Artificial Sequence
  Description of Artificial Sequence: Synthetic peptide
  XENP021001 vhCDR1
DAWMD

SEQ ID NO: 29807 - protein, 19 aa, Artificial Sequence
  Description of Artificial Sequence: Synthetic peptide
  XENP021001 vhCDR2
EIRTKASNHATYYAESVKG

SEQ ID NO: 29808 - protein, 10 aa, Artificial Sequence
  Description of Artificial Sequence: Synthetic peptide
  XENP021001 vhCDR3
LANWDWYFDV

SEQ ID NO: 29809 - protein, 218 aa, Artificial Sequence; identical to SEQ ID NO: 17590
  Description of Artificial Sequence: Synthetic polypeptide
  XENP021001 7G8_H0.66_L0_Fab Light Chain

SEQ ID NO: 29810 - protein, 111 aa, Artificial Sequence; identical to SEQ ID NO: 17591
  Description of Artificial Sequence: Synthetic polypeptide
  VL of XENP021001

SEQ ID NO: 29811 - protein, 15 aa, Artificial Sequence
  Description of Artificial Sequence: Synthetic peptide
  XENP021001 vlCDR1
KASQSVDYDGDSYMN

SEQ ID NO: 29812 - protein, 7 aa, Artificial Sequence
  Description of Artificial Sequence: Synthetic peptide
  XENP021001 vlCDR2
AASNLES

SEQ ID NO: 29813 - protein, 9 aa, Artificial Sequence
  Description of Artificial Sequence: Synthetic peptide
  XENP021001 vlCDR3
QQSNEDPFT

SEQ ID NO: 29814 - protein, 226 aa, Artificial Sequence
  Description of Artificial Sequence: Synthetic polypeptide
  XENP021002 7G8_H0.67_L0_Fab Heavy Chain
EVKLEESGGGLVQPGGSMKLSCAASGFTFSDAWMDWVRQSPEKGLEWVAEIRTKARNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29815 - protein, 121 aa, Artificial Sequence; identical to SEQ ID NO: 18876
  Description of Artificial Sequence: Synthetic polypeptide
  VH of XENP021002

SEQ ID NO: 29816 - protein, 5 aa, Artificial Sequence
  Description of Artificial Sequence: Synthetic peptide
  XENP021002 vhCDR1
DAWMD

SEQ ID NO: 29817 - protein, 19 aa, Artificial Sequence
  Description of Artificial Sequence: Synthetic peptide
  XENP021002 vhCDR2
EIRTKARNHATYYAESVKG

SEQ ID NO: 29818 - protein, 10 aa, Artificial Sequence
  Description of Artificial Sequence: Synthetic peptide
  XENP021002 vhCDR3
LANWDWYFDV

SEQ ID NO: 29819 - protein, 218 aa, Artificial Sequence; identical to SEQ ID NO: 17590
  Description of Artificial Sequence: Synthetic polypeptide
  XENP021002 7G8_H0.67_L0_Fab Light Chain

SEQ ID NO: 29820 - protein, 111 aa, Artificial Sequence; identical to SEQ ID NO: 17591
  Description of Artificial Sequence: Synthetic polypeptide
  VL of XENP021002

SEQ ID NO: 29821 - protein, 15 aa, Artificial Sequence
  Description of Artificial Sequence: Synthetic peptide
  XENP021002 vlCDR1
KASQSVDYDGDSYMN

SEQ ID NO: 29822 - protein, 7 aa, Artificial Sequence
  Description of Artificial Sequence: Synthetic peptide
  XENP021002 vlCDR2
AASNLES

SEQ ID NO: 29823 - protein, 9 aa, Artificial Sequence
  Description of Artificial Sequence: Synthetic peptide
  XENP021002 vlCDR3
QQSNEDPFT

SEQ ID NO: 29824 - protein, 226 aa, Artificial Sequence
  Description of Artificial Sequence: Synthetic polypeptide
  XENP021003 7G8_H0.68_L0_Fab Heavy Chain
EVKLEESGGGLVQPGGSMKLSCAASGFTFSDAWMDWVRQSPEKGLEWVAEIRTKALNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29825 - protein, 121 aa, Artificial Sequence; identical to SEQ ID NO: 18886
  Description of Artificial Sequence: Synthetic polypeptide
  VH of XENP021003

SEQ ID NO: 29826 - protein, 5 aa, Artificial Sequence
  Description of Artificial Sequence: Synthetic peptide
  XENP021003 vhCDR1
DAWMD

SEQ ID NO: 29827 - protein, 19 aa, Artificial Sequence
  Description of Artificial Sequence: Synthetic peptide
  XENP021003 vhCDR2
EIRTKALNHATYYAESVKG

SEQ ID NO: 29828 - protein, 10 aa, Artificial Sequence
  Description of Artificial Sequence: Synthetic peptide
  XENP021003 vhCDR3
LANWDWYFDV

SEQ ID NO: 29829 - protein, 218 aa, Artificial Sequence; identical to SEQ ID NO: 17590
  Description of Artificial Sequence: Synthetic polypeptide
  XENP021003 7G8_H0.68_L0_Fab Light Chain

SEQ ID NO: 29830 - protein, 111 aa, Artificial Sequence; identical to SEQ ID NO: 17591
  Description of Artificial Sequence: Synthetic polypeptide
  VL of XENP021003

SEQ ID NO: 29831 - protein, 15 aa, Artificial Sequence
  Description of Artificial Sequence: Synthetic peptide
  XENP021003 vlCDR1
KASQSVDYDGDSYMN

SEQ ID NO: 29832 - protein, 7 aa, Artificial Sequence
  Description of Artificial Sequence: Synthetic peptide
  XENP021003 vlCDR2
AASNLES

SEQ ID NO: 29833 - protein, 9 aa, Artificial Sequence
  Description of Artificial Sequence: Synthetic peptide
  XENP021003 vlCDR3
QQSNEDPFT

SEQ ID NO: 29834 - protein, 226 aa, Artificial Sequence
  Description of Artificial Sequence: Synthetic polypeptide
  XENP021004 7G8_H0.69_L0_Fab Heavy Chain
EVKLEESGGGLVQPGGSMKLSCAASGFTFSDAWMDWVRQSPEKGLEWVAEIRTKATNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29835 - protein, 121 aa, Artificial Sequence; identical to SEQ ID NO: 18896
  Description of Artificial Sequence: Synthetic polypeptide
  VH of XENP021004

SEQ ID NO: 29836 - protein, 5 aa, Artificial Sequence
  Description of Artificial Sequence: Synthetic peptide
  XENP021004 vhCDR1
DAWMD

SEQ ID NO: 29837 - protein, 19 aa, Artificial Sequence
  Description of Artificial Sequence: Synthetic peptide
  XENP021004 vhCDR2
EIRTKATNHATYYAESVKG

SEQ ID NO: 29838 - protein, 10 aa, Artificial Sequence
  Description of Artificial Sequence: Synthetic peptide
  XENP021004 vhCDR3
LANWDWYFDV

SEQ ID NO: 29839 - protein, 218 aa, Artificial Sequence; identical to SEQ ID NO: 17590
  Description of Artificial Sequence: Synthetic polypeptide
  XENP021004 7G8_H0.69_L0_Fab Light Chain

SEQ ID NO: 29840 - protein, 111 aa, Artificial Sequence; identical to SEQ ID NO: 17591
  Description of Artificial Sequence: Synthetic polypeptide
  VL of XENP021004

SEQ ID NO: 29841 - protein, 15 aa, Artificial Sequence
  Description of Artificial Sequence: Synthetic peptide
  XENP021004 vlCDR1
KASQSVDYDGDSYMN

SEQ ID NO: 29842 - protein, 7 aa, Artificial Sequence
  Description of Artificial Sequence: Synthetic peptide
  XENP021004 vlCDR2
AASNLES

SEQ ID NO: 29843 - protein, 9 aa, Artificial Sequence
  Description of Artificial Sequence: Synthetic peptide
  XENP021004 vlCDR3
QQSNEDPFT

SEQ ID NO: 29844 - protein, 226 aa, Artificial Sequence
  Description of Artificial Sequence: Synthetic polypeptide
  XENP021005 7G8_H0.70_L0_Fab Heavy Chain
EVKLEESGGGLVQPGGSMKLSCAASGFTFSDAWMDWVRQSPEKGLEWVAEIRTKAGNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29845 - protein, 121 aa, Artificial Sequence; identical to SEQ ID NO: 18906
  Description of Artificial Sequence: Synthetic polypeptide
  VH of XENP021005

SEQ ID NO: 29846 - protein, 5 aa, Artificial Sequence
  Description of Artificial Sequence: Synthetic peptide
  XENP021005 vhCDR1
DAWMD

SEQ ID NO: 29847 - protein, 19 aa, Artificial Sequence
  Description of Artificial Sequence: Synthetic peptide
  XENP021005 vhCDR2
EIRTKAGNHATYYAESVKG

SEQ ID NO: 29848 - protein, 10 aa, Artificial Sequence
  Description of Artificial Sequence: Synthetic peptide
  XENP021005 vhCDR3
LANWDWYFDV

SEQ ID NO: 29849 - protein, 218 aa, Artificial Sequence; identical to SEQ ID NO: 17590
  Description of Artificial Sequence: Synthetic polypeptide
  XENP021005 7G8_H0.70_L0_Fab Light Chain

SEQ ID NO: 29850 - protein, 111 aa, Artificial Sequence; identical to SEQ ID NO: 17591
  Description of Artificial Sequence: Synthetic polypeptide
  VL of XENP021005

SEQ ID NO: 29851 - protein, 15 aa, Artificial Sequence
  Description of Artificial Sequence: Synthetic peptide
  XENP021005 vlCDR1
KASQSVDYDGDSYMN

SEQ ID NO: 29852 - protein, 7 aa, Artificial Sequence
  Description of Artificial Sequence: Synthetic peptide
  XENP021005 vlCDR2
AASNLES

SEQ ID NO: 29853 - protein, 9 aa, Artificial Sequence
  Description of Artificial Sequence: Synthetic peptide
  XENP021005 vlCDR3
QQSNEDPFT

SEQ ID NO: 29854 - protein, 226 aa, Artificial Sequence
  Description of Artificial Sequence: Synthetic polypeptide
  XENP021006 7G8_H0.71_L0_Fab Heavy Chain
EVKLEESGGGLVQPGGSMKLSCAASGFTFSDAWMDWVRQSPEKGLEWVAEIRTKAYNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29855 - protein, 121 aa, Artificial Sequence; identical to SEQ ID NO: 18916
  Description of Artificial Sequence: Synthetic polypeptide
  VH of XENP021006

SEQ ID NO: 29856 - protein, 5 aa, Artificial Sequence
  Description of Artificial Sequence: Synthetic peptide
  XENP021006 vhCDR1
DAWMD

SEQ ID NO: 29857 - protein, 19 aa, Artificial Sequence
  Description of Artificial Sequence: Synthetic peptide
  XENP021006 vhCDR2
EIRTKAYNHATYYAESVKG

SEQ ID NO: 29858 - protein, 10 aa, Artificial Sequence
  Description of Artificial Sequence: Synthetic peptide
  XENP021006 vhCDR3
LANWDWYFDV

SEQ ID NO: 29859 - protein, 218 aa, Artificial Sequence; identical to SEQ ID NO: 17590
  Description of Artificial Sequence: Synthetic polypeptide
  XENP021006 7G8_H0.71_L0_Fab Light Chain

SEQ ID NO: 29860 - protein, 111 aa, Artificial Sequence; identical to SEQ ID NO: 17591
  Description of Artificial Sequence: Synthetic polypeptide
  VL of XENP021006

SEQ ID NO: 29861 - protein, 15 aa, Artificial Sequence
  Description of Artificial Sequence: Synthetic peptide
  XENP021006 vlCDR1
KASQSVDYDGDSYMN

SEQ ID NO: 29862 - protein, 7 aa, Artificial Sequence
  Description of Artificial Sequence: Synthetic peptide
  XENP021006 vlCDR2
AASNLES

SEQ ID NO: 29863 - protein, 9 aa, Artificial Sequence
  Description of Artificial Sequence: Synthetic peptide
  XENP021006 vlCDR3
QQSNEDPFT

SEQ ID NO: 29864 - protein, 226 aa, Artificial Sequence
  Description of Artificial Sequence: Synthetic polypeptide
  XENP021007 7G8_H0.72_L0_Fab Heavy Chain
EVKLEESGGGLVQPGGSMKLSCAASGFTFSDAWMDWVRQSPEKGLEWVAEIRTKANDHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29865 - protein, 121 aa, Artificial Sequence; identical to SEQ ID NO: 18926
  Description of Artificial Sequence: Synthetic polypeptide
  VH of XENP021007

SEQ ID NO: 29866 - protein, 5 aa, Artificial Sequence
  Description of Artificial Sequence: Synthetic peptide
  XENP021007 vhCDR1
DAWMD

SEQ ID NO: 29867 - protein, 19 aa, Artificial Sequence
  Description of Artificial Sequence: Synthetic peptide
  XENP021007 vhCDR2
EIRTKANDHATYYAESVKG

SEQ ID NO: 29868 - protein, 10 aa, Artificial Sequence
  Description of Artificial Sequence: Synthetic peptide
  XENP021007 vhCDR3
LANWDWYFDV

SEQ ID NO: 29869 - protein, 218 aa, Artificial Sequence; identical to SEQ ID NO: 17590
  Description of Artificial Sequence: Synthetic polypeptide
  XENP021007 7G8_H0.72_L0_Fab Light Chain

SEQ ID NO: 29870 - protein, 111 aa, Artificial Sequence; identical to SEQ ID NO: 17591
  Description of Artificial Sequence: Synthetic polypeptide
  VL of XENP021007

SEQ ID NO: 29871 - protein, 15 aa, Artificial Sequence
  Description of Artificial Sequence: Synthetic peptide
  XENP021007 vlCDR1
KASQSVDYDGDSYMN

SEQ ID NO: 29872 - protein, 7 aa, Artificial Sequence
  Description of Artificial Sequence: Synthetic peptide
  XENP021007 vlCDR2
AASNLES

SEQ ID NO: 29873 - protein, 9 aa, Artificial Sequence
  Description of Artificial Sequence: Synthetic peptide
  XENP021007 vlCDR3
QQSNEDPFT

SEQ ID NO: 29874 - protein, 226 aa, Artificial Sequence
  Description of Artificial Sequence: Synthetic polypeptide
  XENP021008 7G8_H0.73_L0_Fab Heavy Chain
EVKLEESGGGLVQPGGSMKLSCAASGFTFSDAWMDWVRQSPEKGLEWVAEIRTKANHHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29875 - protein, 121 aa, Artificial Sequence; identical to SEQ ID NO: 18936
  Description of Artificial Sequence: Synthetic polypeptide
  VH of XENP021008

SEQ ID NO: 29876 - protein, 5 aa, Artificial Sequence
  Description of Artificial Sequence: Synthetic peptide
  XENP021008 vhCDR1
DAWMD

SEQ ID NO: 29877 - protein, 19 aa, Artificial Sequence
  Description of Artificial Sequence: Synthetic peptide
  XENP021008 vhCDR2
EIRTKANHHATYYAESVKG

SEQ ID NO: 29878 - protein, 10 aa, Artificial Sequence
  Description of Artificial Sequence: Synthetic peptide
  XENP021008 vhCDR3
LANWDWYFDV

SEQ ID NO: 29879 - protein, 218 aa, Artificial Sequence; identical to SEQ ID NO: 17590
  Description of Artificial Sequence: Synthetic polypeptide
  XENP021008 7G8_H0.73_L0_Fab Light Chain

SEQ ID NO: 29880 - protein, 111 aa, Artificial Sequence; identical to SEQ ID NO: 17591
  Description of Artificial Sequence: Synthetic polypeptide
  VL of XENP021008

SEQ ID NO: 29881 - protein, 15 aa, Artificial Sequence
  Description of Artificial Sequence: Synthetic peptide
  XENP021008 vlCDR1
KASQSVDYDGDSYMN

SEQ ID NO: 29882 - protein, 7 aa, Artificial Sequence
  Description of Artificial Sequence: Synthetic peptide
  XENP021008 vlCDR2
AASNLES

SEQ ID NO: 29883 - protein, 9 aa, Artificial Sequence
  Description of Artificial Sequence: Synthetic peptide
  XENP021008 vlCDR3
QQSNEDPFT

SEQ ID NO: 29884 - protein, 226 aa, Artificial Sequence
  Description of Artificial Sequence: Synthetic polypeptide
  XENP021009 7G8_H0.74_L0_Fab Heavy Chain
EVKLEESGGGLVQPGGSMKLSCAASGFTFSDAWMDWVRQSPEKGLEWVAEIRTKANEHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29885 - protein, 121 aa, Artificial Sequence; identical to SEQ ID NO: 18946
  Description of Artificial Sequence: Synthetic polypeptide
  VH of XENP021009

SEQ ID NO: 29886 - protein, 5 aa, Artificial Sequence
  Description of Artificial Sequence: Synthetic peptide
  XENP021009 vhCDR1
DAWMD

SEQ ID NO: 29887 - protein, 19 aa, Artificial Sequence
  Description of Artificial Sequence: Synthetic peptide
  XENP021009 vhCDR2
EIRTKANEHATYYAESVKG

SEQ ID NO: 29888 - protein, 10 aa, Artificial Sequence
  Description of Artificial Sequence: Synthetic peptide
  XENP021009 vhCDR3
LANWDWYFDV

SEQ ID NO: 29889 - protein, 218 aa, Artificial Sequence; identical to SEQ ID NO: 17590
  Description of Artificial Sequence: Synthetic polypeptide
  XENP021009 7G8_H0.74_L0_Fab Light Chain

SEQ ID NO: 29890 - protein, 111 aa, Artificial Sequence; identical to SEQ ID NO: 17591
  Description of Artificial Sequence: Synthetic polypeptide
  VL of XENP021009

SEQ ID NO: 29891 - protein, 15 aa, Artificial Sequence
  Description of Artificial Sequence: Synthetic peptide
  XENP021009 vlCDR1
KASQSVDYDGDSYMN

SEQ ID NO: 29892 - protein, 7 aa, Artificial Sequence
  Description of Artificial Sequence: Synthetic peptide
  XENP021009 vlCDR2
AASNLES

SEQ ID NO: 29893 - protein, 9 aa, Artificial Sequence
  Description of Artificial Sequence: Synthetic peptide
  XENP021009 vlCDR3
QQSNEDPFT

SEQ ID NO: 29894 - protein, 226 aa, Artificial Sequence
  Description of Artificial Sequence: Synthetic polypeptide
  XENP021010 7G8_H0.75_L0_Fab Heavy Chain
EVKLEESGGGLVQPGGSMKLSCAASGFTFSDAWMDWVRQSPEKGLEWVAEIRTKANSHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29895 - protein, 121 aa, Artificial Sequence; identical to SEQ ID NO: 18956
  Description of Artificial Sequence: Synthetic polypeptide
  VH of XENP021010

SEQ ID NO: 29896 - protein, 5 aa, Artificial Sequence
  Description of Artificial Sequence: Synthetic peptide
  XENP021010 vhCDR1
DAWMD

SEQ ID NO: 29897 - protein, 19 aa, Artificial Sequence
  Description of Artificial Sequence: Synthetic peptide
  XENP021010 vhCDR2
EIRTKANSHATYYAESVKG

SEQ ID NO: 29898 - protein, 10 aa, Artificial Sequence
  Description of Artificial Sequence: Synthetic peptide
  XENP021010 vhCDR3
LANWDWYFDV

SEQ ID NO: 29899 - protein, 218 aa, Artificial Sequence; identical to SEQ ID NO: 17590
  Description of Artificial Sequence: Synthetic polypeptide
  XENP021010 7G8_H0.75_L0_Fab Light Chain

SEQ ID NO: 29900 - protein, 111 aa, Artificial Sequence; identical to SEQ ID NO: 17591
  Description of Artificial Sequence: Synthetic polypeptide
  VL of XENP021010

SEQ ID NO: 29901 - protein, 15 aa, Artificial Sequence
  Description of Artificial Sequence: Synthetic peptide
  XENP021010 vlCDR1
KASQSVDYDGDSYMN

SEQ ID NO: 29902 - protein, 7 aa, Artificial Sequence
  Description of Artificial Sequence: Synthetic peptide
  XENP021010 vlCDR2
AASNLES

SEQ ID NO: 29903 - protein, 9 aa, Artificial Sequence
  Description of Artificial Sequence: Synthetic peptide
  XENP021010 vlCDR3
QQSNEDPFT

SEQ ID NO: 29904 - protein, 226 aa, Artificial Sequence
  Description of Artificial Sequence: Synthetic polypeptide
  XENP021011 7G8_H0.76_L0_Fab Heavy Chain
EVKLEESGGGLVQPGGSMKLSCAASGFTFSDAWMDWVRQSPEKGLEWVAEIRTKANRHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29905 - protein, 121 aa, Artificial Sequence; identical to SEQ ID NO: 18966
  Description of Artificial Sequence: Synthetic polypeptide
  VH of XENP021011

SEQ ID NO: 29906 - protein, 5 aa, Artificial Sequence
  Description of Artificial Sequence: Synthetic peptide
  XENP021011 vhCDR1
DAWMD

SEQ ID NO: 29907 - protein, 19 aa, Artificial Sequence
  Description of Artificial Sequence: Synthetic peptide
  XENP021011 vhCDR2
EIRTKANRHATYYAESVKG

SEQ ID NO: 29908 - protein, 10 aa, Artificial Sequence
  Description of Artificial Sequence: Synthetic peptide
  XENP021011 vhCDR3
LANWDWYFDV

SEQ ID NO: 29909 - protein, 218 aa, Artificial Sequence; identical to SEQ ID NO: 17590
  Description of Artificial Sequence: Synthetic polypeptide
  XENP021011 7G8_H0.76_L0_Fab Light Chain

SEQ ID NO: 29910 - protein, 111 aa, Artificial Sequence; identical to SEQ ID NO: 17591
  Description of Artificial Sequence: Synthetic polypeptide
  VL of XENP021011

SEQ ID NO: 29911 - protein, 15 aa, Artificial Sequence
  Description of Artificial Sequence: Synthetic peptide
  XENP021011 vlCDR1
KASQSVDYDGDSYMN

SEQ ID NO: 29912 - protein, 7 aa, Artificial Sequence
  Description of Artificial Sequence: Synthetic peptide
  XENP021011 vlCDR2
AASNLES

SEQ ID NO: 29913 - protein, 9 aa, Artificial Sequence
  Description of Artificial Sequence: Synthetic peptide
  XENP021011 vlCDR3
QQSNEDPFT

SEQ ID NO: 29914 - protein, 226 aa, Artificial Sequence
  Description of Artificial Sequence: Synthetic polypeptide
  XENP021012 7G8_H0.77_L0_Fab Heavy Chain
EVKLEESGGGLVQPGGSMKLSCAASGFTFSDAWMDWVRQSPEKGLEWVAEIRTKANLHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29915 - protein, 121 aa, Artificial Sequence; identical to SEQ ID NO: 18976
  Description of Artificial Sequence: Synthetic polypeptide
  VH of XENP021012

SEQ ID NO: 29916 - protein, 5 aa, Artificial Sequence
  Description of Artificial Sequence: Synthetic peptide
  XENP021012 vhCDR1
DAWMD

SEQ ID NO: 29917 - protein, 19 aa, Artificial Sequence
  Description of Artificial Sequence: Synthetic peptide
  XENP021012 vhCDR2
EIRTKANLHATYYAESVKG

SEQ ID NO: 29918 - protein, 10 aa, Artificial Sequence
  Description of Artificial Sequence: Synthetic peptide
  XENP021012 vhCDR3
LANWDWYFDV

SEQ ID NO: 29919 - protein, 218 aa, Artificial Sequence; identical to SEQ ID NO: 17590
  Description of Artificial Sequence: Synthetic polypeptide
  XENP021012 7G8_H0.77_L0_Fab Light Chain

SEQ ID NO: 29920 - protein, 111 aa, Artificial Sequence; identical to SEQ ID NO: 17591
  Description of Artificial Sequence: Synthetic polypeptide
  VL of XENP021012

SEQ ID NO: 29921 - protein, 15 aa, Artificial Sequence
  Description of Artificial Sequence: Synthetic peptide
  XENP021012 vlCDR1
KASQSVDYDGDSYMN

SEQ ID NO: 29922 - protein, 7 aa, Artificial Sequence
  Description of Artificial Sequence: Synthetic peptide
  XENP021012 vlCDR2
AASNLES

SEQ ID NO: 29923 - protein, 9 aa, Artificial Sequence
  Description of Artificial Sequence: Synthetic peptide
  XENP021012 vlCDR3
QQSNEDPFT

SEQ ID NO: 29924 - protein, 226 aa, Artificial Sequence
  Description of Artificial Sequence: Synthetic polypeptide
  XENP021013 7G8_H0.78_L0_Fab Heavy Chain
EVKLEESGGGLVQPGGSMKLSCAASGFTFSDAWMDWVRQSPEKGLEWVAEIRTKANTHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29925 - protein, 121 aa, Artificial Sequence; identical to SEQ ID NO: 18986
  Description of Artificial Sequence: Synthetic polypeptide
  VH of XENP021013

SEQ ID NO: 29926 - protein, 5 aa, Artificial Sequence
  Description of Artificial Sequence: Synthetic peptide
  XENP021013 vhCDR1
DAWMD

SEQ ID NO: 29927 - protein, 19 aa, Artificial Sequence
  Description of Artificial Sequence: Synthetic peptide
  XENP021013 vhCDR2
EIRTKANTHATYYAESVKG

SEQ ID NO: 29928 - protein, 10 aa, Artificial Sequence
  Description of Artificial Sequence: Synthetic peptide
  XENP021013 vhCDR3
LANWDWYFDV

SEQ ID NO: 29929 - protein, 218 aa, Artificial Sequence; identical to SEQ ID NO: 17590
  Description of Artificial Sequence: Synthetic polypeptide
  XENP021013 7G8_H0.78_L0_Fab Light Chain

SEQ ID NO: 29930 - protein, 111 aa, Artificial Sequence; identical to SEQ ID NO: 17591
  Description of Artificial Sequence: Synthetic polypeptide
  VL of XENP021013

SEQ ID NO: 29931 - protein, 15 aa, Artificial Sequence
  Description of Artificial Sequence: Synthetic peptide
  XENP021013 vlCDR1
KASQSVDYDGDSYMN

SEQ ID NO: 29932 - protein, 7 aa, Artificial Sequence
  Description of Artificial Sequence: Synthetic peptide
  XENP021013 vlCDR2
AASNLES

SEQ ID NO: 29933 - protein, 9 aa, Artificial Sequence
  Description of Artificial Sequence: Synthetic peptide
  XENP021013 vlCDR3
QQSNEDPFT

SEQ ID NO: 29934 - protein, 226 aa, Artificial Sequence
  Description of Artificial Sequence: Synthetic polypeptide
  XENP021014 7G8_H0.79_L0_Fab Heavy Chain
EVKLEESGGGLVQPGGSMKLSCAASGFTFSDAWMDWVRQSPEKGLEWVAEIRTKANGHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29935 - protein, 121 aa, Artificial Sequence; identical to SEQ ID NO: 18996
  Description of Artificial Sequence: Synthetic polypeptide
  VH of XENP021014

SEQ ID NO: 29936 - protein, 5 aa, Artificial Sequence
  Description of Artificial Sequence: Synthetic peptide
  XENP021014 vhCDR1
DAWMD

SEQ ID NO: 29937 - protein, 19 aa, Artificial Sequence
  Description of Artificial Sequence: Synthetic peptide
  XENP021014 vhCDR2
EIRTKANGHATYYAESVKG

SEQ ID NO: 29938 - protein, 10 aa, Artificial Sequence
  Description of Artificial Sequence: Synthetic peptide
  XENP021014 vhCDR3
LANWDWYFDV

SEQ ID NO: 29939 - protein, 218 aa, Artificial Sequence; identical to SEQ ID NO: 17590
  Description of Artificial Sequence: Synthetic polypeptide
  XENP021014 7G8_H0.79_L0_Fab Light Chain

SEQ ID NO: 29940 - protein, 111 aa, Artificial Sequence; identical to SEQ ID NO: 17591
  Description of Artificial Sequence: Synthetic polypeptide
  VL of XENP021014

SEQ ID NO: 29941 - protein, 15 aa, Artificial Sequence
  Description of Artificial Sequence: Synthetic peptide
  XENP021014 vlCDR1
KASQSVDYDGDSYMN

SEQ ID NO: 29942 - protein, 7 aa, Artificial Sequence
  Description of Artificial Sequence: Synthetic peptide
  XENP021014 vlCDR2
AASNLES

SEQ ID NO: 29943 - protein, 9 aa, Artificial Sequence
  Description of Artificial Sequence: Synthetic peptide
  XENP021014 vlCDR3
QQSNEDPFT

SEQ ID NO: 29944 - protein, 226 aa, Artificial Sequence
  Description of Artificial Sequence: Synthetic polypeptide
  XENP021015 7G8_H0.80_L0_Fab Heavy Chain
EVKLEESGGGLVQPGGSMKLSCAASGFTFSDAWMDWVRQSPEKGLEWVAEIRTKANYHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29945 - protein, 121 aa, Artificial Sequence; identical to SEQ ID NO: 19006
  Description of Artificial Sequence: Synthetic polypeptide
  VH of XENP021015

SEQ ID NO: 29946 - protein, 5 aa, Artificial Sequence
  Description of Artificial Sequence: Synthetic peptide
  XENP021015 vhCDR1
DAWMD

SEQ ID NO: 29947 - protein, 19 aa, Artificial Sequence
  Description of Artificial Sequence: Synthetic peptide
  XENP021015 vhCDR2
EIRTKANYHATYYAESVKG

SEQ ID NO: 29948 - protein, 10 aa, Artificial Sequence
  Description of Artificial Sequence: Synthetic peptide
  XENP021015 vhCDR3
LANWDWYFDV

SEQ ID NO: 29949 - protein, 218 aa, Artificial Sequence; identical to SEQ ID NO: 17590
  Description of Artificial Sequence: Synthetic polypeptide
  XENP021015 7G8_H0.80_L0_Fab Light Chain

SEQ ID NO: 29950 - protein, 111 aa, Artificial Sequence; identical to SEQ ID NO: 17591
  Description of Artificial Sequence: Synthetic polypeptide
  VL of XENP021015

SEQ ID NO: 29951 - protein, 15 aa, Artificial Sequence
  Description of Artificial Sequence: Synthetic peptide
  XENP021015 vlCDR1
KASQSVDYDGDSYMN

SEQ ID NO: 29952 - protein, 7 aa, Artificial Sequence
  Description of Artificial Sequence: Synthetic peptide
  XENP021015 vlCDR2
AASNLES

SEQ ID NO: 29953 - protein, 9 aa, Artificial Sequence
  Description of Artificial Sequence: Synthetic peptide
  XENP021015 vlCDR3
QQSNEDPFT

SEQ ID NO: 29954 - protein, 226 aa, Artificial Sequence
  Description of Artificial Sequence: Synthetic polypeptide
  XENP021016 7G8_H0.81_L0_Fab Heavy Chain
EVKLEESGGGLVQPGGSMKLSCAASGFTFSDAWMDWVRQSPEKGLEWVAEIRTKANNYATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29955 - protein, 121 aa, Artificial Sequence; identical to SEQ ID NO: 19016
  Description of Artificial Sequence: Synthetic polypeptide
  VH of XENP021016

SEQ ID NO: 29956 - protein, 5 aa, Artificial Sequence
  Description of Artificial Sequence: Synthetic peptide
  XENP021016 vhCDR1
DAWMD

SEQ ID NO: 29957 - protein, 19 aa, Artificial Sequence
  Description of Artificial Sequence: Synthetic peptide
  XENP021016 vhCDR2
EIRTKANNYATYYAESVKG

SEQ ID NO: 29958 - protein, 10 aa, Artificial Sequence
  Description of Artificial Sequence: Synthetic peptide
  XENP021016 vhCDR3
LANWDWYFDV

SEQ ID NO: 29959 - protein, 218 aa, Artificial Sequence; identical to SEQ ID NO: 17590
  Description of Artificial Sequence: Synthetic polypeptide
  XENP021016 7G8_H0.81_L0_Fab Light Chain

SEQ ID NO: 29960 - protein, 111 aa, Artificial Sequence; identical to SEQ ID NO: 17591
  Description of Artificial Sequence: Synthetic polypeptide
  VL of XENP021016

SEQ ID NO: 29961 - protein, 15 aa, Artificial Sequence
  Description of Artificial Sequence: Synthetic peptide
  XENP021016 vlCDR1
KASQSVDYDGDSYMN

SEQ ID NO: 29962 - protein, 7 aa, Artificial Sequence
  Description of Artificial Sequence: Synthetic peptide
  XENP021016 vlCDR2
AASNLES

SEQ ID NO: 29963 - protein, 9 aa, Artificial Sequence
  Description of Artificial Sequence: Synthetic peptide
  XENP021016 vlCDR3
QQSNEDPFT

SEQ ID NO: 29964 - protein, 226 aa, Artificial Sequence
  Description of Artificial Sequence: Synthetic polypeptide
  XENP021017 7G8_H0.82_L0_Fab Heavy Chain
EVKLEESGGGLVQPGGSMKLSCAASGFTFSDAWMDWVRQSPEKGLEWVAEIRTKANNQATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29965 - protein, 121 aa, Artificial Sequence; identical to SEQ ID NO: 19026
  Description of Artificial Sequence: Synthetic polypeptide
  VH of XENP021017

SEQ ID NO: 29966 - protein, 5 aa, Artificial Sequence
  Description of Artificial Sequence: Synthetic peptide
  XENP021017 vhCDR1
DAWMD

SEQ ID NO: 29967 - protein, 19 aa, Artificial Sequence
  Description of Artificial Sequence: Synthetic peptide
  XENP021017 vhCDR2
EIRTKANNQATYYAESVKG

SEQ ID NO: 29968 - protein, 10 aa, Artificial Sequence
  Description of Artificial Sequence: Synthetic peptide
  XENP021017 vhCDR3
LANWDWYFDV

SEQ ID NO: 29969 - protein, 218 aa, Artificial Sequence; identical to SEQ ID NO: 17590
  Description of Artificial Sequence: Synthetic polypeptide
  XENP021017 7G8_H0.82_L0_Fab Light Chain

SEQ ID NO: 29970 - protein, 111 aa, Artificial Sequence; identical to SEQ ID NO: 17591
  Description of Artificial Sequence: Synthetic polypeptide
  VL of XENP021017

SEQ ID NO: 29971 - protein, 15 aa, Artificial Sequence
  Description of Artificial Sequence: Synthetic peptide
  XENP021017 vlCDR1
KASQSVDYDGDSYMN

SEQ ID NO: 29972 - protein, 7 aa, Artificial Sequence
  Description of Artificial Sequence: Synthetic peptide
  XENP021017 vlCDR2
AASNLES

SEQ ID NO: 29973 - protein, 9 aa, Artificial Sequence
  Description of Artificial Sequence: Synthetic peptide
  XENP021017 vlCDR3
QQSNEDPFT

SEQ ID NO: 29974 - protein, 226 aa, Artificial Sequence
  Description of Artificial Sequence: Synthetic polypeptide
  XENP021018 7G8_H0.83_L0_Fab Heavy Chain
EVKLEESGGGLVQPGGSMKLSCAASGFTFSDAWMDWVRQSPEKGLEWVAEIRTKANNDATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29975 - protein, 121 aa, Artificial Sequence; identical to SEQ ID NO: 19036
  Description of Artificial Sequence: Synthetic polypeptide
  VH of XENP021018

SEQ ID NO: 29976 - protein, 5 aa, Artificial Sequence
  Description of Artificial Sequence: Synthetic peptide
  XENP021018 vhCDR1
DAWMD

SEQ ID NO: 29977 - protein, 19 aa, Artificial Sequence
  Description of Artificial Sequence: Synthetic peptide
  XENP021018 vhCDR2
EIRTKANNDATYYAESVKG

SEQ ID NO: 29978 - protein, 10 aa, Artificial Sequence
  Description of Artificial Sequence: Synthetic peptide
  XENP021018 vhCDR3
LANWDWYFDV

SEQ ID NO: 29979 - protein, 218 aa, Artificial Sequence; identical to SEQ ID NO: 17590
  Description of Artificial Sequence: Synthetic polypeptide
  XENP021018 7G8_H0.83_L0_Fab Light Chain

SEQ ID NO: 29980 - protein, 111 aa, Artificial Sequence; identical to SEQ ID NO: 17591
  Description of Artificial Sequence: Synthetic polypeptide
  VL of XENP021018

SEQ ID NO: 29981 - protein, 15 aa, Artificial Sequence
  Description of Artificial Sequence: Synthetic peptide
  XENP021018 vlCDR1
KASQSVDYDGDSYMN

SEQ ID NO: 29982 - protein, 7 aa, Artificial Sequence
  Description of Artificial Sequence: Synthetic peptide
  XENP021018 vlCDR2
AASNLES

SEQ ID NO: 29983 - protein, 9 aa, Artificial Sequence
  Description of Artificial Sequence: Synthetic peptide
  XENP021018 vlCDR3
QQSNEDPFT

SEQ ID NO: 29984 - protein, 226 aa, Artificial Sequence
  Description of Artificial Sequence: Synthetic polypeptide
  XENP021019 7G8_H0.84_L0_Fab Heavy Chain
EVKLEESGGGLVQPGGSMKLSCAASGFTFSDAWMDWVRQSPEKGLEWVAEIRTKANNFATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29985 - protein, 121 aa, Artificial Sequence; identical to SEQ ID NO: 19046
  Description of Artificial Sequence: Synthetic polypeptide
  VH of XENP021019

SEQ ID NO: 29986 - protein, 5 aa, Artificial Sequence
  Description of Artificial Sequence: Synthetic peptide
  XENP021019 vhCDR1
DAWMD

SEQ ID NO: 29987 - protein, 19 aa, Artificial Sequence
  Description of Artificial Sequence: Synthetic peptide
  XENP021019 vhCDR2
EIRTKANNFATYYAESVKG

SEQ ID NO: 29988 - protein, 10 aa, Artificial Sequence
  Description of Artificial Sequence: Synthetic peptide
  XENP021019 vhCDR3
LANWDWYFDV

SEQ ID NO: 29989 - protein, 218 aa, Artificial Sequence; identical to SEQ ID NO: 17590
  Description of Artificial Sequence: Synthetic polypeptide
  XENP021019 7G8_H0.84_L0_Fab Light Chain

SEQ ID NO: 29990 - protein, 111 aa, Artificial Sequence; identical to SEQ ID NO: 17591
  Description of Artificial Sequence: Synthetic polypeptide
  VL of XENP021019

SEQ ID NO: 29991 - protein, 15 aa, Artificial Sequence
  Description of Artificial Sequence: Synthetic peptide
  XENP021019 vlCDR1
KASQSVDYDGDSYMN

SEQ ID NO: 29992 - protein, 7 aa, Artificial Sequence
  Description of Artificial Sequence: Synthetic peptide
  XENP021019 vlCDR2
AASNLES

SEQ ID NO: 29993 - protein, 9 aa, Artificial Sequence
  Description of Artificial Sequence: Synthetic peptide
  XENP021019 vlCDR3
QQSNEDPFT

SEQ ID NO: 29994 - protein, 226 aa, Artificial Sequence
  Description of Artificial Sequence: Synthetic polypeptide
  XENP021020 7G8_H0.85_L0_Fab Heavy Chain
EVKLEESGGGLVQPGGSMKLSCAASGFTFSDAWMDWVRQSPEKGLEWVAEIRTKANNAATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29995 - protein, 121 aa, Artificial Sequence; identical to SEQ ID NO: 19056
  Description of Artificial Sequence: Synthetic polypeptide
  VH of XENP021020

SEQ ID NO: 29996 - protein, 5 aa, Artificial Sequence
  Description of Artificial Sequence: Synthetic peptide
  XENP021020 vhCDR1
DAWMD

SEQ ID NO: 29997 - protein, 19 aa, Artificial Sequence
  Description of Artificial Sequence: Synthetic peptide
  XENP021020 vhCDR2
EIRTKANNAATYYAESVKG

SEQ ID NO: 29998 - protein, 10 aa, Artificial Sequence
  Description of Artificial Sequence: Synthetic peptide
  XENP021020 vhCDR3
LANWDWYFDV

SEQ ID NO: 29999 - protein, 218 aa, Artificial Sequence; identical to SEQ ID NO: 17590
  Description of Artificial Sequence: Synthetic polypeptide
  XENP021020 7G8_H0.85_L0_Fab Light Chain

SEQ ID NO: 30000 - protein, 111 aa, Artificial Sequence; identical to SEQ ID NO: 17591
  Description of Artificial Sequence: Synthetic polypeptide
  VL of XENP021020

SEQ ID NO: 30001 - protein, 15 aa, Artificial Sequence
  Description of Artificial Sequence: Synthetic peptide
  XENP021020 vlCDR1
KASQSVDYDGDSYMN

SEQ ID NO: 30002 - protein, 7 aa, Artificial Sequence
  Description of Artificial Sequence: Synthetic peptide
  XENP021020 vlCDR2
AASNLES

SEQ ID NO: 30003 - protein, 9 aa, Artificial Sequence
  Description of Artificial Sequence: Synthetic peptide
  XENP021020 vlCDR3
QQSNEDPFT

SEQ ID NO: 30004 - protein, 226 aa, Artificial Sequence
  Description of Artificial Sequence: Synthetic polypeptide
  XENP021021 7G8_H0.86_L0_Fab Heavy Chain
EVKLEESGGGLVQPGGSMKLSCAASGFTFSDAWMDWVRQSPEKGLEWVAEIRTKANNKATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30005 - protein, 121 aa, Artificial Sequence; identical to SEQ ID NO: 19066
  Description of Artificial Sequence: Synthetic polypeptide
  VH of XENP021021

SEQ ID NO: 30006 - protein, 5 aa, Artificial Sequence
  Description of Artificial Sequence: Synthetic peptide
  XENP021021 vhCDR1
DAWMD

SEQ ID NO: 30007 - protein, 19 aa, Artificial Sequence
  Description of Artificial Sequence: Synthetic peptide
  XENP021021 vhCDR2
EIRTKANNKATYYAESVKG

SEQ ID NO: 30008 - protein, 10 aa, Artificial Sequence
  Description of Artificial Sequence: Synthetic peptide
  XENP021021 vhCDR3
LANWDWYFDV

SEQ ID NO: 30009 - protein, 218 aa, Artificial Sequence; identical to SEQ ID NO: 17590
  Description of Artificial Sequence: Synthetic polypeptide
  XENP021021 7G8_H0.86_L0_Fab Light Chain

SEQ ID NO: 30010 - protein, 111 aa, Artificial Sequence; identical to SEQ ID NO: 17591
  Description of Artificial Sequence: Synthetic polypeptide
  VL of XENP021021

SEQ ID NO: 30011 - protein, 15 aa, Artificial Sequence
  Description of Artificial Sequence: Synthetic peptide
  XENP021021 vlCDR1
KASQSVDYDGDSYMN

SEQ ID NO: 30012 - protein, 7 aa, Artificial Sequence
  Description of Artificial Sequence: Synthetic peptide
  XENP021021 vlCDR2
AASNLES

SEQ ID NO: 30013 - protein, 9 aa, Artificial Sequence
  Description of Artificial Sequence: Synthetic peptide
  XENP021021 vlCDR3
QQSNEDPFT

SEQ ID NO: 30014 - protein, 226 aa, Artificial Sequence
  Description of Artificial Sequence: Synthetic polypeptide
  XENP021022 7G8_H0.87_L0_Fab Heavy Chain
EVKLEESGGGLVQPGGSMKLSCAASGFTFSDAWMDWVRQSPEKGLEWVAEIRTKANNGATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30015 - protein, 121 aa, Artificial Sequence; identical to SEQ ID NO: 19076
  Description of Artificial Sequence: Synthetic polypeptide
  VH of XENP021022

SEQ ID NO: 30016 - protein, 5 aa, Artificial Sequence
  Description of Artificial Sequence: Synthetic peptide
  XENP021022 vhCDR1
DAWMD

SEQ ID NO: 30017 - protein, 19 aa, Artificial Sequence
  Description of Artificial Sequence: Synthetic peptide
  XENP021022 vhCDR2
EIRTKANNGATYYAESVKG

SEQ ID NO: 30018 - protein, 10 aa, Artificial Sequence
  Description of Artificial Sequence: Synthetic peptide
  XENP021022 vhCDR3
LANWDWYFDV

SEQ ID NO: 30019 - protein, 218 aa, Artificial Sequence; identical to SEQ ID NO: 17590
  Description of Artificial Sequence: Synthetic polypeptide
  XENP021022 7G8_H0.87_L0_Fab Light Chain

SEQ ID NO: 30020 - protein, 111 aa, Artificial Sequence; identical to SEQ ID NO: 17591
  Description of Artificial Sequence: Synthetic polypeptide
  VL of XENP021022

SEQ ID NO: 30021 - protein, 15 aa, Artificial Sequence
  Description of Artificial Sequence: Synthetic peptide
  XENP021022 vlCDR1
KASQSVDYDGDSYMN

SEQ ID NO: 30022 - protein, 7 aa, Artificial Sequence
  Description of Artificial Sequence: Synthetic peptide
  XENP021022 vlCDR2
AASNLES

SEQ ID NO: 30023 - protein, 9 aa, Artificial Sequence
  Description of Artificial Sequence: Synthetic peptide
  XENP021022 vlCDR3
QQSNEDPFT

SEQ ID NO: 30024 - protein, 226 aa, Artificial Sequence
  Description of Artificial Sequence: Synthetic polypeptide
  XENP021023 7G8_H0.88_L0_Fab Heavy Chain
EVKLEESGGGLVQPGGSMKLSCAASGFTFSDAWMDWVRQSPEKGLEWVAEIRTKANNLATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30025 - protein, 121 aa, Artificial Sequence; identical to SEQ ID NO: 19086
  Description of Artificial Sequence: Synthetic polypeptide
  VH of XENP021023

SEQ ID NO: 30026 - protein, 5 aa, Artificial Sequence
  Description of Artificial Sequence: Synthetic peptide
  XENP021023 vhCDR1
DAWMD

SEQ ID NO: 30027 - protein, 19 aa, Artificial Sequence
  Description of Artificial Sequence: Synthetic peptide
  XENP021023 vhCDR2
EIRTKANNLATYYAESVKG

SEQ ID NO: 30028 - protein, 10 aa, Artificial Sequence
  Description of Artificial Sequence: Synthetic peptide
  XENP021023 vhCDR3
LANWDWYFDV

SEQ ID NO: 30029 - protein, 218 aa, Artificial Sequence; identical to SEQ ID NO: 17590
  Description of Artificial Sequence: Synthetic polypeptide
  XENP021023 7G8_H0.88_L0_Fab Light Chain

SEQ ID NO: 30030 - protein, 111 aa, Artificial Sequence; identical to SEQ ID NO: 17591
  Description of Artificial Sequence: Synthetic polypeptide
  VL of XENP021023

SEQ ID NO: 30031 - protein, 15 aa, Artificial Sequence
  Description of Artificial Sequence: Synthetic peptide
  XENP021023 vlCDR1
KASQSVDYDGDSYMN

SEQ ID NO: 30032 - protein, 7 aa, Artificial Sequence
  Description of Artificial Sequence: Synthetic peptide
  XENP021023 vlCDR2
AASNLES

SEQ ID NO: 30033 - protein, 9 aa, Artificial Sequence
  Description of Artificial Sequence: Synthetic peptide
  XENP021023 vlCDR3
QQSNEDPFT

SEQ ID NO: 30034 - protein, 226 aa, Artificial Sequence
  Description of Artificial Sequence: Synthetic polypeptide
  XENP021024 7G8_H0.89_L0_Fab Heavy Chain
EVKLEESGGGLVQPGGSMKLSCAASGFTFSDAWMDWVRQSPEKGLEWVAEIRTKANNHGTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30035 - protein, 121 aa, Artificial Sequence; identical to SEQ ID NO: 19096
  Description of Artificial Sequence: Synthetic polypeptide
  VH of XENP021024

SEQ ID NO: 30036 - protein, 5 aa, Artificial Sequence
  Description of Artificial Sequence: Synthetic peptide
  XENP021024 vhCDR1
DAWMD

SEQ ID NO: 30037 - protein, 19 aa, Artificial Sequence
  Description of Artificial Sequence: Synthetic peptide
  XENP021024 vhCDR2
EIRTKANNHGTYYAESVKG

SEQ ID NO: 30038 - protein, 10 aa, Artificial Sequence
  Description of Artificial Sequence: Synthetic peptide
  XENP021024 vhCDR3
LANWDWYFDV

SEQ ID NO: 30039 - protein, 218 aa, Artificial Sequence; identical to SEQ ID NO: 17590
  Description of Artificial Sequence: Synthetic polypeptide
  XENP021024 7G8_H0.89_L0_Fab Light Chain

SEQ ID NO: 30040 - protein, 111 aa, Artificial Sequence; identical to SEQ ID NO: 17591
  Description of Artificial Sequence: Synthetic polypeptide
  VL of XENP021024

SEQ ID NO: 30041 - protein, 15 aa, Artificial Sequence
  Description of Artificial Sequence: Synthetic peptide
  XENP021024 vlCDR1
KASQSVDYDGDSYMN

SEQ ID NO: 30042 - protein, 7 aa, Artificial Sequence
  Description of Artificial Sequence: Synthetic peptide
  XENP021024 vlCDR2
AASNLES

SEQ ID NO: 30043 - protein, 9 aa, Artificial Sequence
  Description of Artificial Sequence: Synthetic peptide
  XENP021024 vlCDR3
QQSNEDPFT

SEQ ID NO: 30044 - protein, 226 aa, Artificial Sequence
  Description of Artificial Sequence: Synthetic polypeptide
  XENP021025 7G8_H0.90_L0_Fab Heavy Chain
EVKLEESGGGLVQPGGSMKLSCAASGFTFSDAWMDWVRQSPEKGLEWVAEIRTKANNHHTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30045 - protein, 121 aa, Artificial Sequence; identical to SEQ ID NO: 19106
  Description of Artificial Sequence: Synthetic polypeptide
  VH of XENP021025

SEQ ID NO: 30046 - protein, 5 aa, Artificial Sequence
  Description of Artificial Sequence: Synthetic peptide
  XENP021025 vhCDR1
DAWMD

SEQ ID NO: 30047 - protein, 19 aa, Artificial Sequence
  Description of Artificial Sequence: Synthetic peptide
  XENP021025 vhCDR2
EIRTKANNHHTYYAESVKG

SEQ ID NO: 30048 - protein, 10 aa, Artificial Sequence
  Description of Artificial Sequence: Synthetic peptide
  XENP021025 vhCDR3
LANWDWYFDV

SEQ ID NO: 30049 - protein, 218 aa, Artificial Sequence; identical to SEQ ID NO: 17590
  Description of Artificial Sequence: Synthetic polypeptide
  XENP021025 7G8_H0.90_L0_Fab Light Chain

SEQ ID NO: 30050 - protein, 111 aa, Artificial Sequence; identical to SEQ ID NO: 17591
  Description of Artificial Sequence: Synthetic polypeptide
  VL of XENP021025

SEQ ID NO: 30051 - protein, 15 aa, Artificial Sequence
  Description of Artificial Sequence: Synthetic peptide
  XENP021025 vlCDR1
KASQSVDYDGDSYMN

SEQ ID NO: 30052 - protein, 7 aa, Artificial Sequence
  Description of Artificial Sequence: Synthetic peptide
  XENP021025 vlCDR2
AASNLES

SEQ ID NO: 30053 - protein, 9 aa, Artificial Sequence
  Description of Artificial Sequence: Synthetic peptide
  XENP021025 vlCDR3
QQSNEDPFT

SEQ ID NO: 30054 - protein, 226 aa, Artificial Sequence
  Description of Artificial Sequence: Synthetic polypeptide
  XENP021026 7G8_H0.91_L0_Fab Heavy Chain
EVKLEESGGGLVQPGGSMKLSCAASGFTFSDAWMDWVRQSPEKGLEWVAEIRTKANNHQTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30055 - protein, 121 aa, Artificial Sequence; identical to SEQ ID NO: 19116
  Description of Artificial Sequence: Synthetic polypeptide
  VH of XENP021026

SEQ ID NO: 30056 - protein, 5 aa, Artificial Sequence
  Description of Artificial Sequence: Synthetic peptide
  XENP021026 vhCDR1
DAWMD

SEQ ID NO: 30057 - protein, 19 aa, Artificial Sequence
  Description of Artificial Sequence: Synthetic peptide
  XENP021026 vhCDR2
EIRTKANNHQTYYAESVKG

SEQ ID NO: 30058 - protein, 10 aa, Artificial Sequence
  Description of Artificial Sequence: Synthetic peptide
  XENP021026 vhCDR3
LANWDWYFDV

SEQ ID NO: 30059 - protein, 218 aa, Artificial Sequence; identical to SEQ ID NO: 17590
  Description of Artificial Sequence: Synthetic polypeptide
  XENP021026 7G8_H0.91_L0_Fab Light Chain

SEQ ID NO: 30060 - protein, 111 aa, Artificial Sequence; identical to SEQ ID NO: 17591
  Description of Artificial Sequence: Synthetic polypeptide
  VL of XENP021026

SEQ ID NO: 30061 - protein, 15 aa, Artificial Sequence
  Description of Artificial Sequence: Synthetic peptide
  XENP021026 vlCDR1
KASQSVDYDGDSYMN

SEQ ID NO: 30062 - protein, 7 aa, Artificial Sequence
  Description of Artificial Sequence: Synthetic peptide
  XENP021026 vlCDR2
AASNLES

SEQ ID NO: 30063 - protein, 9 aa, Artificial Sequence
  Description of Artificial Sequence: Synthetic peptide
  XENP021026 vlCDR3
QQSNEDPFT

SEQ ID NO: 30064 - protein, 226 aa, Artificial Sequence
  Description of Artificial Sequence: Synthetic polypeptide
  XENP021027 7G8_H0.92_L0_Fab Heavy Chain
EVKLEESGGGLVQPGGSMKLSCAASGFTFSDAWMDWVRQSPEKGLEWVAEIRTKANNHDTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30065 - protein, 121 aa, Artificial Sequence; identical to SEQ ID NO: 19126
  Description of Artificial Sequence: Synthetic polypeptide
  VH of XENP021027

SEQ ID NO: 30066 - protein, 5 aa, Artificial Sequence
  Description of Artificial Sequence: Synthetic peptide
  XENP021027 vhCDR1
DAWMD

SEQ ID NO: 30067 - protein, 19 aa, Artificial Sequence
  Description of Artificial Sequence: Synthetic peptide
  XENP021027 vhCDR2
EIRTKANNHDTYYAESVKG

SEQ ID NO: 30068 - protein, 10 aa, Artificial Sequence
  Description of Artificial Sequence: Synthetic peptide
  XENP021027 vhCDR3
LANWDWYFDV

SEQ ID NO: 30069 - protein, 218 aa, Artificial Sequence; identical to SEQ ID NO: 17590
  Description of Artificial Sequence: Synthetic polypeptide
  XENP021027 7G8_H0.92_L0_Fab Light Chain

SEQ ID NO: 30070 - protein, 111 aa, Artificial Sequence; identical to SEQ ID NO: 17591
  Description of Artificial Sequence: Synthetic polypeptide
  VL of XENP021027

SEQ ID NO: 30071 - protein, 15 aa, Artificial Sequence
  Description of Artificial Sequence: Synthetic peptide
  XENP021027 vlCDR1
KASQSVDYDGDSYMN

SEQ ID NO: 30072 - protein, 7 aa, Artificial Sequence
  Description of Artificial Sequence: Synthetic peptide
  XENP021027 vlCDR2
AASNLES

SEQ ID NO: 30073 - protein, 9 aa, Artificial Sequence
  Description of Artificial Sequence: Synthetic peptide
  XENP021027 vlCDR3
QQSNEDPFT

SEQ ID NO: 30074 - protein, 226 aa, Artificial Sequence
  Description of Artificial Sequence: Synthetic polypeptide
  XENP021028 7G8_H0.93_L0_Fab Heavy Chain
EVKLEESGGGLVQPGGSMKLSCAASGFTFSDAWMDWVRQSPEKGLEWVAEIRTKANNHLTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30075 - protein, 121 aa, Artificial Sequence; identical to SEQ ID NO: 19136
  Description of Artificial Sequence: Synthetic polypeptide
  VH of XENP021028

SEQ ID NO: 30076 - protein, 5 aa, Artificial Sequence
  Description of Artificial Sequence: Synthetic peptide
  XENP021028 vhCDR1
DAWMD

SEQ ID NO: 30077 - protein, 19 aa, Artificial Sequence
  Description of Artificial Sequence: Synthetic peptide
  XENP021028 vhCDR2
EIRTKANNHLTYYAESVKG

SEQ ID NO: 30078 - protein, 10 aa, Artificial Sequence
  Description of Artificial Sequence: Synthetic peptide
  XENP021028 vhCDR3
LANWDWYFDV

SEQ ID NO: 30079 - protein, 218 aa, Artificial Sequence; identical to SEQ ID NO: 17590
  Description of Artificial Sequence: Synthetic polypeptide
  XENP021028 7G8_H0.93_L0_Fab Light Chain

SEQ ID NO: 30080 - protein, 111 aa, Artificial Sequence; identical to SEQ ID NO: 17591
  Description of Artificial Sequence: Synthetic polypeptide
  VL of XENP021028

SEQ ID NO: 30081 - protein, 15 aa, Artificial Sequence
  Description of Artificial Sequence: Synthetic peptide
  XENP021028 vlCDR1
KASQSVDYDGDSYMN

SEQ ID NO: 30082 - protein, 7 aa, Artificial Sequence
  Description of Artificial Sequence: Synthetic peptide
  XENP021028 vlCDR2
AASNLES

SEQ ID NO: 30083 - protein, 9 aa, Artificial Sequence
  Description of Artificial Sequence: Synthetic peptide
  XENP021028 vlCDR3
QQSNEDPFT

SEQ ID NO: 30084 - protein, 226 aa, Artificial Sequence
  Description of Artificial Sequence: Synthetic polypeptide
  XENP021029 7G8_H0.94_L0_Fab Heavy Chain
EVKLEESGGGLVQPGGSMKLSCAASGFTFSDAWMDWVRQSPEKGLEWVAEIRTKANNHKTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30085 - protein, 121 aa, Artificial Sequence; identical to SEQ ID NO: 19146
  Description of Artificial Sequence: Synthetic polypeptide
  VH of XENP021029

SEQ ID NO: 30086 - protein, 5 aa, Artificial Sequence
  Description of Artificial Sequence: Synthetic peptide
  XENP021029 vhCDR1
DAWMD

SEQ ID NO: 30087 - protein, 19 aa, Artificial Sequence
  Description of Artificial Sequence: Synthetic peptide
  XENP021029 vhCDR2
EIRTKANNHKTYYAESVKG

SEQ ID NO: 30088 - protein, 10 aa, Artificial Sequence
  Description of Artificial Sequence: Synthetic peptide
  XENP021029 vhCDR3
LANWDWYFDV

SEQ ID NO: 30089 - protein, 218 aa, Artificial Sequence; identical to SEQ ID NO: 17590
  Description of Artificial Sequence: Synthetic polypeptide
  XENP021029 7G8_H0.94_L0_Fab Light Chain

SEQ ID NO: 30090 - protein, 111 aa, Artificial Sequence; identical to SEQ ID NO: 17591
  Description of Artificial Sequence: Synthetic polypeptide
  VL of XENP021029

SEQ ID NO: 30091 - protein, 15 aa, Artificial Sequence
  Description of Artificial Sequence: Synthetic peptide
  XENP021029 vlCDR1
KASQSVDYDGDSYMN

SEQ ID NO: 30092 - protein, 7 aa, Artificial Sequence
  Description of Artificial Sequence: Synthetic peptide
  XENP021029 vlCDR2
AASNLES

SEQ ID NO: 30093 - protein, 9 aa, Artificial Sequence
  Description of Artificial Sequence: Synthetic peptide
  XENP021029 vlCDR3
QQSNEDPFT

SEQ ID NO: 30094 - protein, 226 aa, Artificial Sequence
  Description of Artificial Sequence: Synthetic polypeptide
  XENP021030 7G8_H0.95_L0_Fab Heavy Chain
EVKLEESGGGLVQPGGSMKLSCAASGFTFSDAWMDWVRQSPEKGLEWVAEIRTKANNHYTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30095 - protein, 121 aa, Artificial Sequence; identical to SEQ ID NO: 19156
  Description of Artificial Sequence: Synthetic polypeptide
  VH of XENP021030

SEQ ID NO: 30096 - protein, 5 aa, Artificial Sequence
  Description of Artificial Sequence: Synthetic peptide
  XENP021030 vhCDR1
DAWMD

SEQ ID NO: 30097 - protein, 19 aa, Artificial Sequence
  Description of Artificial Sequence: Synthetic peptide
  XENP021030 vhCDR2
EIRTKANNHYTYYAESVKG

SEQ ID NO: 30098 - protein, 10 aa, Artificial Sequence
  Description of Artificial Sequence: Synthetic peptide
  XENP021030 vhCDR3
LANWDWYFDV

SEQ ID NO: 30099 - protein, 218 aa, Artificial Sequence; identical to SEQ ID NO: 17590
  Description of Artificial Sequence: Synthetic polypeptide
  XENP021030 7G8_H0.95_L0_Fab Light Chain

SEQ ID NO: 30100 - protein, 111 aa, Artificial Sequence; identical to SEQ ID NO: 17591
  Description of Artificial Sequence: Synthetic polypeptide
  VL of XENP021030

SEQ ID NO: 30101 - protein, 15 aa, Artificial Sequence
  Description of Artificial Sequence: Synthetic peptide
  XENP021030 vlCDR1
KASQSVDYDGDSYMN

SEQ ID NO: 30102 - protein, 7 aa, Artificial Sequence
  Description of Artificial Sequence: Synthetic peptide
  XENP021030 vlCDR2
AASNLES

SEQ ID NO: 30103 - protein, 9 aa, Artificial Sequence
  Description of Artificial Sequence: Synthetic peptide
  XENP021030 vlCDR3
QQSNEDPFT

SEQ ID NO: 30104 - protein, 226 aa, Artificial Sequence
  Description of Artificial Sequence: Synthetic polypeptide
  XENP021031 7G8_H0.96_L0_Fab Heavy Chain
EVKLEESGGGLVQPGGSMKLSCAASGFTFSDAWMDWVRQSPEKGLEWVAEIRTKANNHATFYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30105 - protein, 121 aa, Artificial Sequence; identical to SEQ ID NO: 19166
  Description of Artificial Sequence: Synthetic polypeptide
  VH of XENP021031

SEQ ID NO: 30106 - protein, 5 aa, Artificial Sequence
  Description of Artificial Sequence: Synthetic peptide
  XENP021031 vhCDR1
DAWMD

SEQ ID NO: 30107 - protein, 19 aa, Artificial Sequence
  Description of Artificial Sequence: Synthetic peptide
  XENP021031 vhCDR2
EIRTKANNHATFYAESVKG

SEQ ID NO: 30108 - protein, 10 aa, Artificial Sequence
  Description of Artificial Sequence: Synthetic peptide
  XENP021031 vhCDR3
LANWDWYFDV

SEQ ID NO: 30109 - protein, 218 aa, Artificial Sequence; identical to SEQ ID NO: 17590
  Description of Artificial Sequence: Synthetic polypeptide
  XENP021031 7G8_H0.96_L0_Fab Light Chain

SEQ ID NO: 30110 - protein, 111 aa, Artificial Sequence; identical to SEQ ID NO: 17591
  Description of Artificial Sequence: Synthetic polypeptide
  VL of XENP021031

SEQ ID NO: 30111 - protein, 15 aa, Artificial Sequence
  Description of Artificial Sequence: Synthetic peptide
  XENP021031 vlCDR1
KASQSVDYDGDSYMN

SEQ ID NO: 30112 - protein, 7 aa, Artificial Sequence
  Description of Artificial Sequence: Synthetic peptide
  XENP021031 vlCDR2
AASNLES

SEQ ID NO: 30113 - protein, 9 aa, Artificial Sequence
  Description of Artificial Sequence: Synthetic peptide
  XENP021031 vlCDR3
QQSNEDPFT

SEQ ID NO: 30114 - protein, 226 aa, Artificial Sequence
  Description of Artificial Sequence: Synthetic polypeptide
  XENP021032 7G8_H0.97_L0_Fab Heavy Chain
EVKLEESGGGLVQPGGSMKLSCAASGFTFSDAWMDWVRQSPEKGLEWVAEIRTKANNHATHYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30115 - protein, 121 aa, Artificial Sequence; identical to SEQ ID NO: 19176
  Description of Artificial Sequence: Synthetic polypeptide
  VH of XENP021032

SEQ ID NO: 30116 - protein, 5 aa, Artificial Sequence
  Description of Artificial Sequence: Synthetic peptide
  XENP021032 vhCDR1
DAWMD

SEQ ID NO: 30117 - protein, 19 aa, Artificial Sequence
  Description of Artificial Sequence: Synthetic peptide
  XENP021032 vhCDR2
EIRTKANNHATHYAESVKG

SEQ ID NO: 30118 - protein, 10 aa, Artificial Sequence
  Description of Artificial Sequence: Synthetic peptide
  XENP021032 vhCDR3
LANWDWYFDV

SEQ ID NO: 30119 - protein, 218 aa, Artificial Sequence; identical to SEQ ID NO: 17590
  Description of Artificial Sequence: Synthetic polypeptide
  XENP021032 7G8_H0.97_L0_Fab Light Chain

SEQ ID NO: 30120 - protein, 111 aa, Artificial Sequence; identical to SEQ ID NO: 17591
  Description of Artificial Sequence: Synthetic polypeptide
  VL of XENP021032

SEQ ID NO: 30121 - protein, 15 aa, Artificial Sequence
  Description of Artificial Sequence: Synthetic peptide
  XENP021032 vlCDR1
KASQSVDYDGDSYMN

SEQ ID NO: 30122 - protein, 7 aa, Artificial Sequence
  Description of Artificial Sequence: Synthetic peptide
  XENP021032 vlCDR2
AASNLES

SEQ ID NO: 30123 - protein, 9 aa, Artificial Sequence
  Description of Artificial Sequence: Synthetic peptide
  XENP021032 vlCDR3
QQSNEDPFT

SEQ ID NO: 30124 - protein, 226 aa, Artificial Sequence
  Description of Artificial Sequence: Synthetic polypeptide
  XENP021033 7G8_H0.98_L0_Fab Heavy Chain
EVKLEESGGGLVQPGGSMKLSCAASGFTFSDAWMDWVRQSPEKGLEWVAEIRTKANNHATLYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30125 - protein, 121 aa, Artificial Sequence; identical to SEQ ID NO: 19186
  Description of Artificial Sequence: Synthetic polypeptide
  VH of XENP021033

SEQ ID NO: 30126 - protein, 5 aa, Artificial Sequence
  Description of Artificial Sequence: Synthetic peptide
  XENP021033 vhCDR1
DAWMD

SEQ ID NO: 30127 - protein, 19 aa, Artificial Sequence
  Description of Artificial Sequence: Synthetic peptide
  XENP021033 vhCDR2
EIRTKANNHATLYAESVKG

SEQ ID NO: 30128 - protein, 10 aa, Artificial Sequence
  Description of Artificial Sequence: Synthetic peptide
  XENP021033 vhCDR3
LANWDWYFDV

SEQ ID NO: 30129 - protein, 218 aa, Artificial Sequence; identical to SEQ ID NO: 17590
  Description of Artificial Sequence: Synthetic polypeptide
  XENP021033 7G8_H0.98_L0_Fab Light Chain

SEQ ID NO: 30130 - protein, 111 aa, Artificial Sequence; identical to SEQ ID NO: 17591
  Description of Artificial Sequence: Synthetic polypeptide
  VL of XENP021033

SEQ ID NO: 30131 - protein, 15 aa, Artificial Sequence
  Description of Artificial Sequence: Synthetic peptide
  XENP021033 vlCDR1
KASQSVDYDGDSYMN

SEQ ID NO: 30132 - protein, 7 aa, Artificial Sequence
  Description of Artificial Sequence: Synthetic peptide
  XENP021033 vlCDR2
AASNLES

SEQ ID NO: 30133 - protein, 9 aa, Artificial Sequence
  Description of Artificial Sequence: Synthetic peptide
  XENP021033 vlCDR3
QQSNEDPFT

SEQ ID NO: 30134 - protein, 226 aa, Artificial Sequence
  Description of Artificial Sequence: Synthetic polypeptide
  XENP021034 7G8_H0.99_L0_Fab Heavy Chain
EVKLEESGGGLVQPGGSMKLSCAASGFTFSDAWMDWVRQSPEKGLEWVAEIRTKANNHATWYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30135 - protein, 121 aa, Artificial Sequence; identical to SEQ ID NO: 19196
  Description of Artificial Sequence: Synthetic polypeptide
  VH of XENP021034

SEQ ID NO: 30136 - protein, 5 aa, Artificial Sequence
  Description of Artificial Sequence: Synthetic peptide
  XENP021034 vhCDR1
DAWMD

SEQ ID NO: 30137 - protein, 19 aa, Artificial Sequence
  Description of Artificial Sequence: Synthetic peptide
  XENP021034 vhCDR2
EIRTKANNHATWYAESVKG

SEQ ID NO: 30138 - protein, 10 aa, Artificial Sequence
  Description of Artificial Sequence: Synthetic peptide
  XENP021034 vhCDR3
LANWDWYFDV

SEQ ID NO: 30139 - protein, 218 aa, Artificial Sequence; identical to SEQ ID NO: 17590
  Description of Artificial Sequence: Synthetic polypeptide
  XENP021034 7G8_H0.99_L0_Fab Light Chain

SEQ ID NO: 30140 - protein, 111 aa, Artificial Sequence; identical to SEQ ID NO: 17591
  Description of Artificial Sequence: Synthetic polypeptide
  VL of XENP021034

SEQ ID NO: 30141 - protein, 15 aa, Artificial Sequence
  Description of Artificial Sequence: Synthetic peptide
  XENP021034 vlCDR1
KASQSVDYDGDSYMN

SEQ ID NO: 30142 - protein, 7 aa, Artificial Sequence
  Description of Artificial Sequence: Synthetic peptide
  XENP021034 vlCDR2
AASNLES

SEQ ID NO: 30143 - protein, 9 aa, Artificial Sequence
  Description of Artificial Sequence: Synthetic peptide
  XENP021034 vlCDR3
QQSNEDPFT

SEQ ID NO: 30144 - protein, 226 aa, Artificial Sequence
  Description of Artificial Sequence: Synthetic polypeptide
  XENP021035 7G8_H0.100_L0_Fab Heavy Chain
EVKLEESGGGLVQPGGSMKLSCAASGFTFSDAWMDWVRQSPEKGLEWVAEIRTKANNHATVYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30145 - protein, 121 aa, Artificial Sequence; identical to SEQ ID NO: 19206
  Description of Artificial Sequence: Synthetic polypeptide
  VH of XENP021035

SEQ ID NO: 30146 - protein, 5 aa, Artificial Sequence
  Description of Artificial Sequence: Synthetic peptide
  XENP021035 vhCDR1
DAWMD

SEQ ID NO: 30147 - protein, 19 aa, Artificial Sequence
  Description of Artificial Sequence: Synthetic peptide
  XENP021035 vhCDR2
EIRTKANNHATVYAESVKG

SEQ ID NO: 30148 - protein, 10 aa, Artificial Sequence
  Description of Artificial Sequence: Synthetic peptide
  XENP021035 vhCDR3
LANWDWYFDV

SEQ ID NO: 30149 - protein, 218 aa, Artificial Sequence; identical to SEQ ID NO: 17590
  Description of Artificial Sequence: Synthetic polypeptide
  XENP021035 7G8_H0.100_L0_Fab Light Chain

SEQ ID NO: 30150 - protein, 111 aa, Artificial Sequence; identical to SEQ ID NO: 17591
  Description of Artificial Sequence: Synthetic polypeptide
  VL of XENP021035

SEQ ID NO: 30151 - protein, 15 aa, Artificial Sequence
  Description of Artificial Sequence: Synthetic peptide
  XENP021035 vlCDR1
KASQSVDYDGDSYMN

SEQ ID NO: 30152 - protein, 7 aa, Artificial Sequence
  Description of Artificial Sequence: Synthetic peptide
  XENP021035 vlCDR2
AASNLES

SEQ ID NO: 30153 - protein, 9 aa, Artificial Sequence
  Description of Artificial Sequence: Synthetic peptide
  XENP021035 vlCDR3
QQSNEDPFT

SEQ ID NO: 30154 - protein, 226 aa, Artificial Sequence
  Description of Artificial Sequence: Synthetic polypeptide
  XENP021036 7G8_H0.101_L0_Fab Heavy Chain
EVKLEESGGGLVQPGGSMKLSCAASGFTFSDAWMDWVRQSPEKGLEWVAEIRTKANNHATAYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30155 - protein, 121 aa, Artificial Sequence; identical to SEQ ID NO: 19216
  Description of Artificial Sequence: Synthetic polypeptide
  VH of XENP021036

SEQ ID NO: 30156 - protein, 5 aa, Artificial Sequence
  Description of Artificial Sequence: Synthetic peptide
  XENP021036 vhCDR1
DAWMD

SEQ ID NO: 30157 - protein, 19 aa, Artificial Sequence
  Description of Artificial Sequence: Synthetic peptide
  XENP021036 vhCDR2
EIRTKANNHATAYAESVKG

SEQ ID NO: 30158 - protein, 10 aa, Artificial Sequence
  Description of Artificial Sequence: Synthetic peptide
  XENP021036 vhCDR3
LANWDWYFDV

SEQ ID NO: 30159 - protein, 218 aa, Artificial Sequence; identical to SEQ ID NO: 17590
  Description of Artificial Sequence: Synthetic polypeptide
  XENP021036 7G8_H0.101_L0_Fab Light Chain

SEQ ID NO: 30160 - protein, 111 aa, Artificial Sequence; identical to SEQ ID NO: 17591
  Description of Artificial Sequence: Synthetic polypeptide
  VL of XENP021036

SEQ ID NO: 30161 - protein, 15 aa, Artificial Sequence
  Description of Artificial Sequence: Synthetic peptide
  XENP021036 vlCDR1
KASQSVDYDGDSYMN

SEQ ID NO: 30162 - protein, 7 aa, Artificial Sequence
  Description of Artificial Sequence: Synthetic peptide
  XENP021036 vlCDR2
AASNLES

SEQ ID NO: 30163 - protein, 9 aa, Artificial Sequence
  Description of Artificial Sequence: Synthetic peptide
  XENP021036 vlCDR3
QQSNEDPFT

SEQ ID NO: 30164 - protein, 226 aa, Artificial Sequence
  Description of Artificial Sequence: Synthetic polypeptide
  XENP021037 7G8_H0.102_L0_Fab Heavy Chain
EVKLEESGGGLVQPGGSMKLSCAASGFTFSDAWMDWVRQSPEKGLEWVAEIRTKANNHATQYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30165 - protein, 121 aa, Artificial Sequence; identical to SEQ ID NO: 19226
  Description of Artificial Sequence: Synthetic polypeptide
  VH of XENP021037

SEQ ID NO: 30166 - protein, 5 aa, Artificial Sequence
  Description of Artificial Sequence: Synthetic peptide
  XENP021037 vhCDR1
DAWMD

SEQ ID NO: 30167 - protein, 19 aa, Artificial Sequence
  Description of Artificial Sequence: Synthetic peptide
  XENP021037 vhCDR2
EIRTKANNHATQYAESVKG

SEQ ID NO: 30168 - protein, 10 aa, Artificial Sequence
  Description of Artificial Sequence: Synthetic peptide
  XENP021037 vhCDR3
LANWDWYFDV

SEQ ID NO: 30169 - protein, 218 aa, Artificial Sequence; identical to SEQ ID NO: 17590
  Description of Artificial Sequence: Synthetic polypeptide
  XENP021037 7G8_H0.102_L0_Fab Light Chain

SEQ ID NO: 30170 - protein, 111 aa, Artificial Sequence; identical to SEQ ID NO: 17591
  Description of Artificial Sequence: Synthetic polypeptide
  VL of XENP021037

SEQ ID NO: 30171 - protein, 15 aa, Artificial Sequence
  Description of Artificial Sequence: Synthetic peptide
  XENP021037 vlCDR1
KASQSVDYDGDSYMN

SEQ ID NO: 30172 - protein, 7 aa, Artificial Sequence
  Description of Artificial Sequence: Synthetic peptide
  XENP021037 vlCDR2
AASNLES

SEQ ID NO: 30173 - protein, 9 aa, Artificial Sequence
  Description of Artificial Sequence: Synthetic peptide
  XENP021037 vlCDR3
QQSNEDPFT

SEQ ID NO: 30174 - protein, 226 aa, Artificial Sequence
  Description of Artificial Sequence: Synthetic polypeptide
  XENP021038 7G8_H0.103_L0_Fab Heavy Chain
EVKLEESGGGLVQPGGSMKLSCAASGFTFSDAWMDWVRQSPEKGLEWVAEIRTKANNHATDYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30175 - protein, 121 aa, Artificial Sequence; identical to SEQ ID NO: 19236
  Description of Artificial Sequence: Synthetic polypeptide
  VH of XENP021038

SEQ ID NO: 30176 - protein, 5 aa, Artificial Sequence
  Description of Artificial Sequence: Synthetic peptide
  XENP021038 vhCDR1
DAWMD

SEQ ID NO: 30177 - protein, 19 aa, Artificial Sequence
  Description of Artificial Sequence: Synthetic peptide
  XENP021038 vhCDR2
EIRTKANNHATDYAESVKG

SEQ ID NO: 30178 - protein, 10 aa, Artificial Sequence
  Description of Artificial Sequence: Synthetic peptide
  XENP021038 vhCDR3
LANWDWYFDV

SEQ ID NO: 30179 - protein, 218 aa, Artificial Sequence; identical to SEQ ID NO: 17590
  Description of Artificial Sequence: Synthetic polypeptide
  XENP021038 7G8_H0.103_L0_Fab Light Chain

SEQ ID NO: 30180 - protein, 111 aa, Artificial Sequence; identical to SEQ ID NO: 17591
  Description of Artificial Sequence: Synthetic polypeptide
  VL of XENP021038

SEQ ID NO: 30181 - protein, 15 aa, Artificial Sequence
  Description of Artificial Sequence: Synthetic peptide
  XENP021038 vlCDR1
KASQSVDYDGDSYMN

SEQ ID NO: 30182 - protein, 7 aa, Artificial Sequence
  Description of Artificial Sequence: Synthetic peptide
  XENP021038 vlCDR2
AASNLES

SEQ ID NO: 30183 - protein, 9 aa, Artificial Sequence
  Description of Artificial Sequence: Synthetic peptide
  XENP021038 vlCDR3
QQSNEDPFT

SEQ ID NO: 30184 - protein, 226 aa, Artificial Sequence
  Description of Artificial Sequence: Synthetic polypeptide
  XENP021039 7G8_H0.104_L0_Fab Heavy Chain
EVKLEESGGGLVQPGGSMKLSCAASGFTFSDAWMDWVRQSPEKGLEWVAEIRTKANNHATKYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30185 - protein, 121 aa, Artificial Sequence; identical to SEQ ID NO: 19246
  Description of Artificial Sequence: Synthetic polypeptide
  VH of XENP021039

SEQ ID NO: 30186 - protein, 5 aa, Artificial Sequence
  Description of Artificial Sequence: Synthetic peptide
  XENP021039 vhCDR1
DAWMD

SEQ ID NO: 30187 - protein, 19 aa, Artificial Sequence
  Description of Artificial Sequence: Synthetic peptide
  XENP021039 vhCDR2
EIRTKANNHATKYAESVKG

SEQ ID NO: 30188 - protein, 10 aa, Artificial Sequence
  Description of Artificial Sequence: Synthetic peptide
  XENP021039 vhCDR3
LANWDWYFDV

SEQ ID NO: 30189 - protein, 218 aa, Artificial Sequence; identical to SEQ ID NO: 17590
  Description of Artificial Sequence: Synthetic polypeptide
  XENP021039 7G8_H0.104_L0_Fab Light Chain

SEQ ID NO: 30190 - protein, 111 aa, Artificial Sequence; identical to SEQ ID NO: 17591
  Description of Artificial Sequence: Synthetic polypeptide
  VL of XENP021039

SEQ ID NO: 30191 - protein, 15 aa, Artificial Sequence
  Description of Artificial Sequence: Synthetic peptide
  XENP021039 vlCDR1
KASQSVDYDGDSYMN

SEQ ID NO: 30192 - protein, 7 aa, Artificial Sequence
  Description of Artificial Sequence: Synthetic peptide
  XENP021039 vlCDR2
AASNLES

SEQ ID NO: 30193 - protein, 9 aa, Artificial Sequence
  Description of Artificial Sequence: Synthetic peptide
  XENP021039 vlCDR3
QQSNEDPFT

SEQ ID NO: 30194 - protein, 226 aa, Artificial Sequence
  Description of Artificial Sequence: Synthetic polypeptide
  XENP021040 7G8_H0.105_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRIANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30195 - protein, 121 aa, Artificial Sequence; identical to SEQ ID NO: 19256
  Description of Artificial Sequence: Synthetic polypeptide
  VH of XENP021040

SEQ ID NO: 30196 - protein, 5 aa, Artificial Sequence
  Description of Artificial Sequence: Synthetic peptide
  XENP021040 vhCDR1
DAWMD

SEQ ID NO: 30197 - protein, 19 aa, Artificial Sequence
  Description of Artificial Sequence: Synthetic peptide
  XENP021040 vhCDR2
EIRTKANNHATYYAESVKG

SEQ ID NO: 30198 - protein, 10 aa, Artificial Sequence
  Description of Artificial Sequence: Synthetic peptide
  XENP021040 vhCDR3
IANWDWYFDV

SEQ ID NO: 30199 - protein, 218 aa, Artificial Sequence; identical to SEQ ID NO: 17590
  Description of Artificial Sequence: Synthetic polypeptide
  XENP021040 7G8_H0.105_L0_Fab Light Chain

SEQ ID NO: 30200 - protein, 111 aa, Artificial Sequence; identical to SEQ ID NO: 17591
  Description of Artificial Sequence: Synthetic polypeptide
  VL of XENP021040

SEQ ID NO: 30201 - protein, 15 aa, Artificial Sequence
  Description of Artificial Sequence: Synthetic peptide
  XENP021040 vlCDR1
KASQSVDYDGDSYMN

SEQ ID NO: 30202 - protein, 7 aa, Artificial Sequence
  Description of Artificial Sequence: Synthetic peptide
  XENP021040 vlCDR2
AASNLES

SEQ ID NO: 30203 - protein, 9 aa, Artificial Sequence
  Description of Artificial Sequence: Synthetic peptide
  XENP021040 vlCDR3
QQSNEDPFT

SEQ ID NO: 30204 - protein, 226 aa, Artificial Sequence
  Description of Artificial Sequence: Synthetic polypeptide
  XENP021041 7G8_H0.106_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRFANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30205 - protein, 121 aa, Artificial Sequence; identical to SEQ ID NO: 19266
  Description of Artificial Sequence: Synthetic polypeptide
  VH of XENP021041

SEQ ID NO: 30206 - protein, 5 aa, Artificial Sequence
  Description of Artificial Sequence: Synthetic peptide
  XENP021041 vhCDR1
DAWMD

SEQ ID NO: 30207 - protein, 19 aa, Artificial Sequence
  Description of Artificial Sequence: Synthetic peptide
  XENP021041 vhCDR2
EIRTKANNHATYYAESVKG

SEQ ID NO: 30208 - protein, 10 aa, Artificial Sequence
  Description of Artificial Sequence: Synthetic peptide
  XENP021041 vhCDR3
FANWDWYFDV

SEQ ID NO: 30209 - protein, 218 aa, Artificial Sequence; identical to SEQ ID NO: 17590
  Description of Artificial Sequence: Synthetic polypeptide
  XENP021041 7G8_H0.106_L0_Fab Light Chain

SEQ ID NO: 30210 - protein, 111 aa, Artificial Sequence; identical to SEQ ID NO: 17591
  Description of Artificial Sequence: Synthetic polypeptide
  VL of XENP021041

SEQ ID NO: 30211 - protein, 15 aa, Artificial Sequence
  Description of Artificial Sequence: Synthetic peptide
  XENP021041 vlCDR1
KASQSVDYDGDSYMN

SEQ ID NO: 30212 - protein, 7 aa, Artificial Sequence
  Description of Artificial Sequence: Synthetic peptide
  XENP021041 vlCDR2
AASNLES

SEQ ID NO: 30213 - protein, 9 aa, Artificial Sequence
  Description of Artificial Sequence: Synthetic peptide
  XENP021041 vlCDR3
QQSNEDPFT

SEQ ID NO: 30214 - protein, 226 aa, Artificial Sequence
  Description of Artificial Sequence: Synthetic polypeptide
  XENP021042 7G8_H0.107_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRVANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30215 - protein, 121 aa, Artificial Sequence; identical to SEQ ID NO: 19276
  Description of Artificial Sequence: Synthetic polypeptide
  VH of XENP021042

SEQ ID NO: 30216 - protein, 5 aa, Artificial Sequence
  Description of Artificial Sequence: Synthetic peptide
  XENP021042 vhCDR1
DAWMD

SEQ ID NO: 30217 - protein, 19 aa, Artificial Sequence
  Description of Artificial Sequence: Synthetic peptide
  XENP021042 vhCDR2
EIRTKANNHATYYAESVKG

SEQ ID NO: 30218 - protein, 10 aa, Artificial Sequence
  Description of Artificial Sequence: Synthetic peptide
  XENP021042 vhCDR3
VANWDWYFDV

SEQ ID NO: 30219 - protein, 218 aa, Artificial Sequence; identical to SEQ ID NO: 17590
  Description of Artificial Sequence: Synthetic polypeptide
  XENP021042 7G8_H0.107_L0_Fab Light Chain

SEQ ID NO: 30220 - protein, 111 aa, Artificial Sequence; identical to SEQ ID NO: 17591
  Description of Artificial Sequence: Synthetic polypeptide
  VL of XENP021042

SEQ ID NO: 30221 - protein, 15 aa, Artificial Sequence
  Description of Artificial Sequence: Synthetic peptide
  XENP021042 vlCDR1
KASQSVDYDGDSYMN

SEQ ID NO: 30222 - protein, 7 aa, Artificial Sequence
  Description of Artificial Sequence: Synthetic peptide
  XENP021042 vlCDR2
AASNLES

SEQ ID NO: 30223 - protein, 9 aa, Artificial Sequence
  Description of Artificial Sequence: Synthetic peptide
  XENP021042 vlCDR3
QQSNEDPFT

SEQ ID NO: 30224 - protein, 226 aa, Artificial Sequence
  Description of Artificial Sequence: Synthetic polypeptide
  XENP021043 7G8_H0.110_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRDANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30225 - protein, 121 aa, Artificial Sequence; identical to SEQ ID NO: 19306
  Description of Artificial Sequence: Synthetic polypeptide
  VH of XENP021043

SEQ ID NO: 30226 - protein, 5 aa, Artificial Sequence
  Description of Artificial Sequence: Synthetic peptide
  XENP021043 vhCDR1
DAWMD

SEQ ID NO: 30227 - protein, 19 aa, Artificial Sequence
  Description of Artificial Sequence: Synthetic peptide
  XENP021043 vhCDR2
EIRTKANNHATYYAESVKG

SEQ ID NO: 30228 - protein, 10 aa, Artificial Sequence
  Description of Artificial Sequence: Synthetic peptide
  XENP021043 vhCDR3
DANWDWYFDV

SEQ ID NO: 30229 - protein, 218 aa, Artificial Sequence; identical to SEQ ID NO: 17590
  Description of Artificial Sequence: Synthetic polypeptide
  XENP021043 7G8_H0.110_L0_Fab Light Chain

SEQ ID NO: 30230 - protein, 111 aa, Artificial Sequence; identical to SEQ ID NO: 17591
  Description of Artificial Sequence: Synthetic polypeptide
  VL of XENP021043

SEQ ID NO: 30231 - protein, 15 aa, Artificial Sequence
  Description of Artificial Sequence: Synthetic peptide
  XENP021043 vlCDR1
KASQSVDYDGDSYMN

SEQ ID NO: 30232 - protein, 7 aa, Artificial Sequence
  Description of Artificial Sequence: Synthetic peptide
  XENP021043 vlCDR2
AASNLES

SEQ ID NO: 30233 - protein, 9 aa, Artificial Sequence
  Description of Artificial Sequence: Synthetic peptide
  XENP021043 vlCDR3
QQSNEDPFT

SEQ ID NO: 30234 - protein, 226 aa, Artificial Sequence
  Description of Artificial Sequence: Synthetic polypeptide
  XENP021044 7G8_H0.111_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRAANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30235 - protein, 121 aa, Artificial Sequence; identical to SEQ ID NO: 19316
  Description of Artificial Sequence: Synthetic polypeptide
  VH of XENP021044

SEQ ID NO: 30236 - protein, 5 aa, Artificial Sequence
  Description of Artificial Sequence: Synthetic peptide
  XENP021044 vhCDR1
DAWMD

SEQ ID NO: 30237 - protein, 19 aa, Artificial Sequence
  Description of Artificial Sequence: Synthetic peptide
  XENP021044 vhCDR2
EIRTKANNHATYYAESVKG

SEQ ID NO: 30238 - protein, 10 aa, Artificial Sequence
  Description of Artificial Sequence: Synthetic peptide
  XENP021044 vhCDR3
AANWDWYFDV

SEQ ID NO: 30239 - protein, 218 aa, Artificial Sequence; identical to SEQ ID NO: 17590
  Description of Artificial Sequence: Synthetic polypeptide
  XENP021044 7G8_H0.111_L0_Fab Light Chain

SEQ ID NO: 30240 - protein, 111 aa, Artificial Sequence; identical to SEQ ID NO: 17591
  Description of Artificial Sequence: Synthetic polypeptide
  VL of XENP021044

SEQ ID NO: 30241 - protein, 15 aa, Artificial Sequence
  Description of Artificial Sequence: Synthetic peptide
  XENP021044 vlCDR1
KASQSVDYDGDSYMN

SEQ ID NO: 30242 - protein, 7 aa, Artificial Sequence
  Description of Artificial Sequence: Synthetic peptide
  XENP021044 vlCDR2
AASNLES

SEQ ID NO: 30243 - protein, 9 aa, Artificial Sequence
  Description of Artificial Sequence: Synthetic peptide
  XENP021044 vlCDR3
QQSNEDPFT

SEQ ID NO: 30244 - protein, 226 aa, Artificial Sequence
  Description of Artificial Sequence: Synthetic polypeptide
  XENP021045 7G8_H0.112_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRQANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30245 - protein, 121 aa, Artificial Sequence; identical to SEQ ID NO: 19326
  Description of Artificial Sequence: Synthetic polypeptide
  VH of XENP021045

SEQ ID NO: 30246 - protein, 5 aa, Artificial Sequence
  Description of Artificial Sequence: Synthetic peptide
  XENP021045 vhCDR1
DAWMD

SEQ ID NO: 30247 - protein, 19 aa, Artificial Sequence
  Description of Artificial Sequence: Synthetic peptide
  XENP021045 vhCDR2
EIRTKANNHATYYAESVKG

SEQ ID NO: 30248 - protein, 10 aa, Artificial Sequence
  Description of Artificial Sequence: Synthetic peptide
  XENP021045 vhCDR3
QANWDWYFDV

SEQ ID NO: 30249 - protein, 218 aa, Artificial Sequence; identical to SEQ ID NO: 17590
  Description of Artificial Sequence: Synthetic polypeptide
  XENP021045 7G8_H0.112_L0_Fab Light Chain

SEQ ID NO: 30250 - protein, 111 aa, Artificial Sequence; identical to SEQ ID NO: 17591
  Description of Artificial Sequence: Synthetic polypeptide
  VL of XENP021045

SEQ ID NO: 30251 - protein, 15 aa, Artificial Sequence
  Description of Artificial Sequence: Synthetic peptide
  XENP021045 vlCDR1
KASQSVDYDGDSYMN

SEQ ID NO: 30252 - protein, 7 aa, Artificial Sequence
  Description of Artificial Sequence: Synthetic peptide
  XENP021045 vlCDR2
AASNLES

SEQ ID NO: 30253 - protein, 9 aa, Artificial Sequence
  Description of Artificial Sequence: Synthetic peptide
  XENP021045 vlCDR3
QQSNEDPFT

SEQ ID NO: 30254 - protein, 226 aa, Artificial Sequence
  Description of Artificial Sequence: Synthetic polypeptide
  XENP021046 7G8_H0.114_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLSNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30255 - protein, 121 aa, Artificial Sequence; identical to SEQ ID NO: 19346
  Description of Artificial Sequence: Synthetic polypeptide
  VH of XENP021046

SEQ ID NO: 30256 - protein, 5 aa, Artificial Sequence
  Description of Artificial Sequence: Synthetic peptide
  XENP021046 vhCDR1
DAWMD

SEQ ID NO: 30257 - protein, 19 aa, Artificial Sequence
  Description of Artificial Sequence: Synthetic peptide
  XENP021046 vhCDR2
EIRTKANNHATYYAESVKG

SEQ ID NO: 30258 - protein, 10 aa, Artificial Sequence
  Description of Artificial Sequence: Synthetic peptide
  XENP021046 vhCDR3
LSNWDWYFDV

SEQ ID NO: 30259 - protein, 218 aa, Artificial Sequence; identical to SEQ ID NO: 17590
  Description of Artificial Sequence: Synthetic polypeptide
  XENP021046 7G8_H0.114_L0_Fab Light Chain

SEQ ID NO: 30260 - protein, 111 aa, Artificial Sequence; identical to SEQ ID NO: 17591
  Description of Artificial Sequence: Synthetic polypeptide
  VL of XENP021046

SEQ ID NO: 30261 - protein, 15 aa, Artificial Sequence
  Description of Artificial Sequence: Synthetic peptide
  XENP021046 vlCDR1
KASQSVDYDGDSYMN

SEQ ID NO: 30262 - protein, 7 aa, Artificial Sequence
  Description of Artificial Sequence: Synthetic peptide
  XENP021046 vlCDR2
AASNLES

SEQ ID NO: 30263 - protein, 9 aa, Artificial Sequence
  Description of Artificial Sequence: Synthetic peptide
  XENP021046 vlCDR3
QQSNEDPFT

SEQ ID NO: 30264 - protein, 226 aa, Artificial Sequence
  Description of Artificial Sequence: Synthetic polypeptide
  XENP021047 7G8_H0.115_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLTNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30265 - protein, 121 aa, Artificial Sequence; identical to SEQ ID NO: 19356
  Description of Artificial Sequence: Synthetic polypeptide
  VH of XENP021047

SEQ ID NO: 30266 - protein, 5 aa, Artificial Sequence
  Description of Artificial Sequence: Synthetic peptide
  XENP021047 vhCDR1
DAWMD

SEQ ID NO: 30267 - protein, 19 aa, Artificial Sequence
  Description of Artificial Sequence: Synthetic peptide
  XENP021047 vhCDR2
EIRTKANNHATYYAESVKG

SEQ ID NO: 30268 - protein, 10 aa, Artificial Sequence
  Description of Artificial Sequence: Synthetic peptide
  XENP021047 vhCDR3
LTNWDWYFDV

SEQ ID NO: 30269 - protein, 218 aa, Artificial Sequence; identical to SEQ ID NO: 17590
  Description of Artificial Sequence: Synthetic polypeptide
  XENP021047 7G8_H0.115_L0_Fab Light Chain

SEQ ID NO: 30270 - protein, 111 aa, Artificial Sequence; identical to SEQ ID NO: 17591
  Description of Artificial Sequence: Synthetic polypeptide
  VL of XENP021047

SEQ ID NO: 30271 - protein, 15 aa, Artificial Sequence
  Description of Artificial Sequence: Synthetic peptide
  XENP021047 vlCDR1
KASQSVDYDGDSYMN

SEQ ID NO: 30272 - protein, 7 aa, Artificial Sequence
  Description of Artificial Sequence: Synthetic peptide
  XENP021047 vlCDR2
AASNLES

SEQ ID NO: 30273 - protein, 9 aa, Artificial Sequence
  Description of Artificial Sequence: Synthetic peptide
  XENP021047 vlCDR3
QQSNEDPFT

SEQ ID NO: 30274 - protein, 226 aa, Artificial Sequence
  Description of Artificial Sequence: Synthetic polypeptide
  XENP021048 7G8_H0.116_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLGNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30275 - protein, 121 aa, Artificial Sequence; identical to SEQ ID NO: 19366
  Description of Artificial Sequence: Synthetic polypeptide
  VH of XENP021048

SEQ ID NO: 30276 - protein, 5 aa, Artificial Sequence
  Description of Artificial Sequence: Synthetic peptide
  XENP021048 vhCDR1
DAWMD

SEQ ID NO: 30277 - protein, 19 aa, Artificial Sequence
  Description of Artificial Sequence: Synthetic peptide
  XENP021048 vhCDR2
EIRTKANNHATYYAESVKG

SEQ ID NO: 30278 - protein, 10 aa, Artificial Sequence
  Description of Artificial Sequence: Synthetic peptide
  XENP021048 vhCDR3
LGNWDWYFDV

SEQ ID NO: 30279 - protein, 218 aa, Artificial Sequence; identical to SEQ ID NO: 17590
  Description of Artificial Sequence: Synthetic polypeptide
  XENP021048 7G8_H0.116_L0_Fab Light Chain

SEQ ID NO: 30280 - protein, 111 aa, Artificial Sequence; identical to SEQ ID NO: 17591
  Description of Artificial Sequence: Synthetic polypeptide
  VL of XENP021048

SEQ ID NO: 30281 - protein, 15 aa, Artificial Sequence
  Description of Artificial Sequence: Synthetic peptide
  XENP021048 vlCDR1
KASQSVDYDGDSYMN

SEQ ID NO: 30282 - protein, 7 aa, Artificial Sequence
  Description of Artificial Sequence: Synthetic peptide
  XENP021048 vlCDR2
AASNLES

SEQ ID NO: 30283 - protein, 9 aa, Artificial Sequence
  Description of Artificial Sequence: Synthetic peptide
  XENP021048 vlCDR3
QQSNEDPFT

SEQ ID NO: 30284 - protein, 226 aa, Artificial Sequence
  Description of Artificial Sequence: Synthetic polypeptide
  XENP021049 7G8_H0.117_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLHNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30285 - protein, 121 aa, Artificial Sequence; identical to SEQ ID NO: 19376
  Description of Artificial Sequence: Synthetic polypeptide
  VH of XENP021049

SEQ ID NO: 30286 - protein, 5 aa, Artificial Sequence
  Description of Artificial Sequence: Synthetic peptide
  XENP021049 vhCDR1
DAWMD

SEQ ID NO: 30287 - protein, 19 aa, Artificial Sequence
  Description of Artificial Sequence: Synthetic peptide
  XENP021049 vhCDR2
EIRTKANNHATYYAESVKG

SEQ ID NO: 30288 - protein, 10 aa, Artificial Sequence
  Description of Artificial Sequence: Synthetic peptide
  XENP021049 vhCDR3
LHNWDWYFDV

SEQ ID NO: 30289 - protein, 218 aa, Artificial Sequence; identical to SEQ ID NO: 17590
  Description of Artificial Sequence: Synthetic polypeptide
  XENP021049 7G8_H0.117_L0_Fab Light Chain

SEQ ID NO: 30290 - protein, 111 aa, Artificial Sequence; identical to SEQ ID NO: 17591
  Description of Artificial Sequence: Synthetic polypeptide
  VL of XENP021049

SEQ ID NO: 30291 - protein, 15 aa, Artificial Sequence
  Description of Artificial Sequence: Synthetic peptide
  XENP021049 vlCDR1
KASQSVDYDGDSYMN

SEQ ID NO: 30292 - protein, 7 aa, Artificial Sequence
  Description of Artificial Sequence: Synthetic peptide
  XENP021049 vlCDR2
AASNLES

SEQ ID NO: 30293 - protein, 9 aa, Artificial Sequence
  Description of Artificial Sequence: Synthetic peptide
  XENP021049 vlCDR3
QQSNEDPFT

SEQ ID NO: 30294 - protein, 226 aa, Artificial Sequence
  Description of Artificial Sequence: Synthetic polypeptide
  XENP021050 7G8_H0.118_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLQNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30295 - protein, 121 aa, Artificial Sequence; identical to SEQ ID NO: 19386
  Description of Artificial Sequence: Synthetic polypeptide
  VH of XENP021050

SEQ ID NO: 30296 - protein, 5 aa, Artificial Sequence
  Description of Artificial Sequence: Synthetic peptide
  XENP021050 vhCDR1
DAWMD

SEQ ID NO: 30297 - protein, 19 aa, Artificial Sequence
  Description of Artificial Sequence: Synthetic peptide
  XENP021050 vhCDR2
EIRTKANNHATYYAESVKG

SEQ ID NO: 30298 - protein, 10 aa, Artificial Sequence
  Description of Artificial Sequence: Synthetic peptide
  XENP021050 vhCDR3
LQNWDWYFDV

SEQ ID NO: 30299 - protein, 218 aa, Artificial Sequence; identical to SEQ ID NO: 17590
  Description of Artificial Sequence: Synthetic polypeptide
  XENP021050 7G8_H0.118_L0_Fab Light Chain

SEQ ID NO: 30300 - protein, 111 aa, Artificial Sequence; identical to SEQ ID NO: 17591
  Description of Artificial Sequence: Synthetic polypeptide
  VL of XENP021050

SEQ ID NO: 30301 - protein, 15 aa, Artificial Sequence
  Description of Artificial Sequence: Synthetic peptide
  XENP021050 vlCDR1
KASQSVDYDGDSYMN

SEQ ID NO: 30302 - protein, 7 aa, Artificial Sequence
  Description of Artificial Sequence: Synthetic peptide
  XENP021050 vlCDR2
AASNLES

SEQ ID NO: 30303 - protein, 9 aa, Artificial Sequence
  Description of Artificial Sequence: Synthetic peptide
  XENP021050 vlCDR3
QQSNEDPFT

SEQ ID NO: 30304 - protein, 226 aa, Artificial Sequence
  Description of Artificial Sequence: Synthetic polypeptide
  XENP021051 7G8_H0.119_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLDNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30305 - protein, 121 aa, Artificial Sequence; identical to SEQ ID NO: 19396
  Description of Artificial Sequence: Synthetic polypeptide
  VH of XENP021051

SEQ ID NO: 30306 - protein, 5 aa, Artificial Sequence
  Description of Artificial Sequence: Synthetic peptide
  XENP021051 vhCDR1
DAWMD

SEQ ID NO: 30307 - protein, 19 aa, Artificial Sequence
  Description of Artificial Sequence: Synthetic peptide
  XENP021051 vhCDR2
EIRTKANNHATYYAESVKG

SEQ ID NO: 30308 - protein, 10 aa, Artificial Sequence
  Description of Artificial Sequence: Synthetic peptide
  XENP021051 vhCDR3
LDNWDWYFDV

SEQ ID NO: 30309 - protein, 218 aa, Artificial Sequence; identical to SEQ ID NO: 17590
  Description of Artificial Sequence: Synthetic polypeptide
  XENP021051 7G8_H0.119_L0_Fab Light Chain

SEQ ID NO: 30310 - protein, 111 aa, Artificial Sequence; identical to SEQ ID NO: 17591
  Description of Artificial Sequence: Synthetic polypeptide
  VL of XENP021051

SEQ ID NO: 30311 - protein, 15 aa, Artificial Sequence
  Description of Artificial Sequence: Synthetic peptide
  XENP021051 vlCDR1
KASQSVDYDGDSYMN

SEQ ID NO: 30312 - protein, 7 aa, Artificial Sequence
  Description of Artificial Sequence: Synthetic peptide
  XENP021051 vlCDR2
AASNLES

SEQ ID NO: 30313 - protein, 9 aa, Artificial Sequence
  Description of Artificial Sequence: Synthetic peptide
  XENP021051 vlCDR3
QQSNEDPFT

SEQ ID NO: 30314 - protein, 226 aa, Artificial Sequence
  Description of Artificial Sequence: Synthetic polypeptide
  XENP021052 7G8_H0.120_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLLNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30315 - protein, 121 aa, Artificial Sequence; identical to SEQ ID NO: 19406
  Description of Artificial Sequence: Synthetic polypeptide
  VH of XENP021052

SEQ ID NO: 30316 - protein, 5 aa, Artificial Sequence
  Description of Artificial Sequence: Synthetic peptide
  XENP021052 vhCDR1
DAWMD

SEQ ID NO: 30317 - protein, 19 aa, Artificial Sequence
  Description of Artificial Sequence: Synthetic peptide
  XENP021052 vhCDR2
EIRTKANNHATYYAESVKG

SEQ ID NO: 30318 - protein, 10 aa, Artificial Sequence
  Description of Artificial Sequence: Synthetic peptide
  XENP021052 vhCDR3
LLNWDWYFDV

SEQ ID NO: 30319 - protein, 218 aa, Artificial Sequence; identical to SEQ ID NO: 17590
  Description of Artificial Sequence: Synthetic polypeptide
  XENP021052 7G8_H0.120_L0_Fab Light Chain

SEQ ID NO: 30320 - protein, 111 aa, Artificial Sequence; identical to SEQ ID NO: 17591
  Description of Artificial Sequence: Synthetic polypeptide
  VL of XENP021052

SEQ ID NO: 30321 - protein, 15 aa, Artificial Sequence
  Description of Artificial Sequence: Synthetic peptide
  XENP021052 vlCDR1
KASQSVDYDGDSYMN

SEQ ID NO: 30322 - protein, 7 aa, Artificial Sequence
  Description of Artificial Sequence: Synthetic peptide
  XENP021052 vlCDR2
AASNLES

SEQ ID NO: 30323 - protein, 9 aa, Artificial Sequence
  Description of Artificial Sequence: Synthetic peptide
  XENP021052 vlCDR3
QQSNEDPFT

SEQ ID NO: 30324 - protein, 226 aa, Artificial Sequence
  Description of Artificial Sequence: Synthetic polypeptide
  XENP021053 7G8_H0.121_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLKNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30325 - protein, 121 aa, Artificial Sequence; identical to SEQ ID NO: 19416
  Description of Artificial Sequence: Synthetic polypeptide
  VH of XENP021053

SEQ ID NO: 30326 - protein, 5 aa, Artificial Sequence
  Description of Artificial Sequence: Synthetic peptide
  XENP021053 vhCDR1
DAWMD

SEQ ID NO: 30327 - protein, 19 aa, Artificial Sequence
  Description of Artificial Sequence: Synthetic peptide
  XENP021053 vhCDR2
EIRTKANNHATYYAESVKG

SEQ ID NO: 30328 - protein, 10 aa, Artificial Sequence
  Description of Artificial Sequence: Synthetic peptide
  XENP021053 vhCDR3
LKNWDWYFDV

SEQ ID NO: 30329 - protein, 218 aa, Artificial Sequence; identical to SEQ ID NO: 17590
  Description of Artificial Sequence: Synthetic polypeptide
  XENP021053 7G8_H0.121_L0_Fab Light Chain

SEQ ID NO: 30330 - protein, 111 aa, Artificial Sequence; identical to SEQ ID NO: 17591
  Description of Artificial Sequence: Synthetic polypeptide
  VL of XENP021053

SEQ ID NO: 30331 - protein, 15 aa, Artificial Sequence
  Description of Artificial Sequence: Synthetic peptide
  XENP021053 vlCDR1
KASQSVDYDGDSYMN

SEQ ID NO: 30332 - protein, 7 aa, Artificial Sequence
  Description of Artificial Sequence: Synthetic peptide
  XENP021053 vlCDR2
AASNLES

SEQ ID NO: 30333 - protein, 9 aa, Artificial Sequence
  Description of Artificial Sequence: Synthetic peptide
  XENP021053 vlCDR3
QQSNEDPFT

SEQ ID NO: 30334 - protein, 226 aa, Artificial Sequence
  Description of Artificial Sequence: Synthetic polypeptide
  XENP021054 7G8_H0.122_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLYNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30335 - protein, 121 aa, Artificial Sequence; identical to SEQ ID NO: 19426
  Description of Artificial Sequence: Synthetic polypeptide
  VH of XENP021054

SEQ ID NO: 30336 - protein, 5 aa, Artificial Sequence
  Description of Artificial Sequence: Synthetic peptide
  XENP021054 vhCDR1
DAWMD

SEQ ID NO: 30337 - protein, 19 aa, Artificial Sequence
  Description of Artificial Sequence: Synthetic peptide
  XENP021054 vhCDR2
EIRTKANNHATYYAESVKG

SEQ ID NO: 30338 - protein, 10 aa, Artificial Sequence
  Description of Artificial Sequence: Synthetic peptide
  XENP021054 vhCDR3
LYNWDWYFDV

SEQ ID NO: 30339 - protein, 218 aa, Artificial Sequence; identical to SEQ ID NO: 17590
  Description of Artificial Sequence: Synthetic polypeptide
  XENP021054 7G8_H0.122_L0_Fab Light Chain

SEQ ID NO: 30340 - protein, 111 aa, Artificial Sequence; identical to SEQ ID NO: 17591
  Description of Artificial Sequence: Synthetic polypeptide
  VL of XENP021054

SEQ ID NO: 30341 - protein, 15 aa, Artificial Sequence
  Description of Artificial Sequence: Synthetic peptide
  XENP021054 vlCDR1
KASQSVDYDGDSYMN

SEQ ID NO: 30342 - protein, 7 aa, Artificial Sequence
  Description of Artificial Sequence: Synthetic peptide
  XENP021054 vlCDR2
AASNLES

SEQ ID NO: 30343 - protein, 9 aa, Artificial Sequence
  Description of Artificial Sequence: Synthetic peptide
  XENP021054 vlCDR3
QQSNEDPFT

SEQ ID NO: 30344 - protein, 226 aa, Artificial Sequence
  Description of Artificial Sequence: Synthetic polypeptide
  XENP021055 7G8_H0.123_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLADWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30345 - protein, 121 aa, Artificial Sequence; identical to SEQ ID NO: 19436
  Description of Artificial Sequence: Synthetic polypeptide
  VH of XENP021055

SEQ ID NO: 30346 - protein, 5 aa, Artificial Sequence
  Description of Artificial Sequence: Synthetic peptide
  XENP021055 vhCDR1
DAWMD

SEQ ID NO: 30347 - protein, 19 aa, Artificial Sequence
  Description of Artificial Sequence: Synthetic peptide
  XENP021055 vhCDR2
EIRTKANNHATYYAESVKG

SEQ ID NO: 30348 - protein, 10 aa, Artificial Sequence
  Description of Artificial Sequence: Synthetic peptide
  XENP021055 vhCDR3
LADWDWYFDV

SEQ ID NO: 30349 - protein, 218 aa, Artificial Sequence; identical to SEQ ID NO: 17590
  Description of Artificial Sequence: Synthetic polypeptide
  XENP021055 7G8_H0.123_L0_Fab Light Chain

SEQ ID NO: 30350 - protein, 111 aa, Artificial Sequence; identical to SEQ ID NO: 17591
  Description of Artificial Sequence: Synthetic polypeptide
  VL of XENP021055

SEQ ID NO: 30351 - protein, 15 aa, Artificial Sequence
  Description of Artificial Sequence: Synthetic peptide
  XENP021055 vlCDR1
KASQSVDYDGDSYMN

SEQ ID NO: 30352 - protein, 7 aa, Artificial Sequence
  Description of Artificial Sequence: Synthetic peptide
  XENP021055 vlCDR2
AASNLES

SEQ ID NO: 30353 - protein, 9 aa, Artificial Sequence
  Description of Artificial Sequence: Synthetic peptide
  XENP021055 vlCDR3
QQSNEDPFT

SEQ ID NO: 30354 - protein, 226 aa, Artificial Sequence
  Description of Artificial Sequence: Synthetic polypeptide
  XENP021056 7G8_H0.124_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAHWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30355 - protein, 121 aa, Artificial Sequence; identical to SEQ ID NO: 19446
  Description of Artificial Sequence: Synthetic polypeptide
  VH of XENP021056

SEQ ID NO: 30356 - protein, 5 aa, Artificial Sequence
  Description of Artificial Sequence: Synthetic peptide
  XENP021056 vhCDR1
DAWMD

SEQ ID NO: 30357 - protein, 19 aa, Artificial Sequence
  Description of Artificial Sequence: Synthetic peptide
  XENP021056 vhCDR2
EIRTKANNHATYYAESVKG

SEQ ID NO: 30358 - protein, 10 aa, Artificial Sequence
  Description of Artificial Sequence: Synthetic peptide
  XENP021056 vhCDR3
LAHWDWYFDV

SEQ ID NO: 30359 - protein, 218 aa, Artificial Sequence; identical to SEQ ID NO: 17590
  Description of Artificial Sequence: Synthetic polypeptide
  XENP021056 7G8_H0.124_L0_Fab Light Chain

SEQ ID NO: 30360 - protein, 111 aa, Artificial Sequence; identical to SEQ ID NO: 17591
  Description of Artificial Sequence: Synthetic polypeptide
  VL of XENP021056

SEQ ID NO: 30361 - protein, 15 aa, Artificial Sequence
  Description of Artificial Sequence: Synthetic peptide
  XENP021056 vlCDR1
KASQSVDYDGDSYMN

SEQ ID NO: 30362 - protein, 7 aa, Artificial Sequence
  Description of Artificial Sequence: Synthetic peptide
  XENP021056 vlCDR2
AASNLES

SEQ ID NO: 30363 - protein, 9 aa, Artificial Sequence
  Description of Artificial Sequence: Synthetic peptide
  XENP021056 vlCDR3
QQSNEDPFT

SEQ ID NO: 30364 - protein, 226 aa, Artificial Sequence
  Description of Artificial Sequence: Synthetic polypeptide
  XENP021057 7G8_H0.125_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAEWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30365 - protein, 121 aa, Artificial Sequence; identical to SEQ ID NO: 19456
  Description of Artificial Sequence: Synthetic polypeptide
  VH of XENP021057

SEQ ID NO: 30366 - protein, 5 aa, Artificial Sequence
  Description of Artificial Sequence: Synthetic peptide
  XENP021057 vhCDR1
DAWMD

SEQ ID NO: 30367 - protein, 19 aa, Artificial Sequence
  Description of Artificial Sequence: Synthetic peptide
  XENP021057 vhCDR2
EIRTKANNHATYYAESVKG

SEQ ID NO: 30368 - protein, 10 aa, Artificial Sequence
  Description of Artificial Sequence: Synthetic peptide
  XENP021057 vhCDR3
LAEWDWYFDV

SEQ ID NO: 30369 - protein, 218 aa, Artificial Sequence; identical to SEQ ID NO: 17590
  Description of Artificial Sequence: Synthetic polypeptide
  XENP021057 7G8_H0.125_L0_Fab Light Chain

SEQ ID NO: 30370 - protein, 111 aa, Artificial Sequence; identical to SEQ ID NO: 17591
  Description of Artificial Sequence: Synthetic polypeptide
  VL of XENP021057

SEQ ID NO: 30371 - protein, 15 aa, Artificial Sequence
  Description of Artificial Sequence: Synthetic peptide
  XENP021057 vlCDR1
KASQSVDYDGDSYMN

SEQ ID NO: 30372 - protein, 7 aa, Artificial Sequence
  Description of Artificial Sequence: Synthetic peptide
  XENP021057 vlCDR2
AASNLES

SEQ ID NO: 30373 - protein, 9 aa, Artificial Sequence
  Description of Artificial Sequence: Synthetic peptide
  XENP021057 vlCDR3
QQSNEDPFT

SEQ ID NO: 30374 - protein, 226 aa, Artificial Sequence
  Description of Artificial Sequence: Synthetic polypeptide
  XENP021058 7G8_H0.126_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLASWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30375 - protein, 121 aa, Artificial Sequence; identical to SEQ ID NO: 19466
  Description of Artificial Sequence: Synthetic polypeptide
  VH of XENP021058

SEQ ID NO: 30376 - protein, 5 aa, Artificial Sequence
  Description of Artificial Sequence: Synthetic peptide
  XENP021058 vhCDR1
DAWMD

SEQ ID NO: 30377 - protein, 19 aa, Artificial Sequence
  Description of Artificial Sequence: Synthetic peptide
  XENP021058 vhCDR2
EIRTKANNHATYYAESVKG

SEQ ID NO: 30378 - protein, 10 aa, Artificial Sequence
  Description of Artificial Sequence: Synthetic peptide
  XENP021058 vhCDR3
LASWDWYFDV

SEQ ID NO: 30379 - protein, 218 aa, Artificial Sequence; identical to SEQ ID NO: 17590
  Description of Artificial Sequence: Synthetic polypeptide
  XENP021058 7G8_H0.126_L0_Fab Light Chain

SEQ ID NO: 30380 - protein, 111 aa, Artificial Sequence; identical to SEQ ID NO: 17591
  Description of Artificial Sequence: Synthetic polypeptide
  VL of XENP021058

SEQ ID NO: 30381 - protein, 15 aa, Artificial Sequence
  Description of Artificial Sequence: Synthetic peptide
  XENP021058 vlCDR1
KASQSVDYDGDSYMN

SEQ ID NO: 30382 - protein, 7 aa, Artificial Sequence
  Description of Artificial Sequence: Synthetic peptide
  XENP021058 vlCDR2
AASNLES

SEQ ID NO: 30383 - protein, 9 aa, Artificial Sequence
  Description of Artificial Sequence: Synthetic peptide
  XENP021058 vlCDR3
QQSNEDPFT

SEQ ID NO: 30384 - protein, 226 aa, Artificial Sequence
  Description of Artificial Sequence: Synthetic polypeptide
  XENP021059 7G8_H0.127_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLARWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30385 - protein, 121 aa, Artificial Sequence; identical to SEQ ID NO: 19476
  Description of Artificial Sequence: Synthetic polypeptide
  VH of XENP021059

SEQ ID NO: 30386 - protein, 5 aa, Artificial Sequence
  Description of Artificial Sequence: Synthetic peptide
  XENP021059 vhCDR1
DAWMD

SEQ ID NO: 30387 - protein, 19 aa, Artificial Sequence
  Description of Artificial Sequence: Synthetic peptide
  XENP021059 vhCDR2
EIRTKANNHATYYAESVKG

SEQ ID NO: 30388 - protein, 10 aa, Artificial Sequence
  Description of Artificial Sequence: Synthetic peptide
  XENP021059 vhCDR3
LARWDWYFDV

SEQ ID NO: 30389 - protein, 218 aa, Artificial Sequence; identical to SEQ ID NO: 17590
  Description of Artificial Sequence: Synthetic polypeptide
  XENP021059 7G8_H0.127_L0_Fab Light Chain

SEQ ID NO: 30390 - protein, 111 aa, Artificial Sequence; identical to SEQ ID NO: 17591
  Description of Artificial Sequence: Synthetic polypeptide
  VL of XENP021059

SEQ ID NO: 30391 - protein, 15 aa, Artificial Sequence
  Description of Artificial Sequence: Synthetic peptide
  XENP021059 vlCDR1
KASQSVDYDGDSYMN

SEQ ID NO: 30392 - protein, 7 aa, Artificial Sequence
  Description of Artificial Sequence: Synthetic peptide
  XENP021059 vlCDR2
AASNLES

SEQ ID NO: 30393 - protein, 9 aa, Artificial Sequence
  Description of Artificial Sequence: Synthetic peptide
  XENP021059 vlCDR3
QQSNEDPFT

SEQ ID NO: 30394 - protein, 226 aa, Artificial Sequence
  Description of Artificial Sequence: Synthetic polypeptide
  XENP021060 7G8_H0.128_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLALWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30395 - protein, 121 aa, Artificial Sequence; identical to SEQ ID NO: 19486
  Description of Artificial Sequence: Synthetic polypeptide
  VH of XENP021060

SEQ ID NO: 30396 - protein, 5 aa, Artificial Sequence
  Description of Artificial Sequence: Synthetic peptide
  XENP021060 vhCDR1
DAWMD

SEQ ID NO: 30397 - protein, 19 aa, Artificial Sequence
  Description of Artificial Sequence: Synthetic peptide
  XENP021060 vhCDR2
EIRTKANNHATYYAESVKG

SEQ ID NO: 30398 - protein, 10 aa, Artificial Sequence
  Description of Artificial Sequence: Synthetic peptide
  XENP021060 vhCDR3
LALWDWYFDV

SEQ ID NO: 30399 - protein, 218 aa, Artificial Sequence; identical to SEQ ID NO: 17590
  Description of Artificial Sequence: Synthetic polypeptide
  XENP021060 7G8_H0.128_L0_Fab Light Chain

SEQ ID NO: 30400 - protein, 111 aa, Artificial Sequence; identical to SEQ ID NO: 17591
  Description of Artificial Sequence: Synthetic polypeptide
  VL of XENP021060

SEQ ID NO: 30401 - protein, 15 aa, Artificial Sequence
  Description of Artificial Sequence: Synthetic peptide
  XENP021060 vlCDR1
KASQSVDYDGDSYMN

SEQ ID NO: 30402 - protein, 7 aa, Artificial Sequence
  Description of Artificial Sequence: Synthetic peptide
  XENP021060 vlCDR2
AASNLES

SEQ ID NO: 30403 - protein, 9 aa, Artificial Sequence
  Description of Artificial Sequence: Synthetic peptide
  XENP021060 vlCDR3
QQSNEDPFT

SEQ ID NO: 30404 - protein, 226 aa, Artificial Sequence
  Description of Artificial Sequence: Synthetic polypeptide
  XENP021061 7G8_H0.129_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLATWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30405 - protein, 121 aa, Artificial Sequence; identical to SEQ ID NO: 19496
  Description of Artificial Sequence: Synthetic polypeptide
  VH of XENP021061

SEQ ID NO: 30406 - protein, 5 aa, Artificial Sequence
  Description of Artificial Sequence: Synthetic peptide
  XENP021061 vhCDR1
DAWMD

SEQ ID NO: 30407 - protein, 19 aa, Artificial Sequence
  Description of Artificial Sequence: Synthetic peptide
  XENP021061 vhCDR2
EIRTKANNHATYYAESVKG

SEQ ID NO: 30408 - protein, 10 aa, Artificial Sequence
  Description of Artificial Sequence: Synthetic peptide
  XENP021061 vhCDR3
LATWDWYFDV

SEQ ID NO: 30409 - protein, 218 aa, Artificial Sequence; identical to SEQ ID NO: 17590
  Description of Artificial Sequence: Synthetic polypeptide
  XENP021061 7G8_H0.129_L0_Fab Light Chain

SEQ ID NO: 30410 - protein, 111 aa, Artificial Sequence; identical to SEQ ID NO: 17591
  Description of Artificial Sequence: Synthetic polypeptide
  VL of XENP021061

SEQ ID NO: 30411 - protein, 15 aa, Artificial Sequence
  Description of Artificial Sequence: Synthetic peptide
  XENP021061 vlCDR1
KASQSVDYDGDSYMN

SEQ ID NO: 30412 - protein, 7 aa, Artificial Sequence
  Description of Artificial Sequence: Synthetic peptide
  XENP021061 vlCDR2
AASNLES

SEQ ID NO: 30413 - protein, 9 aa, Artificial Sequence
  Description of Artificial Sequence: Synthetic peptide
  XENP021061 vlCDR3
QQSNEDPFT

SEQ ID NO: 30414 - protein, 226 aa, Artificial Sequence
  Description of Artificial Sequence: Synthetic polypeptide
  XENP021062 7G8_H0.130_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAGWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30415 - protein, 121 aa, Artificial Sequence; identical to SEQ ID NO: 19506
  Description of Artificial Sequence: Synthetic polypeptide
  VH of XENP021062

SEQ ID NO: 30416 - protein, 5 aa, Artificial Sequence
  Description of Artificial Sequence: Synthetic peptide
  XENP021062 vhCDR1
DAWMD

SEQ ID NO: 30417 - protein, 19 aa, Artificial Sequence
  Description of Artificial Sequence: Synthetic peptide
  XENP021062 vhCDR2
EIRTKANNHATYYAESVKG

SEQ ID NO: 30418 - protein, 10 aa, Artificial Sequence
  Description of Artificial Sequence: Synthetic peptide
  XENP021062 vhCDR3
LAGWDWYFDV

SEQ ID NO: 30419 - protein, 218 aa, Artificial Sequence; identical to SEQ ID NO: 17590
  Description of Artificial Sequence: Synthetic polypeptide
  XENP021062 7G8_H0.130_L0_Fab Light Chain

SEQ ID NO: 30420 - protein, 111 aa, Artificial Sequence; identical to SEQ ID NO: 17591
  Description of Artificial Sequence: Synthetic polypeptide
  VL of XENP021062

SEQ ID NO: 30421 - protein, 15 aa, Artificial Sequence
  Description of Artificial Sequence: Synthetic peptide
  XENP021062 vlCDR1
KASQSVDYDGDSYMN

SEQ ID NO: 30422 - protein, 7 aa, Artificial Sequence
  Description of Artificial Sequence: Synthetic peptide
  XENP021062 vlCDR2
AASNLES

SEQ ID NO: 30423 - protein, 9 aa, Artificial Sequence
  Description of Artificial Sequence: Synthetic peptide
  XENP021062 vlCDR3
QQSNEDPFT

SEQ ID NO: 30424 - protein, 226 aa, Artificial Sequence
  Description of Artificial Sequence: Synthetic polypeptide
  XENP021063 7G8_H0.131_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAYWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30425 - protein, 121 aa, Artificial Sequence; identical to SEQ ID NO: 19516
  Description of Artificial Sequence: Synthetic polypeptide
  VH of XENP021063

SEQ ID NO: 30426 - protein, 5 aa, Artificial Sequence
  Description of Artificial Sequence: Synthetic peptide
  XENP021063 vhCDR1
DAWMD

SEQ ID NO: 30427 - protein, 19 aa, Artificial Sequence
  Description of Artificial Sequence: Synthetic peptide
  XENP021063 vhCDR2
EIRTKANNHATYYAESVKG

SEQ ID NO: 30428 - protein, 10 aa, Artificial Sequence
  Description of Artificial Sequence: Synthetic peptide
  XENP021063 vhCDR3
LAYWDWYFDV

SEQ ID NO: 30429 - protein, 218 aa, Artificial Sequence; identical to SEQ ID NO: 17590
  Description of Artificial Sequence: Synthetic polypeptide
  XENP021063 7G8_H0.131_L0_Fab Light Chain

SEQ ID NO: 30430 - protein, 111 aa, Artificial Sequence; identical to SEQ ID NO: 17591
  Description of Artificial Sequence: Synthetic polypeptide
  VL of XENP021063

SEQ ID NO: 30431 - protein, 15 aa, Artificial Sequence
  Description of Artificial Sequence: Synthetic peptide
  XENP021063 vlCDR1
KASQSVDYDGDSYMN

SEQ ID NO: 30432 - protein, 7 aa, Artificial Sequence
  Description of Artificial Sequence: Synthetic peptide
  XENP021063 vlCDR2
AASNLES

SEQ ID NO: 30433 - protein, 9 aa, Artificial Sequence
  Description of Artificial Sequence: Synthetic peptide
  XENP021063 vlCDR3
QQSNEDPFT

SEQ ID NO: 30434 - protein, 226 aa, Artificial Sequence
  Description of Artificial Sequence: Synthetic polypeptide
  XENP021064 7G8_H0.132_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANFDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30435 - protein, 121 aa, Artificial Sequence; identical to SEQ ID NO: 19526
  Description of Artificial Sequence: Synthetic polypeptide
  VH of XENP021064

SEQ ID NO: 30436 - protein, 5 aa, Artificial Sequence
  Description of Artificial Sequence: Synthetic peptide
  XENP021064 vhCDR1
DAWMD

SEQ ID NO: 30437 - protein, 19 aa, Artificial Sequence
  Description of Artificial Sequence: Synthetic peptide
  XENP021064 vhCDR2
EIRTKANNHATYYAESVKG

SEQ ID NO: 30438 - protein, 10 aa, Artificial Sequence
  Description of Artificial Sequence: Synthetic peptide
  XENP021064 vhCDR3
LANFDWYFDV

SEQ ID NO: 30439 - protein, 218 aa, Artificial Sequence; identical to SEQ ID NO: 17590
  Description of Artificial Sequence: Synthetic polypeptide
  XENP021064 7G8_H0.132_L0_Fab Light Chain

SEQ ID NO: 30440 - protein, 111 aa, Artificial Sequence; identical to SEQ ID NO: 17591
  Description of Artificial Sequence: Synthetic polypeptide
  VL of XENP021064

SEQ ID NO: 30441 - protein, 15 aa, Artificial Sequence
  Description of Artificial Sequence: Synthetic peptide
  XENP021064 vlCDR1
KASQSVDYDGDSYMN

SEQ ID NO: 30442 - protein, 7 aa, Artificial Sequence
  Description of Artificial Sequence: Synthetic peptide
  XENP021064 vlCDR2
AASNLES

SEQ ID NO: 30443 - protein, 9 aa, Artificial Sequence
  Description of Artificial Sequence: Synthetic peptide
  XENP021064 vlCDR3
QQSNEDPFT

SEQ ID NO: 30444 - protein, 226 aa, Artificial Sequence
  Description of Artificial Sequence: Synthetic polypeptide
  XENP021065 7G8_H0.134_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANYDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30445 - protein, 121 aa, Artificial Sequence; identical to SEQ ID NO: 19546
  Description of Artificial Sequence: Synthetic polypeptide
  VH of XENP021065

SEQ ID NO: 30446 - protein, 5 aa, Artificial Sequence
  Description of Artificial Sequence: Synthetic peptide
  XENP021065 vhCDR1
DAWMD

SEQ ID NO: 30447 - protein, 19 aa, Artificial Sequence
  Description of Artificial Sequence: Synthetic peptide
  XENP021065 vhCDR2
EIRTKANNHATYYAESVKG

SEQ ID NO: 30448 - protein, 10 aa, Artificial Sequence
  Description of Artificial Sequence: Synthetic peptide
  XENP021065 vhCDR3
LANYDWYFDV

SEQ ID NO: 30449 - protein, 218 aa, Artificial Sequence; identical to SEQ ID NO: 17590
  Description of Artificial Sequence: Synthetic polypeptide
  XENP021065 7G8_H0.134_L0_Fab Light Chain

SEQ ID NO: 30450 - protein, 111 aa, Artificial Sequence; identical to SEQ ID NO: 17591
  Description of Artificial Sequence: Synthetic polypeptide
  VL of XENP021065

SEQ ID NO: 30451 - protein, 15 aa, Artificial Sequence
  Description of Artificial Sequence: Synthetic peptide
  XENP021065 vlCDR1
KASQSVDYDGDSYMN

SEQ ID NO: 30452 - protein, 7 aa, Artificial Sequence
  Description of Artificial Sequence: Synthetic peptide
  XENP021065 vlCDR2
AASNLES

SEQ ID NO: 30453 - protein, 9 aa, Artificial Sequence
  Description of Artificial Sequence: Synthetic peptide
  XENP021065 vlCDR3
QQSNEDPFT

SEQ ID NO: 30454 - protein, 226 aa, Artificial Sequence
  Description of Artificial Sequence: Synthetic polypeptide
  XENP021066 7G8_H0.141_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30455 - protein, 121 aa, Artificial Sequence; identical to SEQ ID NO: 19616
  Description of Artificial Sequence: Synthetic polypeptide
  VH of XENP021066

SEQ ID NO: 30456 - protein, 5 aa, Artificial Sequence
  Description of Artificial Sequence: Synthetic peptide
  XENP021066 vhCDR1
DAWMD

SEQ ID NO: 30457 - protein, 19 aa, Artificial Sequence
  Description of Artificial Sequence: Synthetic peptide
  XENP021066 vhCDR2
EIRTKANNHATYYAESVKG

SEQ ID NO: 30458 - protein, 10 aa, Artificial Sequence
  Description of Artificial Sequence: Synthetic peptide
  XENP021066 vhCDR3
LANWNWYFDV

SEQ ID NO: 30459 - protein, 218 aa, Artificial Sequence; identical to SEQ ID NO: 17590
  Description of Artificial Sequence: Synthetic polypeptide
  XENP021066 7G8_H0.141_L0_Fab Light Chain

SEQ ID NO: 30460 - protein, 111 aa, Artificial Sequence; identical to SEQ ID NO: 17591
  Description of Artificial Sequence: Synthetic polypeptide
  VL of XENP021066

SEQ ID NO: 30461 - protein, 15 aa, Artificial Sequence
  Description of Artificial Sequence: Synthetic peptide
  XENP021066 vlCDR1
KASQSVDYDGDSYMN

SEQ ID NO: 30462 - protein, 7 aa, Artificial Sequence
  Description of Artificial Sequence: Synthetic peptide
  XENP021066 vlCDR2
AASNLES

SEQ ID NO: 30463 - protein, 9 aa, Artificial Sequence
  Description of Artificial Sequence: Synthetic peptide
  XENP021066 vlCDR3
QQSNEDPFT

SEQ ID NO: 30464 - protein, 226 aa, Artificial Sequence
  Description of Artificial Sequence: Synthetic polypeptide
  XENP021067 7G8_H0.142_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWEWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30465 - protein, 121 aa, Artificial Sequence; identical to SEQ ID NO: 19626
  Description of Artificial Sequence: Synthetic polypeptide
  VH of XENP021067

SEQ ID NO: 30466 - protein, 5 aa, Artificial Sequence
  Description of Artificial Sequence: Synthetic peptide
  XENP021067 vhCDR1
DAWMD

SEQ ID NO: 30467 - protein, 19 aa, Artificial Sequence
  Description of Artificial Sequence: Synthetic peptide
  XENP021067 vhCDR2
EIRTKANNHATYYAESVKG

SEQ ID NO: 30468 - protein, 10 aa, Artificial Sequence
  Description of Artificial Sequence: Synthetic peptide
  XENP021067 vhCDR3
LANWEWYFDV

SEQ ID NO: 30469 - protein, 218 aa, Artificial Sequence; identical to SEQ ID NO: 17590
  Description of Artificial Sequence: Synthetic polypeptide
  XENP021067 7G8_H0.142_L0_Fab Light Chain

SEQ ID NO: 30470 - protein, 111 aa, Artificial Sequence; identical to SEQ ID NO: 17591
  Description of Artificial Sequence: Synthetic polypeptide
  VL of XENP021067

SEQ ID NO: 30471 - protein, 15 aa, Artificial Sequence
  Description of Artificial Sequence: Synthetic peptide
  XENP021067 vlCDR1
KASQSVDYDGDSYMN

SEQ ID NO: 30472 - protein, 7 aa, Artificial Sequence
  Description of Artificial Sequence: Synthetic peptide
  XENP021067 vlCDR2
AASNLES

SEQ ID NO: 30473 - protein, 9 aa, Artificial Sequence
  Description of Artificial Sequence: Synthetic peptide
  XENP021067 vlCDR3
QQSNEDPFT

SEQ ID NO: 30474 - protein, 226 aa, Artificial Sequence
  Description of Artificial Sequence: Synthetic polypeptide
  XENP021068 7G8_H0.143_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30475 - protein, 121 aa, Artificial Sequence; identical to SEQ ID NO: 19636
  Description of Artificial Sequence: Synthetic polypeptide
  VH of XENP021068

SEQ ID NO: 30476 - protein, 5 aa, Artificial Sequence
  Description of Artificial Sequence: Synthetic peptide
  XENP021068 vhCDR1
DAWMD

SEQ ID NO: 30477 - protein, 19 aa, Artificial Sequence
  Description of Artificial Sequence: Synthetic peptide
  XENP021068 vhCDR2
EIRTKANNHATYYAESVKG

SEQ ID NO: 30478 - protein, 10 aa, Artificial Sequence
  Description of Artificial Sequence: Synthetic peptide
  XENP021068 vhCDR3
LANWHWYFDV

SEQ ID NO: 30479 - protein, 218 aa, Artificial Sequence; identical to SEQ ID NO: 17590
  Description of Artificial Sequence: Synthetic polypeptide
  XENP021068 7G8_H0.143_L0_Fab Light Chain

SEQ ID NO: 30480 - protein, 111 aa, Artificial Sequence; identical to SEQ ID NO: 17591
  Description of Artificial Sequence: Synthetic polypeptide
  VL of XENP021068

SEQ ID NO: 30481 - protein, 15 aa, Artificial Sequence
  Description of Artificial Sequence: Synthetic peptide
  XENP021068 vlCDR1
KASQSVDYDGDSYMN

SEQ ID NO: 30482 - protein, 7 aa, Artificial Sequence
  Description of Artificial Sequence: Synthetic peptide
  XENP021068 vlCDR2
AASNLES

SEQ ID NO: 30483 - protein, 9 aa, Artificial Sequence
  Description of Artificial Sequence: Synthetic peptide
  XENP021068 vlCDR3
QQSNEDPFT

SEQ ID NO: 30484 - protein, 226 aa, Artificial Sequence
  Description of Artificial Sequence: Synthetic polypeptide
  XENP021069 7G8_H0.145_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWLWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30485 - protein, 121 aa, Artificial Sequence; identical to SEQ ID NO: 19656
  Description of Artificial Sequence: Synthetic polypeptide
  VH of XENP021069

SEQ ID NO: 30486 - protein, 5 aa, Artificial Sequence
  Description of Artificial Sequence: Synthetic peptide
  XENP021069 vhCDR1
DAWMD

SEQ ID NO: 30487 - protein, 19 aa, Artificial Sequence
  Description of Artificial Sequence: Synthetic peptide
  XENP021069 vhCDR2
EIRTKANNHATYYAESVKG

SEQ ID NO: 30488 - protein, 10 aa, Artificial Sequence
  Description of Artificial Sequence: Synthetic peptide
  XENP021069 vhCDR3
LANWLWYFDV

SEQ ID NO: 30489 - protein, 218 aa, Artificial Sequence; identical to SEQ ID NO: 17590
  Description of Artificial Sequence: Synthetic polypeptide
  XENP021069 7G8_H0.145_L0_Fab Light Chain

SEQ ID NO: 30490 - protein, 111 aa, Artificial Sequence; identical to SEQ ID NO: 17591
  Description of Artificial Sequence: Synthetic polypeptide
  VL of XENP021069

SEQ ID NO: 30491 - protein, 15 aa, Artificial Sequence
  Description of Artificial Sequence: Synthetic peptide
  XENP021069 vlCDR1
KASQSVDYDGDSYMN

SEQ ID NO: 30492 - protein, 7 aa, Artificial Sequence
  Description of Artificial Sequence: Synthetic peptide
  XENP021069 vlCDR2
AASNLES

SEQ ID NO: 30493 - protein, 9 aa, Artificial Sequence
  Description of Artificial Sequence: Synthetic peptide
  XENP021069 vlCDR3
QQSNEDPFT

SEQ ID NO: 30494 - protein, 226 aa, Artificial Sequence
  Description of Artificial Sequence: Synthetic polypeptide
  XENP021070 7G8_H0.146_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWGWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30495 - protein, 121 aa, Artificial Sequence; identical to SEQ ID NO: 19666
  Description of Artificial Sequence: Synthetic polypeptide
  VH of XENP021070

SEQ ID NO: 30496 - protein, 5 aa, Artificial Sequence
  Description of Artificial Sequence: Synthetic peptide
  XENP021070 vhCDR1
DAWMD

SEQ ID NO: 30497 - protein, 19 aa, Artificial Sequence
  Description of Artificial Sequence: Synthetic peptide
  XENP021070 vhCDR2
EIRTKANNHATYYAESVKG

SEQ ID NO: 30498 - protein, 10 aa, Artificial Sequence
  Description of Artificial Sequence: Synthetic peptide
  XENP021070 vhCDR3
LANWGWYFDV

SEQ ID NO: 30499 - protein, 218 aa, Artificial Sequence; identical to SEQ ID NO: 17590
  Description of Artificial Sequence: Synthetic polypeptide
  XENP021070 7G8_H0.146_L0_Fab Light Chain

SEQ ID NO: 30500 - protein, 111 aa, Artificial Sequence; identical to SEQ ID NO: 17591
  Description of Artificial Sequence: Synthetic polypeptide
  VL of XENP021070

SEQ ID NO: 30501 - protein, 15 aa, Artificial Sequence
  Description of Artificial Sequence: Synthetic peptide
  XENP021070 vlCDR1
KASQSVDYDGDSYMN

SEQ ID NO: 30502 - protein, 7 aa, Artificial Sequence
  Description of Artificial Sequence: Synthetic peptide
  XENP021070 vlCDR2
AASNLES

SEQ ID NO: 30503 - protein, 9 aa, Artificial Sequence
  Description of Artificial Sequence: Synthetic peptide
  XENP021070 vlCDR3
QQSNEDPFT

SEQ ID NO: 30504 - protein, 226 aa, Artificial Sequence
  Description of Artificial Sequence: Synthetic polypeptide
  XENP021071 7G8_H0.147_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWYWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30505 - protein, 121 aa, Artificial Sequence; identical to SEQ ID NO: 19676
  Description of Artificial Sequence: Synthetic polypeptide
  VH of XENP021071

SEQ ID NO: 30506 - protein, 5 aa, Artificial Sequence
  Description of Artificial Sequence: Synthetic peptide
  XENP021071 vhCDR1
DAWMD

SEQ ID NO: 30507 - protein, 19 aa, Artificial Sequence
  Description of Artificial Sequence: Synthetic peptide
  XENP021071 vhCDR2
EIRTKANNHATYYAESVKG

SEQ ID NO: 30508 - protein, 10 aa, Artificial Sequence
  Description of Artificial Sequence: Synthetic peptide
  XENP021071 vhCDR3
LANWYWYFDV

SEQ ID NO: 30509 - protein, 218 aa, Artificial Sequence; identical to SEQ ID NO: 17590
  Description of Artificial Sequence: Synthetic polypeptide
  XENP021071 7G8_H0.147_L0_Fab Light Chain

SEQ ID NO: 30510 - protein, 111 aa, Artificial Sequence; identical to SEQ ID NO: 17591
  Description of Artificial Sequence: Synthetic polypeptide
  VL of XENP021071

SEQ ID NO: 30511 - protein, 15 aa, Artificial Sequence
  Description of Artificial Sequence: Synthetic peptide
  XENP021071 vlCDR1
KASQSVDYDGDSYMN

SEQ ID NO: 30512 - protein, 7 aa, Artificial Sequence
  Description of Artificial Sequence: Synthetic peptide
  XENP021071 vlCDR2
AASNLES

SEQ ID NO: 30513 - protein, 9 aa, Artificial Sequence
  Description of Artificial Sequence: Synthetic peptide
  XENP021071 vlCDR3
QQSNEDPFT

SEQ ID NO: 30514 - protein, 226 aa, Artificial Sequence
  Description of Artificial Sequence: Synthetic polypeptide
  XENP021072 7G8_H0.148_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDYYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30515 - protein, 121 aa, Artificial Sequence; identical to SEQ ID NO: 19686
  Description of Artificial Sequence: Synthetic polypeptide
  VH of XENP021072

SEQ ID NO: 30516 - protein, 5 aa, Artificial Sequence
  Description of Artificial Sequence: Synthetic peptide
  XENP021072 vhCDR1
DAWMD

SEQ ID NO: 30517 - protein, 19 aa, Artificial Sequence
  Description of Artificial Sequence: Synthetic peptide
  XENP021072 vhCDR2
EIRTKANNHATYYAESVKG

SEQ ID NO: 30518 - protein, 10 aa, Artificial Sequence
  Description of Artificial Sequence: Synthetic peptide
  XENP021072 vhCDR3
LANWDYYFDV

SEQ ID NO: 30519 - protein, 218 aa, Artificial Sequence; identical to SEQ ID NO: 17590
  Description of Artificial Sequence: Synthetic polypeptide
  XENP021072 7G8_H0.148_L0_Fab Light Chain

SEQ ID NO: 30520 - protein, 111 aa, Artificial Sequence; identical to SEQ ID NO: 17591
  Description of Artificial Sequence: Synthetic polypeptide
  VL of XENP021072

SEQ ID NO: 30521 - protein, 15 aa, Artificial Sequence
  Description of Artificial Sequence: Synthetic peptide
  XENP021072 vlCDR1
KASQSVDYDGDSYMN

SEQ ID NO: 30522 - protein, 7 aa, Artificial Sequence
  Description of Artificial Sequence: Synthetic peptide
  XENP021072 vlCDR2
AASNLES

SEQ ID NO: 30523 - protein, 9 aa, Artificial Sequence
  Description of Artificial Sequence: Synthetic peptide
  XENP021072 vlCDR3
QQSNEDPFT

SEQ ID NO: 30524 - protein, 226 aa, Artificial Sequence; identical to SEQ ID NO: 29134
  Description of Artificial Sequence: Synthetic polypeptide
  XENP021074 7G8_H0_L0.1_Fab Heavy Chain

SEQ ID NO: 30525 - protein, 121 aa, Artificial Sequence; identical to SEQ ID NO: 17586
  Description of Artificial Sequence: Synthetic polypeptide
  VH of XENP021074

SEQ ID NO: 30526 - protein, 5 aa, Artificial Sequence
  Description of Artificial Sequence: Synthetic peptide
  XENP021074 vhCDR1
DAWMD

SEQ ID NO: 30527 - protein, 19 aa, Artificial Sequence
  Description of Artificial Sequence: Synthetic peptide
  XENP021074 vhCDR2
EIRTKANNHATYYAESVKG

SEQ ID NO: 30528 - protein, 10 aa, Artificial Sequence
  Description of Artificial Sequence: Synthetic peptide
  XENP021074 vhCDR3
LANWDWYFDV

SEQ ID NO: 30529 - protein, 218 aa, Artificial Sequence; identical to SEQ ID NO: 19700
  Description of Artificial Sequence: Synthetic polypeptide
  XENP021074 7G8_H0_L0.1_Fab Light Chain

SEQ ID NO: 30530 - protein, 111 aa, Artificial Sequence; identical to SEQ ID NO: 19701
  Description of Artificial Sequence: Synthetic polypeptide
  VL of XENP021074

SEQ ID NO: 30531 - protein, 15 aa, Artificial Sequence
  Description of Artificial Sequence: Synthetic peptide
  XENP021074 vlCDR1
KASQSVNYDGDSYMN

SEQ ID NO: 30532 - protein, 7 aa, Artificial Sequence
  Description of Artificial Sequence: Synthetic peptide
  XENP021074 vlCDR2
AASNLES

SEQ ID NO: 30533 - protein, 9 aa, Artificial Sequence
  Description of Artificial Sequence: Synthetic peptide
  XENP021074 vlCDR3
QQSNEDPFT

SEQ ID NO: 30534 - protein, 226 aa, Artificial Sequence; identical to SEQ ID NO: 29134
  Description of Artificial Sequence: Synthetic polypeptide
  XENP021075 7G8_H0_L0.2_Fab Heavy Chain

SEQ ID NO: 30535 - protein, 121 aa, Artificial Sequence; identical to SEQ ID NO: 17586
  Description of Artificial Sequence: Synthetic polypeptide
  VH of XENP021075

SEQ ID NO: 30536 - protein, 5 aa, Artificial Sequence
  Description of Artificial Sequence: Synthetic peptide
  XENP021075 vhCDR1
DAWMD

SEQ ID NO: 30537 - protein, 19 aa, Artificial Sequence
  Description of Artificial Sequence: Synthetic peptide
  XENP021075 vhCDR2
EIRTKANNHATYYAESVKG

SEQ ID NO: 30538 - protein, 10 aa, Artificial Sequence
  Description of Artificial Sequence: Synthetic peptide
  XENP021075 vhCDR3
LANWDWYFDV

SEQ ID NO: 30539 - protein, 218 aa, Artificial Sequence; identical to SEQ ID NO: 19710
  Description of Artificial Sequence: Synthetic polypeptide
  XENP021075 7G8_H0_L0.2_Fab Light Chain

SEQ ID NO: 30540 - protein, 111 aa, Artificial Sequence; identical to SEQ ID NO: 19711
  Description of Artificial Sequence: Synthetic polypeptide
  VL of XENP021075

SEQ ID NO: 30541 - protein, 15 aa, Artificial Sequence
  Description of Artificial Sequence: Synthetic peptide
  XENP021075 vlCDR1
KASQSVEYDGDSYMN

SEQ ID NO: 30542 - protein, 7 aa, Artificial Sequence
  Description of Artificial Sequence: Synthetic peptide
  XENP021075 vlCDR2
AASNLES

SEQ ID NO: 30543 - protein, 9 aa, Artificial Sequence
  Description of Artificial Sequence: Synthetic peptide
  XENP021075 vlCDR3
QQSNEDPFT

SEQ ID NO: 30544 - protein, 226 aa, Artificial Sequence; identical to SEQ ID NO: 29134
  Description of Artificial Sequence: Synthetic polypeptide
  XENP021076 7G8_H0_L0.3_Fab Heavy Chain

SEQ ID NO: 30545 - protein, 121 aa, Artificial Sequence; identical to SEQ ID NO: 17586
  Description of Artificial Sequence: Synthetic polypeptide
  VH of XENP021076

SEQ ID NO: 30546 - protein, 5 aa, Artificial Sequence
  Description of Artificial Sequence: Synthetic peptide
  XENP021076 vhCDR1
DAWMD

SEQ ID NO: 30547 - protein, 19 aa, Artificial Sequence
  Description of Artificial Sequence: Synthetic peptide
  XENP021076 vhCDR2
EIRTKANNHATYYAESVKG

SEQ ID NO: 30548 - protein, 10 aa, Artificial Sequence
  Description of Artificial Sequence: Synthetic peptide
  XENP021076 vhCDR3
LANWDWYFDV

SEQ ID NO: 30549 - protein, 218 aa, Artificial Sequence; identical to SEQ ID NO: 19720
  Description of Artificial Sequence: Synthetic polypeptide
  XENP021076 7G8_H0_L0.3_Fab Light Chain

SEQ ID NO: 30550 - protein, 111 aa, Artificial Sequence; identical to SEQ ID NO: 19721
  Description of Artificial Sequence: Synthetic polypeptide
  VL of XENP021076

SEQ ID NO: 30551 - protein, 15 aa, Artificial Sequence
  Description of Artificial Sequence: Synthetic peptide
  XENP021076 vlCDR1
KASQSVHYDGDSYMN

SEQ ID NO: 30552 - protein, 7 aa, Artificial Sequence
  Description of Artificial Sequence: Synthetic peptide
  XENP021076 vlCDR2
AASNLES

SEQ ID NO: 30553 - protein, 9 aa, Artificial Sequence
  Description of Artificial Sequence: Synthetic peptide
  XENP021076 vlCDR3
QQSNEDPFT

SEQ ID NO: 30554 - protein, 226 aa, Artificial Sequence; identical to SEQ ID NO: 29134
  Description of Artificial Sequence: Synthetic polypeptide
  XENP021077 7G8_H0_L0.4_Fab Heavy Chain

SEQ ID NO: 30555 - protein, 121 aa, Artificial Sequence; identical to SEQ ID NO: 17586
  Description of Artificial Sequence: Synthetic polypeptide
  VH of XENP021077

SEQ ID NO: 30556 - protein, 5 aa, Artificial Sequence
  Description of Artificial Sequence: Synthetic peptide
  XENP021077 vhCDR1
DAWMD

SEQ ID NO: 30557 - protein, 19 aa, Artificial Sequence
  Description of Artificial Sequence: Synthetic peptide
  XENP021077 vhCDR2
EIRTKANNHATYYAESVKG

SEQ ID NO: 30558 - protein, 10 aa, Artificial Sequence
  Description of Artificial Sequence: Synthetic peptide
  XENP021077 vhCDR3
LANWDWYFDV

SEQ ID NO: 30559 - protein, 218 aa, Artificial Sequence; identical to SEQ ID NO: 19730
  Description of Artificial Sequence: Synthetic polypeptide
  XENP021077 7G8_H0_L0.4_Fab Light Chain

SEQ ID NO: 30560 - protein, 111 aa, Artificial Sequence; identical to SEQ ID NO: 19731
  Description of Artificial Sequence: Synthetic polypeptide
  VL of XENP021077

SEQ ID NO: 30561 - protein, 15 aa, Artificial Sequence
  Description of Artificial Sequence: Synthetic peptide
  XENP021077 vlCDR1
KASQSVSYDGDSYMN

SEQ ID NO: 30562 - protein, 7 aa, Artificial Sequence
  Description of Artificial Sequence: Synthetic peptide
  XENP021077 vlCDR2
AASNLES

SEQ ID NO: 30563 - protein, 9 aa, Artificial Sequence
  Description of Artificial Sequence: Synthetic peptide
  XENP021077 vlCDR3
QQSNEDPFT

SEQ ID NO: 30564 - protein, 226 aa, Artificial Sequence; identical to SEQ ID NO: 29134
  Description of Artificial Sequence: Synthetic polypeptide
  XENP021078 7G8_H0_L0.5_Fab Heavy Chain

SEQ ID NO: 30565 - protein, 121 aa, Artificial Sequence; identical to SEQ ID NO: 17586
  Description of Artificial Sequence: Synthetic polypeptide
  VH of XENP021078

SEQ ID NO: 30566 - protein, 5 aa, Artificial Sequence
  Description of Artificial Sequence: Synthetic peptide
  XENP021078 vhCDR1
DAWMD

SEQ ID NO: 30567 - protein, 19 aa, Artificial Sequence
  Description of Artificial Sequence: Synthetic peptide
  XENP021078 vhCDR2
EIRTKANNHATYYAESVKG

SEQ ID NO: 30568 - protein, 10 aa, Artificial Sequence
  Description of Artificial Sequence: Synthetic peptide
  XENP021078 vhCDR3
LANWDWYFDV

SEQ ID NO: 30569 - protein, 218 aa, Artificial Sequence; identical to SEQ ID NO: 19740
  Description of Artificial Sequence: Synthetic polypeptide
  XENP021078 7G8_H0_L0.5_Fab Light Chain

SEQ ID NO: 30570 - protein, 111 aa, Artificial Sequence; identical to SEQ ID NO: 19741
  Description of Artificial Sequence: Synthetic polypeptide
  VL of XENP021078

SEQ ID NO: 30571 - protein, 15 aa, Artificial Sequence
  Description of Artificial Sequence: Synthetic peptide
  XENP021078 vlCDR1
KASQSVRYDGDSYMN

SEQ ID NO: 30572 - protein, 7 aa, Artificial Sequence
  Description of Artificial Sequence: Synthetic peptide
  XENP021078 vlCDR2
AASNLES

SEQ ID NO: 30573 - protein, 9 aa, Artificial Sequence
  Description of Artificial Sequence: Synthetic peptide
  XENP021078 vlCDR3
QQSNEDPFT

SEQ ID NO: 30574 - protein, 226 aa, Artificial Sequence; identical to SEQ ID NO: 29134
  Description of Artificial Sequence: Synthetic polypeptide
  XENP021079 7G8_H0_L0.6_Fab Heavy Chain

SEQ ID NO: 30575 - protein, 121 aa, Artificial Sequence; identical to SEQ ID NO: 17586
  Description of Artificial Sequence: Synthetic polypeptide
  VH of XENP021079

SEQ ID NO: 30576 - protein, 5 aa, Artificial Sequence
  Description of Artificial Sequence: Synthetic peptide
  XENP021079 vhCDR1
DAWMD

SEQ ID NO: 30577 - protein, 19 aa, Artificial Sequence
  Description of Artificial Sequence: Synthetic peptide
  XENP021079 vhCDR2
EIRTKANNHATYYAESVKG

SEQ ID NO: 30578 - protein, 10 aa, Artificial Sequence
  Description of Artificial Sequence: Synthetic peptide
  XENP021079 vhCDR3
LANWDWYFDV

SEQ ID NO: 30579 - protein, 218 aa, Artificial Sequence; identical to SEQ ID NO: 19750
  Description of Artificial Sequence: Synthetic polypeptide
  XENP021079 7G8_H0_L0.6_Fab Light Chain

SEQ ID NO: 30580 - protein, 111 aa, Artificial Sequence; identical to SEQ ID NO: 19751
  Description of Artificial Sequence: Synthetic polypeptide
  VL of XENP021079

SEQ ID NO: 30581 - protein, 15 aa, Artificial Sequence
  Description of Artificial Sequence: Synthetic peptide
  XENP021079 vlCDR1
KASQSVLYDGDSYMN

SEQ ID NO: 30582 - protein, 7 aa, Artificial Sequence
  Description of Artificial Sequence: Synthetic peptide
  XENP021079 vlCDR2
AASNLES

SEQ ID NO: 30583 - protein, 9 aa, Artificial Sequence
  Description of Artificial Sequence: Synthetic peptide
  XENP021079 vlCDR3
QQSNEDPFT

SEQ ID NO: 30584 - protein, 226 aa, Artificial Sequence; identical to SEQ ID NO: 29134
  Description of Artificial Sequence: Synthetic polypeptide
  XENP021080 7G8_H0_L0.7_Fab Heavy Chain

SEQ ID NO: 30585 - protein, 121 aa, Artificial Sequence; identical to SEQ ID NO: 17586
  Description of Artificial Sequence: Synthetic polypeptide
  VH of XENP021080

SEQ ID NO: 30586 - protein, 5 aa, Artificial Sequence
  Description of Artificial Sequence: Synthetic peptide
  XENP021080 vhCDR1
DAWMD

SEQ ID NO: 30587 - protein, 19 aa, Artificial Sequence
  Description of Artificial Sequence: Synthetic peptide
  XENP021080 vhCDR2
EIRTKANNHATYYAESVKG

SEQ ID NO: 30588 - protein, 10 aa, Artificial Sequence
  Description of Artificial Sequence: Synthetic peptide
  XENP021080 vhCDR3
LANWDWYFDV

SEQ ID NO: 30589 - protein, 218 aa, Artificial Sequence; identical to SEQ ID NO: 19760
  Description of Artificial Sequence: Synthetic polypeptide
  XENP021080 7G8_H0_L0.7_Fab Light Chain

SEQ ID NO: 30590 - protein, 111 aa, Artificial Sequence; identical to SEQ ID NO: 19761
  Description of Artificial Sequence: Synthetic polypeptide
  VL of XENP021080

SEQ ID NO: 30591 - protein, 15 aa, Artificial Sequence
  Description of Artificial Sequence: Synthetic peptide
  XENP021080 vlCDR1
KASQSVTYDGDSYMN

SEQ ID NO: 30592 - protein, 7 aa, Artificial Sequence
  Description of Artificial Sequence: Synthetic peptide
  XENP021080 vlCDR2
AASNLES

SEQ ID NO: 30593 - protein, 9 aa, Artificial Sequence
  Description of Artificial Sequence: Synthetic peptide
  XENP021080 vlCDR3
QQSNEDPFT

SEQ ID NO: 30594 - protein, 226 aa, Artificial Sequence; identical to SEQ ID NO: 29134
  Description of Artificial Sequence: Synthetic polypeptide
  XENP021081 7G8_H0_L0.8_Fab Heavy Chain

SEQ ID NO: 30595 - protein, 121 aa, Artificial Sequence; identical to SEQ ID NO: 17586
  Description of Artificial Sequence: Synthetic polypeptide
  VH of XENP021081

SEQ ID NO: 30596 - protein, 5 aa, Artificial Sequence
  Description of Artificial Sequence: Synthetic peptide
  XENP021081 vhCDR1
DAWMD

SEQ ID NO: 30597 - protein, 19 aa, Artificial Sequence
  Description of Artificial Sequence: Synthetic peptide
  XENP021081 vhCDR2
EIRTKANNHATYYAESVKG

SEQ ID NO: 30598 - protein, 10 aa, Artificial Sequence
  Description of Artificial Sequence: Synthetic peptide
  XENP021081 vhCDR3
LANWDWYFDV

SEQ ID NO: 30599 - protein, 218 aa, Artificial Sequence; identical to SEQ ID NO: 19770
  Description of Artificial Sequence: Synthetic polypeptide
  XENP021081 7G8_H0_L0.8_Fab Light Chain

SEQ ID NO: 30600 - protein, 111 aa, Artificial Sequence; identical to SEQ ID NO: 19771
  Description of Artificial Sequence: Synthetic polypeptide
  VL of XENP021081

SEQ ID NO: 30601 - protein, 15 aa, Artificial Sequence
  Description of Artificial Sequence: Synthetic peptide
  XENP021081 vlCDR1
KASQSVGYDGDSYMN

SEQ ID NO: 30602 - protein, 7 aa, Artificial Sequence
  Description of Artificial Sequence: Synthetic peptide
  XENP021081 vlCDR2
AASNLES

SEQ ID NO: 30603 - protein, 9 aa, Artificial Sequence
  Description of Artificial Sequence: Synthetic peptide
  XENP021081 vlCDR3
QQSNEDPFT

SEQ ID NO: 30604 - protein, 226 aa, Artificial Sequence; identical to SEQ ID NO: 29134
  Description of Artificial Sequence: Synthetic polypeptide
  XENP021082 7G8_H0_L0.9_Fab Heavy Chain

SEQ ID NO: 30605 - protein, 121 aa, Artificial Sequence; identical to SEQ ID NO: 17586
  Description of Artificial Sequence: Synthetic polypeptide
  VH of XENP021082

SEQ ID NO: 30606 - protein, 5 aa, Artificial Sequence
  Description of Artificial Sequence: Synthetic peptide
  XENP021082 vhCDR1
DAWMD

SEQ ID NO: 30607 - protein, 19 aa, Artificial Sequence
  Description of Artificial Sequence: Synthetic peptide
  XENP021082 vhCDR2
EIRTKANNHATYYAESVKG

SEQ ID NO: 30608 - protein, 10 aa, Artificial Sequence
  Description of Artificial Sequence: Synthetic peptide
  XENP021082 vhCDR3
LANWDWYFDV

SEQ ID NO: 30609 - protein, 218 aa, Artificial Sequence; identical to SEQ ID NO: 19780
  Description of Artificial Sequence: Synthetic polypeptide
  XENP021082 7G8_H0_L0.9_Fab Light Chain

SEQ ID NO: 30610 - protein, 111 aa, Artificial Sequence; identical to SEQ ID NO: 19781
  Description of Artificial Sequence: Synthetic polypeptide
  VL of XENP021082

SEQ ID NO: 30611 - protein, 15 aa, Artificial Sequence
  Description of Artificial Sequence: Synthetic peptide
  XENP021082 vlCDR1
KASQSVYYDGDSYMN

SEQ ID NO: 30612 - protein, 7 aa, Artificial Sequence
  Description of Artificial Sequence: Synthetic peptide
  XENP021082 vlCDR2
AASNLES

SEQ ID NO: 30613 - protein, 9 aa, Artificial Sequence
  Description of Artificial Sequence: Synthetic peptide
  XENP021082 vlCDR3
QQSNEDPFT

SEQ ID NO: 30614 - protein, 226 aa, Artificial Sequence; identical to SEQ ID NO: 29134
  Description of Artificial Sequence: Synthetic polypeptide
  XENP021083 7G8_H0_L0.10_Fab Heavy Chain

SEQ ID NO: 30615 - protein, 121 aa, Artificial Sequence; identical to SEQ ID NO: 17586
  Description of Artificial Sequence: Synthetic polypeptide
  VH of XENP021083

SEQ ID NO: 30616 - protein, 5 aa, Artificial Sequence
  Description of Artificial Sequence: Synthetic peptide
  XENP021083 vhCDR1
DAWMD

SEQ ID NO: 30617 - protein, 19 aa, Artificial Sequence
  Description of Artificial Sequence: Synthetic peptide
  XENP021083 vhCDR2
EIRTKANNHATYYAESVKG

SEQ ID NO: 30618 - protein, 10 aa, Artificial Sequence
  Description of Artificial Sequence: Synthetic peptide
  XENP021083 vhCDR3
LANWDWYFDV

SEQ ID NO: 30619 - protein, 218 aa, Artificial Sequence; identical to SEQ ID NO: 19790
  Description of Artificial Sequence: Synthetic polypeptide
  XENP021083 7G8_H0_L0.10_Fab Light Chain

SEQ ID NO: 30620 - protein, 111 aa, Artificial Sequence; identical to SEQ ID NO: 19791
  Description of Artificial Sequence: Synthetic polypeptide
  VL of XENP021083

SEQ ID NO: 30621 - protein, 15 aa, Artificial Sequence
  Description of Artificial Sequence: Synthetic peptide
  XENP021083 vlCDR1
KASQSVDFDGDSYMN

SEQ ID NO: 30622 - protein, 7 aa, Artificial Sequence
  Description of Artificial Sequence: Synthetic peptide
  XENP021083 vlCDR2
AASNLES

SEQ ID NO: 30623 - protein, 9 aa, Artificial Sequence
  Description of Artificial Sequence: Synthetic peptide
  XENP021083 vlCDR3
QQSNEDPFT

SEQ ID NO: 30624 - protein, 226 aa, Artificial Sequence; identical to SEQ ID NO: 29134
  Description of Artificial Sequence: Synthetic polypeptide
  XENP021084 7G8_H0_L0.11_Fab Heavy Chain

SEQ ID NO: 30625 - protein, 121 aa, Artificial Sequence; identical to SEQ ID NO: 17586
  Description of Artificial Sequence: Synthetic polypeptide
  VH of XENP021084

SEQ ID NO: 30626 - protein, 5 aa, Artificial Sequence
  Description of Artificial Sequence: Synthetic peptide
  XENP021084 vhCDR1
DAWMD

SEQ ID NO: 30627 - protein, 19 aa, Artificial Sequence
  Description of Artificial Sequence: Synthetic peptide
  XENP021084 vhCDR2
EIRTKANNHATYYAESVKG

SEQ ID NO: 30628 - protein, 10 aa, Artificial Sequence
  Description of Artificial Sequence: Synthetic peptide
  XENP021084 vhCDR3
LANWDWYFDV

SEQ ID NO: 30629 - protein, 218 aa, Artificial Sequence; identical to SEQ ID NO: 19800
  Description of Artificial Sequence: Synthetic polypeptide
  XENP021084 7G8_H0_L0.11_Fab Light Chain

SEQ ID NO: 30630 - protein, 111 aa, Artificial Sequence; identical to SEQ ID NO: 19801
  Description of Artificial Sequence: Synthetic polypeptide
  VL of XENP021084

SEQ ID NO: 30631 - protein, 15 aa, Artificial Sequence
  Description of Artificial Sequence: Synthetic peptide
  XENP021084 vlCDR1
KASQSVDHDGDSYMN

SEQ ID NO: 30632 - protein, 7 aa, Artificial Sequence
  Description of Artificial Sequence: Synthetic peptide
  XENP021084 vlCDR2
AASNLES

SEQ ID NO: 30633 - protein, 9 aa, Artificial Sequence
  Description of Artificial Sequence: Synthetic peptide
  XENP021084 vlCDR3
QQSNEDPFT

SEQ ID NO: 30634 - protein, 226 aa, Artificial Sequence; identical to SEQ ID NO: 29134
  Description of Artificial Sequence: Synthetic polypeptide
  XENP021085 7G8_H0_L0.12_Fab Heavy Chain

SEQ ID NO: 30635 - protein, 121 aa, Artificial Sequence; identical to SEQ ID NO: 17586
  Description of Artificial Sequence: Synthetic polypeptide
  VH of XENP021085

SEQ ID NO: 30636 - protein, 5 aa, Artificial Sequence
  Description of Artificial Sequence: Synthetic peptide
  XENP021085 vhCDR1
DAWMD

SEQ ID NO: 30637 - protein, 19 aa, Artificial Sequence
  Description of Artificial Sequence: Synthetic peptide
  XENP021085 vhCDR2
EIRTKANNHATYYAESVKG

SEQ ID NO: 30638 - protein, 10 aa, Artificial Sequence
  Description of Artificial Sequence: Synthetic peptide
  XENP021085 vhCDR3
LANWDWYFDV

SEQ ID NO: 30639 - protein, 218 aa, Artificial Sequence; identical to SEQ ID NO: 19810
  Description of Artificial Sequence: Synthetic polypeptide
  XENP021085 7G8_H0_L0.12_Fab Light Chain

SEQ ID NO: 30640 - protein, 111 aa, Artificial Sequence; identical to SEQ ID NO: 19811
  Description of Artificial Sequence: Synthetic polypeptide
  VL of XENP021085

SEQ ID NO: 30641 - protein, 15 aa, Artificial Sequence
  Description of Artificial Sequence: Synthetic peptide
  XENP021085 vlCDR1
KASQSVDLDGDSYMN

SEQ ID NO: 30642 - protein, 7 aa, Artificial Sequence
  Description of Artificial Sequence: Synthetic peptide
  XENP021085 vlCDR2
AASNLES

SEQ ID NO: 30643 - protein, 9 aa, Artificial Sequence
  Description of Artificial Sequence: Synthetic peptide
  XENP021085 vlCDR3
QQSNEDPFT

SEQ ID NO: 30644 - protein, 226 aa, Artificial Sequence; identical to SEQ ID NO: 29134
  Description of Artificial Sequence: Synthetic polypeptide
  XENP021086 7G8_H0_L0.13_Fab Heavy Chain

SEQ ID NO: 30645 - protein, 121 aa, Artificial Sequence; identical to SEQ ID NO: 17586
  Description of Artificial Sequence: Synthetic polypeptide
  VH of XENP021086

SEQ ID NO: 30646 - protein, 5 aa, Artificial Sequence
  Description of Artificial Sequence: Synthetic peptide
  XENP021086 vhCDR1
DAWMD

SEQ ID NO: 30647 - protein, 19 aa, Artificial Sequence
  Description of Artificial Sequence: Synthetic peptide
  XENP021086 vhCDR2
EIRTKANNHATYYAESVKG

SEQ ID NO: 30648 - protein, 10 aa, Artificial Sequence
  Description of Artificial Sequence: Synthetic peptide
  XENP021086 vhCDR3
LANWDWYFDV

SEQ ID NO: 30649 - protein, 218 aa, Artificial Sequence; identical to SEQ ID NO: 19820
  Description of Artificial Sequence: Synthetic polypeptide
  XENP021086 7G8_H0_L0.13_Fab Light Chain

SEQ ID NO: 30650 - protein, 111 aa, Artificial Sequence; identical to SEQ ID NO: 19821
  Description of Artificial Sequence: Synthetic polypeptide
  VL of XENP021086

SEQ ID NO: 30651 - protein, 15 aa, Artificial Sequence
  Description of Artificial Sequence: Synthetic peptide
  XENP021086 vlCDR1
KASQSVDWDGDSYMN

SEQ ID NO: 30652 - protein, 7 aa, Artificial Sequence
  Description of Artificial Sequence: Synthetic peptide
  XENP021086 vlCDR2
AASNLES

SEQ ID NO: 30653 - protein, 9 aa, Artificial Sequence
  Description of Artificial Sequence: Synthetic peptide
  XENP021086 vlCDR3
QQSNEDPFT

SEQ ID NO: 30654 - protein, 226 aa, Artificial Sequence; identical to SEQ ID NO: 29134
  Description of Artificial Sequence: Synthetic polypeptide
  XENP021087 7G8_H0_L0.14_Fab Heavy Chain

SEQ ID NO: 30655 - protein, 121 aa, Artificial Sequence; identical to SEQ ID NO: 17586
  Description of Artificial Sequence: Synthetic polypeptide
  VH of XENP021087

SEQ ID NO: 30656 - protein, 5 aa, Artificial Sequence
  Description of Artificial Sequence: Synthetic peptide
  XENP021087 vhCDR1
DAWMD

SEQ ID NO: 30657 - protein, 19 aa, Artificial Sequence
  Description of Artificial Sequence: Synthetic peptide
  XENP021087 vhCDR2
EIRTKANNHATYYAESVKG

SEQ ID NO: 30658 - protein, 10 aa, Artificial Sequence
  Description of Artificial Sequence: Synthetic peptide
  XENP021087 vhCDR3
LANWDWYFDV

SEQ ID NO: 30659 - protein, 218 aa, Artificial Sequence; identical to SEQ ID NO: 19830
  Description of Artificial Sequence: Synthetic polypeptide
  XENP021087 7G8_H0_L0.14_Fab Light Chain

SEQ ID NO: 30660 - protein, 111 aa, Artificial Sequence; identical to SEQ ID NO: 19831
  Description of Artificial Sequence: Synthetic polypeptide
  VL of XENP021087

SEQ ID NO: 30661 - protein, 15 aa, Artificial Sequence
  Description of Artificial Sequence: Synthetic peptide
  XENP021087 vlCDR1
KASQSVDVDGDSYMN

SEQ ID NO: 30662 - protein, 7 aa, Artificial Sequence
  Description of Artificial Sequence: Synthetic peptide
  XENP021087 vlCDR2
AASNLES

SEQ ID NO: 30663 - protein, 9 aa, Artificial Sequence
  Description of Artificial Sequence: Synthetic peptide
  XENP021087 vlCDR3
QQSNEDPFT

SEQ ID NO: 30664 - protein, 226 aa, Artificial Sequence; identical to SEQ ID NO: 29134
  Description of Artificial Sequence: Synthetic polypeptide
  XENP021088 7G8_H0_L0.15_Fab Heavy Chain

SEQ ID NO: 30665 - protein, 121 aa, Artificial Sequence; identical to SEQ ID NO: 17586
  Description of Artificial Sequence: Synthetic polypeptide
  VH of XENP021088

SEQ ID NO: 30666 - protein, 5 aa, Artificial Sequence
  Description of Artificial Sequence: Synthetic peptide
  XENP021088 vhCDR1
DAWMD

SEQ ID NO: 30667 - protein, 19 aa, Artificial Sequence
  Description of Artificial Sequence: Synthetic peptide
  XENP021088 vhCDR2
EIRTKANNHATYYAESVKG

SEQ ID NO: 30668 - protein, 10 aa, Artificial Sequence
  Description of Artificial Sequence: Synthetic peptide
  XENP021088 vhCDR3
LANWDWYFDV

SEQ ID NO: 30669 - protein, 218 aa, Artificial Sequence; identical to SEQ ID NO: 19840
  Description of Artificial Sequence: Synthetic polypeptide
  XENP021088 7G8_H0_L0.15_Fab Light Chain

SEQ ID NO: 30670 - protein, 111 aa, Artificial Sequence; identical to SEQ ID NO: 19841
  Description of Artificial Sequence: Synthetic polypeptide
  VL of XENP021088

SEQ ID NO: 30671 - protein, 15 aa, Artificial Sequence
  Description of Artificial Sequence: Synthetic peptide
  XENP021088 vlCDR1
KASQSVDADGDSYMN

SEQ ID NO: 30672 - protein, 7 aa, Artificial Sequence
  Description of Artificial Sequence: Synthetic peptide
  XENP021088 vlCDR2
AASNLES

SEQ ID NO: 30673 - protein, 9 aa, Artificial Sequence
  Description of Artificial Sequence: Synthetic peptide
  XENP021088 vlCDR3
QQSNEDPFT

SEQ ID NO: 30674 - protein, 226 aa, Artificial Sequence; identical to SEQ ID NO: 29134
  Description of Artificial Sequence: Synthetic polypeptide
  XENP021089 7G8_H0_L0.16_Fab Heavy Chain

SEQ ID NO: 30675 - protein, 121 aa, Artificial Sequence; identical to SEQ ID NO: 17586
  Description of Artificial Sequence: Synthetic polypeptide
  VH of XENP021089

SEQ ID NO: 30676 - protein, 5 aa, Artificial Sequence
  Description of Artificial Sequence: Synthetic peptide
  XENP021089 vhCDR1
DAWMD

SEQ ID NO: 30677 - protein, 19 aa, Artificial Sequence
  Description of Artificial Sequence: Synthetic peptide
  XENP021089 vhCDR2
EIRTKANNHATYYAESVKG

SEQ ID NO: 30678 - protein, 10 aa, Artificial Sequence
  Description of Artificial Sequence: Synthetic peptide
  XENP021089 vhCDR3
LANWDWYFDV

SEQ ID NO: 30679 - protein, 218 aa, Artificial Sequence; identical to SEQ ID NO: 19850
  Description of Artificial Sequence: Synthetic polypeptide
  XENP021089 7G8_H0_L0.16_Fab Light Chain

SEQ ID NO: 30680 - protein, 111 aa, Artificial Sequence; identical to SEQ ID NO: 19851
  Description of Artificial Sequence: Synthetic polypeptide
  VL of XENP021089

SEQ ID NO: 30681 - protein, 15 aa, Artificial Sequence
  Description of Artificial Sequence: Synthetic peptide
  XENP021089 vlCDR1
KASQSVDQDGDSYMN

SEQ ID NO: 30682 - protein, 7 aa, Artificial Sequence
  Description of Artificial Sequence: Synthetic peptide
  XENP021089 vlCDR2
AASNLES

SEQ ID NO: 30683 - protein, 9 aa, Artificial Sequence
  Description of Artificial Sequence: Synthetic peptide
  XENP021089 vlCDR3
QQSNEDPFT

SEQ ID NO: 30684 - protein, 226 aa, Artificial Sequence; identical to SEQ ID NO: 29134
  Description of Artificial Sequence: Synthetic polypeptide
  XENP021090 7G8_H0_L0.17_Fab Heavy Chain

SEQ ID NO: 30685 - protein, 121 aa, Artificial Sequence; identical to SEQ ID NO: 17586
  Description of Artificial Sequence: Synthetic polypeptide
  VH of XENP021090

SEQ ID NO: 30686 - protein, 5 aa, Artificial Sequence
  Description of Artificial Sequence: Synthetic peptide
  XENP021090 vhCDR1
DAWMD

SEQ ID NO: 30687 - protein, 19 aa, Artificial Sequence
  Description of Artificial Sequence: Synthetic peptide
  XENP021090 vhCDR2
EIRTKANNHATYYAESVKG

SEQ ID NO: 30688 - protein, 10 aa, Artificial Sequence
  Description of Artificial Sequence: Synthetic peptide
  XENP021090 vhCDR3
LANWDWYFDV

SEQ ID NO: 30689 - protein, 218 aa, Artificial Sequence; identical to SEQ ID NO: 19860
  Description of Artificial Sequence: Synthetic polypeptide
  XENP021090 7G8_H0_L0.17_Fab Light Chain

SEQ ID NO: 30690 - protein, 111 aa, Artificial Sequence; identical to SEQ ID NO: 19861
  Description of Artificial Sequence: Synthetic polypeptide
  VL of XENP021090

SEQ ID NO: 30691 - protein, 15 aa, Artificial Sequence
  Description of Artificial Sequence: Synthetic peptide
  XENP021090 vlCDR1
KASQSVDDDGDSYMN

SEQ ID NO: 30692 - protein, 7 aa, Artificial Sequence
  Description of Artificial Sequence: Synthetic peptide
  XENP021090 vlCDR2
AASNLES

SEQ ID NO: 30693 - protein, 9 aa, Artificial Sequence
  Description of Artificial Sequence: Synthetic peptide
  XENP021090 vlCDR3
QQSNEDPFT

SEQ ID NO: 30694 - protein, 226 aa, Artificial Sequence; identical to SEQ ID NO: 29134
  Description of Artificial Sequence: Synthetic polypeptide
  XENP021091 7G8_H0_L0.18_Fab Heavy Chain

SEQ ID NO: 30695 - protein, 121 aa, Artificial Sequence; identical to SEQ ID NO: 17586
  Description of Artificial Sequence: Synthetic polypeptide
  VH of XENP021091

SEQ ID NO: 30696 - protein, 5 aa, Artificial Sequence
  Description of Artificial Sequence: Synthetic peptide
  XENP021091 vhCDR1
DAWMD

SEQ ID NO: 30697 - protein, 19 aa, Artificial Sequence
  Description of Artificial Sequence: Synthetic peptide
  XENP021091 vhCDR2
EIRTKANNHATYYAESVKG

SEQ ID NO: 30698 - protein, 10 aa, Artificial Sequence
  Description of Artificial Sequence: Synthetic peptide
  XENP021091 vhCDR3
LANWDWYFDV

SEQ ID NO: 30699 - protein, 218 aa, Artificial Sequence; identical to SEQ ID NO: 19870
  Description of Artificial Sequence: Synthetic polypeptide
  XENP021091 7G8_H0_L0.18_Fab Light Chain

SEQ ID NO: 30700 - protein, 111 aa, Artificial Sequence; identical to SEQ ID NO: 19871
  Description of Artificial Sequence: Synthetic polypeptide
  VL of XENP021091

SEQ ID NO: 30701 - protein, 15 aa, Artificial Sequence
  Description of Artificial Sequence: Synthetic peptide
  XENP021091 vlCDR1
KASQSVDKDGDSYMN

SEQ ID NO: 30702 - protein, 7 aa, Artificial Sequence
  Description of Artificial Sequence: Synthetic peptide
  XENP021091 vlCDR2
AASNLES

SEQ ID NO: 30703 - protein, 9 aa, Artificial Sequence
  Description of Artificial Sequence: Synthetic peptide
  XENP021091 vlCDR3
QQSNEDPFT

SEQ ID NO: 30704 - protein, 226 aa, Artificial Sequence; identical to SEQ ID NO: 29134
  Description of Artificial Sequence: Synthetic polypeptide
  XENP021092 7G8_H0_L0.19_Fab Heavy Chain

SEQ ID NO: 30705 - protein, 121 aa, Artificial Sequence; identical to SEQ ID NO: 17586
  Description of Artificial Sequence: Synthetic polypeptide
  VH of XENP021092

SEQ ID NO: 30706 - protein, 5 aa, Artificial Sequence
  Description of Artificial Sequence: Synthetic peptide
  XENP021092 vhCDR1
DAWMD

SEQ ID NO: 30707 - protein, 19 aa, Artificial Sequence
  Description of Artificial Sequence: Synthetic peptide
  XENP021092 vhCDR2
EIRTKANNHATYYAESVKG

SEQ ID NO: 30708 - protein, 10 aa, Artificial Sequence
  Description of Artificial Sequence: Synthetic peptide
  XENP021092 vhCDR3
LANWDWYFDV

SEQ ID NO: 30709 - protein, 218 aa, Artificial Sequence; identical to SEQ ID NO: 19880
  Description of Artificial Sequence: Synthetic polypeptide
  XENP021092 7G8_H0_L0.19_Fab Light Chain

SEQ ID NO: 30710 - protein, 111 aa, Artificial Sequence; identical to SEQ ID NO: 19881
  Description of Artificial Sequence: Synthetic polypeptide
  VL of XENP021092

SEQ ID NO: 30711 - protein, 15 aa, Artificial Sequence
  Description of Artificial Sequence: Synthetic peptide
  XENP021092 vlCDR1
KASQSVDNDGDSYMN

SEQ ID NO: 30712 - protein, 7 aa, Artificial Sequence
  Description of Artificial Sequence: Synthetic peptide
  XENP021092 vlCDR2
AASNLES

SEQ ID NO: 30713 - protein, 9 aa, Artificial Sequence
  Description of Artificial Sequence: Synthetic peptide
  XENP021092 vlCDR3
QQSNEDPFT

SEQ ID NO: 30714 - protein, 226 aa, Artificial Sequence; identical to SEQ ID NO: 29134
  Description of Artificial Sequence: Synthetic polypeptide
  XENP021093 7G8_H0_L0.20_Fab Heavy Chain

SEQ ID NO: 30715 - protein, 121 aa, Artificial Sequence; identical to SEQ ID NO: 17586
  Description of Artificial Sequence: Synthetic polypeptide
  VH of XENP021093

SEQ ID NO: 30716 - protein, 5 aa, Artificial Sequence
  Description of Artificial Sequence: Synthetic peptide
  XENP021093 vhCDR1
DAWMD

SEQ ID NO: 30717 - protein, 19 aa, Artificial Sequence
  Description of Artificial Sequence: Synthetic peptide
  XENP021093 vhCDR2
EIRTKANNHATYYAESVKG

SEQ ID NO: 30718 - protein, 10 aa, Artificial Sequence
  Description of Artificial Sequence: Synthetic peptide
  XENP021093 vhCDR3
LANWDWYFDV

SEQ ID NO: 30719 - protein, 218 aa, Artificial Sequence; identical to SEQ ID NO: 19890
  Description of Artificial Sequence: Synthetic polypeptide
  XENP021093 7G8_H0_L0.20_Fab Light Chain

SEQ ID NO: 30720 - protein, 111 aa, Artificial Sequence; identical to SEQ ID NO: 19891
  Description of Artificial Sequence: Synthetic polypeptide
  VL of XENP021093

SEQ ID NO: 30721 - protein, 15 aa, Artificial Sequence
  Description of Artificial Sequence: Synthetic peptide
  XENP021093 vlCDR1
KASQSVDYNGDSYMN

SEQ ID NO: 30722 - protein, 7 aa, Artificial Sequence
  Description of Artificial Sequence: Synthetic peptide
  XENP021093 vlCDR2
AASNLES

SEQ ID NO: 30723 - protein, 9 aa, Artificial Sequence
  Description of Artificial Sequence: Synthetic peptide
  XENP021093 vlCDR3
QQSNEDPFT

SEQ ID NO: 30724 - protein, 226 aa, Artificial Sequence; identical to SEQ ID NO: 29134
  Description of Artificial Sequence: Synthetic polypeptide
  XENP021094 7G8_H0_L0.21_Fab Heavy Chain

SEQ ID NO: 30725 - protein, 121 aa, Artificial Sequence; identical to SEQ ID NO: 17586
  Description of Artificial Sequence: Synthetic polypeptide
  VH of XENP021094

SEQ ID NO: 30726 - protein, 5 aa, Artificial Sequence
  Description of Artificial Sequence: Synthetic peptide
  XENP021094 vhCDR1
DAWMD

SEQ ID NO: 30727 - protein, 19 aa, Artificial Sequence
  Description of Artificial Sequence: Synthetic peptide
  XENP021094 vhCDR2
EIRTKANNHATYYAESVKG

SEQ ID NO: 30728 - protein, 10 aa, Artificial Sequence
  Description of Artificial Sequence: Synthetic peptide
  XENP021094 vhCDR3
LANWDWYFDV

SEQ ID NO: 30729 - protein, 218 aa, Artificial Sequence; identical to SEQ ID NO: 19900
  Description of Artificial Sequence: Synthetic polypeptide
  XENP021094 7G8_H0_L0.21_Fab Light Chain

SEQ ID NO: 30730 - protein, 111 aa, Artificial Sequence; identical to SEQ ID NO: 19901
  Description of Artificial Sequence: Synthetic polypeptide
  VL of XENP021094

SEQ ID NO: 30731 - protein, 15 aa, Artificial Sequence
  Description of Artificial Sequence: Synthetic peptide
  XENP021094 vlCDR1
KASQSVDYEGDSYMN

SEQ ID NO: 30732 - protein, 7 aa, Artificial Sequence
  Description of Artificial Sequence: Synthetic peptide
  XENP021094 vlCDR2
AASNLES

SEQ ID NO: 30733 - protein, 9 aa, Artificial Sequence
  Description of Artificial Sequence: Synthetic peptide
  XENP021094 vlCDR3
QQSNEDPFT

SEQ ID NO: 30734 - protein, 226 aa, Artificial Sequence; identical to SEQ ID NO: 29134
  Description of Artificial Sequence: Synthetic polypeptide
  XENP021095 7G8_H0_L0.22_Fab Heavy Chain

SEQ ID NO: 30735 - protein, 121 aa, Artificial Sequence; identical to SEQ ID NO: 17586
  Description of Artificial Sequence: Synthetic polypeptide
  VH of XENP021095

SEQ ID NO: 30736 - protein, 5 aa, Artificial Sequence
  Description of Artificial Sequence: Synthetic peptide
  XENP021095 vhCDR1
DAWMD

SEQ ID NO: 30737 - protein, 19 aa, Artificial Sequence
  Description of Artificial Sequence: Synthetic peptide
  XENP021095 vhCDR2
EIRTKANNHATYYAESVKG

SEQ ID NO: 30738 - protein, 10 aa, Artificial Sequence
  Description of Artificial Sequence: Synthetic peptide
  XENP021095 vhCDR3
LANWDWYFDV

SEQ ID NO: 30739 - protein, 218 aa, Artificial Sequence; identical to SEQ ID NO: 19910
  Description of Artificial Sequence: Synthetic polypeptide
  XENP021095 7G8_H0_L0.22_Fab Light Chain

SEQ ID NO: 30740 - protein, 111 aa, Artificial Sequence; identical to SEQ ID NO: 19911
  Description of Artificial Sequence: Synthetic polypeptide
  VL of XENP021095

SEQ ID NO: 30741 - protein, 15 aa, Artificial Sequence
  Description of Artificial Sequence: Synthetic peptide
  XENP021095 vlCDR1
KASQSVDYHGDSYMN

SEQ ID NO: 30742 - protein, 7 aa, Artificial Sequence
  Description of Artificial Sequence: Synthetic peptide
  XENP021095 vlCDR2
AASNLES

SEQ ID NO: 30743 - protein, 9 aa, Artificial Sequence
  Description of Artificial Sequence: Synthetic peptide
  XENP021095 vlCDR3
QQSNEDPFT

SEQ ID NO: 30744 - protein, 226 aa, Artificial Sequence; identical to SEQ ID NO: 29134
  Description of Artificial Sequence: Synthetic polypeptide
  XENP021096 7G8_H0_L0.23_Fab Heavy Chain

SEQ ID NO: 30745 - protein, 121 aa, Artificial Sequence; identical to SEQ ID NO: 17586
  Description of Artificial Sequence: Synthetic polypeptide
  VH of XENP021096

SEQ ID NO: 30746 - protein, 5 aa, Artificial Sequence
  Description of Artificial Sequence: Synthetic peptide
  XENP021096 vhCDR1
DAWMD

SEQ ID NO: 30747 - protein, 19 aa, Artificial Sequence
  Description of Artificial Sequence: Synthetic peptide
  XENP021096 vhCDR2
EIRTKANNHATYYAESVKG

SEQ ID NO: 30748 - protein, 10 aa, Artificial Sequence
  Description of Artificial Sequence: Synthetic peptide
  XENP021096 vhCDR3
LANWDWYFDV

SEQ ID NO: 30749 - protein, 218 aa, Artificial Sequence; identical to SEQ ID NO: 19920
  Description of Artificial Sequence: Synthetic polypeptide
  XENP021096 7G8_H0_L0.23_Fab Light Chain

SEQ ID NO: 30750 - protein, 111 aa, Artificial Sequence; identical to SEQ ID NO: 19921
  Description of Artificial Sequence: Synthetic polypeptide
  VL of XENP021096

SEQ ID NO: 30751 - protein, 15 aa, Artificial Sequence
  Description of Artificial Sequence: Synthetic peptide
  XENP021096 vlCDR1
KASQSVDYSGDSYMN

SEQ ID NO: 30752 - protein, 7 aa, Artificial Sequence
  Description of Artificial Sequence: Synthetic peptide
  XENP021096 vlCDR2
AASNLES

SEQ ID NO: 30753 - protein, 9 aa, Artificial Sequence
  Description of Artificial Sequence: Synthetic peptide
  XENP021096 vlCDR3
QQSNEDPFT

SEQ ID NO: 30754 - protein, 226 aa, Artificial Sequence; identical to SEQ ID NO: 29134
  Description of Artificial Sequence: Synthetic polypeptide
  XENP021101 7G8_H0_L0.24_Fab Heavy Chain

SEQ ID NO: 30755 - protein, 121 aa, Artificial Sequence; identical to SEQ ID NO: 17586
  Description of Artificial Sequence: Synthetic polypeptide
  VH of XENP021101

SEQ ID NO: 30756 - protein, 5 aa, Artificial Sequence
  Description of Artificial Sequence: Synthetic peptide
  XENP021101 vhCDR1
DAWMD

SEQ ID NO: 30757 - protein, 19 aa, Artificial Sequence
  Description of Artificial Sequence: Synthetic peptide
  XENP021101 vhCDR2
EIRTKANNHATYYAESVKG

SEQ ID NO: 30758 - protein, 10 aa, Artificial Sequence
  Description of Artificial Sequence: Synthetic peptide
  XENP021101 vhCDR3
LANWDWYFDV

SEQ ID NO: 30759 - protein, 218 aa, Artificial Sequence; identical to SEQ ID NO: 19930
  Description of Artificial Sequence: Synthetic polypeptide
  XENP021101 7G8_H0_L0.24_Fab Light Chain

SEQ ID NO: 30760 - protein, 111 aa, Artificial Sequence; identical to SEQ ID NO: 19931
  Description of Artificial Sequence: Synthetic polypeptide
  VL of XENP021101

SEQ ID NO: 30761 - protein, 15 aa, Artificial Sequence
  Description of Artificial Sequence: Synthetic peptide
  XENP021101 vlCDR1
KASQSVDYRGDSYMN

SEQ ID NO: 30762 - protein, 7 aa, Artificial Sequence
  Description of Artificial Sequence: Synthetic peptide
  XENP021101 vlCDR2
AASNLES

SEQ ID NO: 30763 - protein, 9 aa, Artificial Sequence
  Description of Artificial Sequence: Synthetic peptide
  XENP021101 vlCDR3
QQSNEDPFT

SEQ ID NO: 30764 - protein, 226 aa, Artificial Sequence; identical to SEQ ID NO: 29134
  Description of Artificial Sequence: Synthetic polypeptide
  XENP021102 7G8_H0_L0.25_Fab Heavy Chain

SEQ ID NO: 30765 - protein, 121 aa, Artificial Sequence; identical to SEQ ID NO: 17586
  Description of Artificial Sequence: Synthetic polypeptide
  VH of XENP021102

SEQ ID NO: 30766 - protein, 5 aa, Artificial Sequence
  Description of Artificial Sequence: Synthetic peptide
  XENP021102 vhCDR1
DAWMD

SEQ ID NO: 30767 - protein, 19 aa, Artificial Sequence
  Description of Artificial Sequence: Synthetic peptide
  XENP021102 vhCDR2
EIRTKANNHATYYAESVKG

SEQ ID NO: 30768 - protein, 10 aa, Artificial Sequence
  Description of Artificial Sequence: Synthetic peptide
  XENP021102 vhCDR3
LANWDWYFDV

SEQ ID NO: 30769 - protein, 218 aa, Artificial Sequence; identical to SEQ ID NO: 19940
  Description of Artificial Sequence: Synthetic polypeptide
  XENP021102 7G8_H0_L0.25_Fab Light Chain

SEQ ID NO: 30770 - protein, 111 aa, Artificial Sequence; identical to SEQ ID NO: 19941
  Description of Artificial Sequence: Synthetic polypeptide
  VL of XENP021102

SEQ ID NO: 30771 - protein, 15 aa, Artificial Sequence
  Description of Artificial Sequence: Synthetic peptide
  XENP021102 vlCDR1
KASQSVDYLGDSYMN

SEQ ID NO: 30772 - protein, 7 aa, Artificial Sequence
  Description of Artificial Sequence: Synthetic peptide
  XENP021102 vlCDR2
AASNLES

SEQ ID NO: 30773 - protein, 9 aa, Artificial Sequence
  Description of Artificial Sequence: Synthetic peptide
  XENP021102 vlCDR3
QQSNEDPFT

SEQ ID NO: 30774 - protein, 226 aa, Artificial Sequence; identical to SEQ ID NO: 29134
  Description of Artificial Sequence: Synthetic polypeptide
  XENP021103 7G8_H0_L0.26_Fab Heavy Chain

SEQ ID NO: 30775 - protein, 121 aa, Artificial Sequence; identical to SEQ ID NO: 17586
  Description of Artificial Sequence: Synthetic polypeptide
  VH of XENP021103

SEQ ID NO: 30776 - protein, 5 aa, Artificial Sequence
  Description of Artificial Sequence: Synthetic peptide
  XENP021103 vhCDR1
DAWMD

SEQ ID NO: 30777 - protein, 19 aa, Artificial Sequence
  Description of Artificial Sequence: Synthetic peptide
  XENP021103 vhCDR2
EIRTKANNHATYYAESVKG

SEQ ID NO: 30778 - protein, 10 aa, Artificial Sequence
  Description of Artificial Sequence: Synthetic peptide
  XENP021103 vhCDR3
LANWDWYFDV

SEQ ID NO: 30779 - protein, 218 aa, Artificial Sequence; identical to SEQ ID NO: 19950
  Description of Artificial Sequence: Synthetic polypeptide
  XENP021103 7G8_H0_L0.26_Fab Light Chain

SEQ ID NO: 30780 - protein, 111 aa, Artificial Sequence; identical to SEQ ID NO: 19951
  Description of Artificial Sequence: Synthetic polypeptide
  VL of XENP021103

SEQ ID NO: 30781 - protein, 15 aa, Artificial Sequence
  Description of Artificial Sequence: Synthetic peptide
  XENP021103 vlCDR1
KASQSVDYTGDSYMN

SEQ ID NO: 30782 - protein, 7 aa, Artificial Sequence
  Description of Artificial Sequence: Synthetic peptide
  XENP021103 vlCDR2
AASNLES

SEQ ID NO: 30783 - protein, 9 aa, Artificial Sequence
  Description of Artificial Sequence: Synthetic peptide
  XENP021103 vlCDR3
QQSNEDPFT

SEQ ID NO: 30784 - protein, 226 aa, Artificial Sequence; identical to SEQ ID NO: 29134
  Description of Artificial Sequence: Synthetic polypeptide
  XENP021104 7G8_H0_L0.27_Fab Heavy Chain

SEQ ID NO: 30785 - protein, 121 aa, Artificial Sequence; identical to SEQ ID NO: 17586
  Description of Artificial Sequence: Synthetic polypeptide
  VH of XENP021104

SEQ ID NO: 30786 - protein, 5 aa, Artificial Sequence
  Description of Artificial Sequence: Synthetic peptide
  XENP021104 vhCDR1
DAWMD

SEQ ID NO: 30787 - protein, 19 aa, Artificial Sequence
  Description of Artificial Sequence: Synthetic peptide
  XENP021104 vhCDR2
EIRTKANNHATYYAESVKG

SEQ ID NO: 30788 - protein, 10 aa, Artificial Sequence
  Description of Artificial Sequence: Synthetic peptide
  XENP021104 vhCDR3
LANWDWYFDV

SEQ ID NO: 30789 - protein, 218 aa, Artificial Sequence; identical to SEQ ID NO: 19960
  Description of Artificial Sequence: Synthetic polypeptide
  XENP021104 7G8_H0_L0.27_Fab Light Chain

SEQ ID NO: 30790 - protein, 111 aa, Artificial Sequence; identical to SEQ ID NO: 19961
  Description of Artificial Sequence: Synthetic polypeptide
  VL of XENP021104

SEQ ID NO: 30791 - protein, 15 aa, Artificial Sequence
  Description of Artificial Sequence: Synthetic peptide
  XENP021104 vlCDR1
KASQSVDYGGDSYMN

SEQ ID NO: 30792 - protein, 7 aa, Artificial Sequence
  Description of Artificial Sequence: Synthetic peptide
  XENP021104 vlCDR2
AASNLES

SEQ ID NO: 30793 - protein, 9 aa, Artificial Sequence
  Description of Artificial Sequence: Synthetic peptide
  XENP021104 vlCDR3
QQSNEDPFT

SEQ ID NO: 30794 - protein, 226 aa, Artificial Sequence; identical to SEQ ID NO: 29134
  Description of Artificial Sequence: Synthetic polypeptide
  XENP021105 7G8_H0_L0.28_Fab Heavy Chain

SEQ ID NO: 30795 - protein, 121 aa, Artificial Sequence; identical to SEQ ID NO: 17586
  Description of Artificial Sequence: Synthetic polypeptide
  VH of XENP021105

SEQ ID NO: 30796 - protein, 5 aa, Artificial Sequence
  Description of Artificial Sequence: Synthetic peptide
  XENP021105 vhCDR1
DAWMD

SEQ ID NO: 30797 - protein, 19 aa, Artificial Sequence
  Description of Artificial Sequence: Synthetic peptide
  XENP021105 vhCDR2
EIRTKANNHATYYAESVKG

SEQ ID NO: 30798 - protein, 10 aa, Artificial Sequence
  Description of Artificial Sequence: Synthetic peptide
  XENP021105 vhCDR3
LANWDWYFDV

SEQ ID NO: 30799 - protein, 218 aa, Artificial Sequence; identical to SEQ ID NO: 19970
  Description of Artificial Sequence: Synthetic polypeptide
  XENP021105 7G8_H0_L0.28_Fab Light Chain

SEQ ID NO: 30800 - protein, 111 aa, Artificial Sequence; identical to SEQ ID NO: 19971
  Description of Artificial Sequence: Synthetic polypeptide
  VL of XENP021105

SEQ ID NO: 30801 - protein, 15 aa, Artificial Sequence
  Description of Artificial Sequence: Synthetic peptide
  XENP021105 vlCDR1
KASQSVDYYGDSYMN

SEQ ID NO: 30802 - protein, 7 aa, Artificial Sequence
  Description of Artificial Sequence: Synthetic peptide
  XENP021105 vlCDR2
AASNLES

SEQ ID NO: 30803 - protein, 9 aa, Artificial Sequence
  Description of Artificial Sequence: Synthetic peptide
  XENP021105 vlCDR3
QQSNEDPFT

SEQ ID NO: 30804 - protein, 226 aa, Artificial Sequence; identical to SEQ ID NO: 29134
  Description of Artificial Sequence: Synthetic polypeptide
  XENP021106 7G8_H0_L0.29_Fab Heavy Chain

SEQ ID NO: 30805 - protein, 121 aa, Artificial Sequence; identical to SEQ ID NO: 17586
  Description of Artificial Sequence: Synthetic polypeptide
  VH of XENP021106

SEQ ID NO: 30806 - protein, 5 aa, Artificial Sequence
  Description of Artificial Sequence: Synthetic peptide
  XENP021106 vhCDR1
DAWMD

SEQ ID NO: 30807 - protein, 19 aa, Artificial Sequence
  Description of Artificial Sequence: Synthetic peptide
  XENP021106 vhCDR2
EIRTKANNHATYYAESVKG

SEQ ID NO: 30808 - protein, 10 aa, Artificial Sequence
  Description of Artificial Sequence: Synthetic peptide
  XENP021106 vhCDR3
LANWDWYFDV

SEQ ID NO: 30809 - protein, 218 aa, Artificial Sequence; identical to SEQ ID NO: 19980
  Description of Artificial Sequence: Synthetic polypeptide
  XENP021106 7G8_H0_L0.29_Fab Light Chain

SEQ ID NO: 30810 - protein, 111 aa, Artificial Sequence; identical to SEQ ID NO: 19981
  Description of Artificial Sequence: Synthetic polypeptide
  VL of XENP021106

SEQ ID NO: 30811 - protein, 15 aa, Artificial Sequence
  Description of Artificial Sequence: Synthetic peptide
  XENP021106 vlCDR1
KASQSVDYDADSYMN

SEQ ID NO: 30812 - protein, 7 aa, Artificial Sequence
  Description of Artificial Sequence: Synthetic peptide
  XENP021106 vlCDR2
AASNLES

SEQ ID NO: 30813 - protein, 9 aa, Artificial Sequence
  Description of Artificial Sequence: Synthetic peptide
  XENP021106 vlCDR3
QQSNEDPFT

SEQ ID NO: 30814 - protein, 226 aa, Artificial Sequence; identical to SEQ ID NO: 29134
  Description of Artificial Sequence: Synthetic polypeptide
  XENP021107 7G8_H0_L0.30_Fab Heavy Chain

SEQ ID NO: 30815 - protein, 121 aa, Artificial Sequence; identical to SEQ ID NO: 17586
  Description of Artificial Sequence: Synthetic polypeptide
  VH of XENP021107

SEQ ID NO: 30816 - protein, 5 aa, Artificial Sequence
  Description of Artificial Sequence: Synthetic peptide
  XENP021107 vhCDR1
DAWMD

SEQ ID NO: 30817 - protein, 19 aa, Artificial Sequence
  Description of Artificial Sequence: Synthetic peptide
  XENP021107 vhCDR2
EIRTKANNHATYYAESVKG

SEQ ID NO: 30818 - protein, 10 aa, Artificial Sequence
  Description of Artificial Sequence: Synthetic peptide
  XENP021107 vhCDR3
LANWDWYFDV

SEQ ID NO: 30819 - protein, 218 aa, Artificial Sequence; identical to SEQ ID NO: 19990
  Description of Artificial Sequence: Synthetic polypeptide
  XENP021107 7G8_H0_L0.30_Fab Light Chain

SEQ ID NO: 30820 - protein, 111 aa, Artificial Sequence; identical to SEQ ID NO: 19991
  Description of Artificial Sequence: Synthetic polypeptide
  VL of XENP021107

SEQ ID NO: 30821 - protein, 15 aa, Artificial Sequence
  Description of Artificial Sequence: Synthetic peptide
  XENP021107 vlCDR1
KASQSVDYDSDSYMN

SEQ ID NO: 30822 - protein, 7 aa, Artificial Sequence
  Description of Artificial Sequence: Synthetic peptide
  XENP021107 vlCDR2
AASNLES

SEQ ID NO: 30823 - protein, 9 aa, Artificial Sequence
  Description of Artificial Sequence: Synthetic peptide
  XENP021107 vlCDR3
QQSNEDPFT

SEQ ID NO: 30824 - protein, 226 aa, Artificial Sequence; identical to SEQ ID NO: 29134
  Description of Artificial Sequence: Synthetic polypeptide
  XENP021108 7G8_H0_L0.31_Fab Heavy Chain

SEQ ID NO: 30825 - protein, 121 aa, Artificial Sequence; identical to SEQ ID NO: 17586
  Description of Artificial Sequence: Synthetic polypeptide
  VH of XENP021108

SEQ ID NO: 30826 - protein, 5 aa, Artificial Sequence
  Description of Artificial Sequence: Synthetic peptide
  XENP021108 vhCDR1
DAWMD

SEQ ID NO: 30827 - protein, 19 aa, Artificial Sequence
  Description of Artificial Sequence: Synthetic peptide
  XENP021108 vhCDR2
EIRTKANNHATYYAESVKG

SEQ ID NO: 30828 - protein, 10 aa, Artificial Sequence
  Description of Artificial Sequence: Synthetic peptide
  XENP021108 vhCDR3
LANWDWYFDV

SEQ ID NO: 30829 - protein, 218 aa, Artificial Sequence; identical to SEQ ID NO: 20000
  Description of Artificial Sequence: Synthetic polypeptide
  XENP021108 7G8_H0_L0.31_Fab Light Chain

SEQ ID NO: 30830 - protein, 111 aa, Artificial Sequence; identical to SEQ ID NO: 20001
  Description of Artificial Sequence: Synthetic polypeptide
  VL of XENP021108

SEQ ID NO: 30831 - protein, 15 aa, Artificial Sequence
  Description of Artificial Sequence: Synthetic peptide
  XENP021108 vlCDR1
KASQSVDYDTDSYMN

SEQ ID NO: 30832 - protein, 7 aa, Artificial Sequence
  Description of Artificial Sequence: Synthetic peptide
  XENP021108 vlCDR2
AASNLES

SEQ ID NO: 30833 - protein, 9 aa, Artificial Sequence
  Description of Artificial Sequence: Synthetic peptide
  XENP021108 vlCDR3
QQSNEDPFT

SEQ ID NO: 30834 - protein, 226 aa, Artificial Sequence; identical to SEQ ID NO: 29134
  Description of Artificial Sequence: Synthetic polypeptide
  XENP021109 7G8_H0_L0.32_Fab Heavy Chain

SEQ ID NO: 30835 - protein, 121 aa, Artificial Sequence; identical to SEQ ID NO: 17586
  Description of Artificial Sequence: Synthetic polypeptide
  VH of XENP021109

SEQ ID NO: 30836 - protein, 5 aa, Artificial Sequence
  Description of Artificial Sequence: Synthetic peptide
  XENP021109 vhCDR1
DAWMD

SEQ ID NO: 30837 - protein, 19 aa, Artificial Sequence
  Description of Artificial Sequence: Synthetic peptide
  XENP021109 vhCDR2
EIRTKANNHATYYAESVKG

SEQ ID NO: 30838 - protein, 10 aa, Artificial Sequence
  Description of Artificial Sequence: Synthetic peptide
  XENP021109 vhCDR3
LANWDWYFDV

SEQ ID NO: 30839 - protein, 218 aa, Artificial Sequence; identical to SEQ ID NO: 20010
  Description of Artificial Sequence: Synthetic polypeptide
  XENP021109 7G8_H0_L0.32_Fab Light Chain

SEQ ID NO: 30840 - protein, 111 aa, Artificial Sequence; identical to SEQ ID NO: 20011
  Description of Artificial Sequence: Synthetic polypeptide
  VL of XENP021109

SEQ ID NO: 30841 - protein, 15 aa, Artificial Sequence
  Description of Artificial Sequence: Synthetic peptide
  XENP021109 vlCDR1
KASQSVDYDQDSYMN

SEQ ID NO: 30842 - protein, 7 aa, Artificial Sequence
  Description of Artificial Sequence: Synthetic peptide
  XENP021109 vlCDR2
AASNLES

SEQ ID NO: 30843 - protein, 9 aa, Artificial Sequence
  Description of Artificial Sequence: Synthetic peptide
  XENP021109 vlCDR3
QQSNEDPFT

SEQ ID NO: 30844 - protein, 226 aa, Artificial Sequence; identical to SEQ ID NO: 29134
  Description of Artificial Sequence: Synthetic polypeptide
  XENP021110 7G8_H0_L0.33_Fab Heavy Chain

SEQ ID NO: 30845 - protein, 121 aa, Artificial Sequence; identical to SEQ ID NO: 17586
  Description of Artificial Sequence: Synthetic polypeptide
  VH of XENP021110

SEQ ID NO: 30846 - protein, 5 aa, Artificial Sequence
  Description of Artificial Sequence: Synthetic peptide
  XENP021110 vhCDR1
DAWMD

SEQ ID NO: 30847 - protein, 19 aa, Artificial Sequence
  Description of Artificial Sequence: Synthetic peptide
  XENP021110 vhCDR2
EIRTKANNHATYYAESVKG

SEQ ID NO: 30848 - protein, 10 aa, Artificial Sequence
  Description of Artificial Sequence: Synthetic peptide
  XENP021110 vhCDR3
LANWDWYFDV

SEQ ID NO: 30849 - protein, 218 aa, Artificial Sequence; identical to SEQ ID NO: 20020
  Description of Artificial Sequence: Synthetic polypeptide
  XENP021110 7G8_H0_L0.33_Fab Light Chain

SEQ ID NO: 30850 - protein, 111 aa, Artificial Sequence; identical to SEQ ID NO: 20021
  Description of Artificial Sequence: Synthetic polypeptide
  VL of XENP021110

SEQ ID NO: 30851 - protein, 15 aa, Artificial Sequence
  Description of Artificial Sequence: Synthetic peptide
  XENP021110 vlCDR1
KASQSVDYDHDSYMN

SEQ ID NO: 30852 - protein, 7 aa, Artificial Sequence
  Description of Artificial Sequence: Synthetic peptide
  XENP021110 vlCDR2
AASNLES

SEQ ID NO: 30853 - protein, 9 aa, Artificial Sequence
  Description of Artificial Sequence: Synthetic peptide
  XENP021110 vlCDR3
QQSNEDPFT

SEQ ID NO: 30854 - protein, 226 aa, Artificial Sequence; identical to SEQ ID NO: 29134
  Description of Artificial Sequence: Synthetic polypeptide
  XENP021111 7G8_H0_L0.34_Fab Heavy Chain

SEQ ID NO: 30855 - protein, 121 aa, Artificial Sequence; identical to SEQ ID NO: 17586
  Description of Artificial Sequence: Synthetic polypeptide
  VH of XENP021111

SEQ ID NO: 30856 - protein, 5 aa, Artificial Sequence
  Description of Artificial Sequence: Synthetic peptide
  XENP021111 vhCDR1
DAWMD

SEQ ID NO: 30857 - protein, 19 aa, Artificial Sequence
  Description of Artificial Sequence: Synthetic peptide
  XENP021111 vhCDR2
EIRTKANNHATYYAESVKG

SEQ ID NO: 30858 - protein, 10 aa, Artificial Sequence
  Description of Artificial Sequence: Synthetic peptide
  XENP021111 vhCDR3
LANWDWYFDV

SEQ ID NO: 30859 - protein, 218 aa, Artificial Sequence; identical to SEQ ID NO: 20030
  Description of Artificial Sequence: Synthetic polypeptide
  XENP021111 7G8_H0_L0.34_Fab Light Chain

SEQ ID NO: 30860 - protein, 111 aa, Artificial Sequence; identical to SEQ ID NO: 20031
  Description of Artificial Sequence: Synthetic polypeptide
  VL of XENP021111

SEQ ID NO: 30861 - protein, 15 aa, Artificial Sequence
  Description of Artificial Sequence: Synthetic peptide
  XENP021111 vlCDR1
KASQSVDYDDDSYMN

SEQ ID NO: 30862 - protein, 7 aa, Artificial Sequence
  Description of Artificial Sequence: Synthetic peptide
  XENP021111 vlCDR2
AASNLES

SEQ ID NO: 30863 - protein, 9 aa, Artificial Sequence
  Description of Artificial Sequence: Synthetic peptide
  XENP021111 vlCDR3
QQSNEDPFT

SEQ ID NO: 30864 - protein, 226 aa, Artificial Sequence; identical to SEQ ID NO: 29134
  Description of Artificial Sequence: Synthetic polypeptide
  XENP021112 7G8_H0_L0.35_Fab Heavy Chain

SEQ ID NO: 30865 - protein, 121 aa, Artificial Sequence; identical to SEQ ID NO: 17586
  Description of Artificial Sequence: Synthetic polypeptide
  VH of XENP021112

SEQ ID NO: 30866 - protein, 5 aa, Artificial Sequence
  Description of Artificial Sequence: Synthetic peptide
  XENP021112 vhCDR1
DAWMD

SEQ ID NO: 30867 - protein, 19 aa, Artificial Sequence
  Description of Artificial Sequence: Synthetic peptide
  XENP021112 vhCDR2
EIRTKANNHATYYAESVKG

SEQ ID NO: 30868 - protein, 10 aa, Artificial Sequence
  Description of Artificial Sequence: Synthetic peptide
  XENP021112 vhCDR3
LANWDWYFDV

SEQ ID NO: 30869 - protein, 218 aa, Artificial Sequence; identical to SEQ ID NO: 20040
  Description of Artificial Sequence: Synthetic polypeptide
  XENP021112 7G8_H0_L0.35_Fab Light Chain

SEQ ID NO: 30870 - protein, 111 aa, Artificial Sequence; identical to SEQ ID NO: 20041
  Description of Artificial Sequence: Synthetic polypeptide
  VL of XENP021112

SEQ ID NO: 30871 - protein, 15 aa, Artificial Sequence
  Description of Artificial Sequence: Synthetic peptide
  XENP021112 vlCDR1
KASQSVDYDKDSYMN

SEQ ID NO: 30872 - protein, 7 aa, Artificial Sequence
  Description of Artificial Sequence: Synthetic peptide
  XENP021112 vlCDR2
AASNLES

SEQ ID NO: 30873 - protein, 9 aa, Artificial Sequence
  Description of Artificial Sequence: Synthetic peptide
  XENP021112 vlCDR3
QQSNEDPFT

SEQ ID NO: 30874 - protein, 226 aa, Artificial Sequence; identical to SEQ ID NO: 29134
  Description of Artificial Sequence: Synthetic polypeptide
  XENP021113 7G8_H0_L0.36_Fab Heavy Chain

SEQ ID NO: 30875 - protein, 121 aa, Artificial Sequence; identical to SEQ ID NO: 17586
  Description of Artificial Sequence: Synthetic polypeptide
  VH of XENP021113

SEQ ID NO: 30876 - protein, 5 aa, Artificial Sequence
  Description of Artificial Sequence: Synthetic peptide
  XENP021113 vhCDR1
DAWMD

SEQ ID NO: 30877 - protein, 19 aa, Artificial Sequence
  Description of Artificial Sequence: Synthetic peptide
  XENP021113 vhCDR2
EIRTKANNHATYYAESVKG

SEQ ID NO: 30878 - protein, 10 aa, Artificial Sequence
  Description of Artificial Sequence: Synthetic peptide
  XENP021113 vhCDR3
LANWDWYFDV

SEQ ID NO: 30879 - protein, 218 aa, Artificial Sequence; identical to SEQ ID NO: 20050
  Description of Artificial Sequence: Synthetic polypeptide
  XENP021113 7G8_H0_L0.36_Fab Light Chain

SEQ ID NO: 30880 - protein, 111 aa, Artificial Sequence; identical to SEQ ID NO: 20051
  Description of Artificial Sequence: Synthetic polypeptide
  VL of XENP021113

SEQ ID NO: 30881 - protein, 15 aa, Artificial Sequence
  Description of Artificial Sequence: Synthetic peptide
  XENP021113 vlCDR1
KASQSVDYDLDSYMN

SEQ ID NO: 30882 - protein, 7 aa, Artificial Sequence
  Description of Artificial Sequence: Synthetic peptide
  XENP021113 vlCDR2
AASNLES

SEQ ID NO: 30883 - protein, 9 aa, Artificial Sequence
  Description of Artificial Sequence: Synthetic peptide
  XENP021113 vlCDR3
QQSNEDPFT

SEQ ID NO: 30884 - protein, 226 aa, Artificial Sequence; identical to SEQ ID NO: 29134
  Description of Artificial Sequence: Synthetic polypeptide
  XENP021114 7G8_H0_L0.37_Fab Heavy Chain

SEQ ID NO: 30885 - protein, 121 aa, Artificial Sequence; identical to SEQ ID NO: 17586
  Description of Artificial Sequence: Synthetic polypeptide
  VH of XENP021114

SEQ ID NO: 30886 - protein, 5 aa, Artificial Sequence
  Description of Artificial Sequence: Synthetic peptide
  XENP021114 vhCDR1
DAWMD

SEQ ID NO: 30887 - protein, 19 aa, Artificial Sequence
  Description of Artificial Sequence: Synthetic peptide
  XENP021114 vhCDR2
EIRTKANNHATYYAESVKG

SEQ ID NO: 30888 - protein, 10 aa, Artificial Sequence
  Description of Artificial Sequence: Synthetic peptide
  XENP021114 vhCDR3
LANWDWYFDV

SEQ ID NO: 30889 - protein, 218 aa, Artificial Sequence; identical to SEQ ID NO: 20060
  Description of Artificial Sequence: Synthetic polypeptide
  XENP021114 7G8_H0_L0.37_Fab Light Chain

SEQ ID NO: 30890 - protein, 111 aa, Artificial Sequence; identical to SEQ ID NO: 20061
  Description of Artificial Sequence: Synthetic polypeptide
  VL of XENP021114

SEQ ID NO: 30891 - protein, 15 aa, Artificial Sequence
  Description of Artificial Sequence: Synthetic peptide
  XENP021114 vlCDR1
KASQSVDYDYDSYMN

SEQ ID NO: 30892 - protein, 7 aa, Artificial Sequence
  Description of Artificial Sequence: Synthetic peptide
  XENP021114 vlCDR2
AASNLES

SEQ ID NO: 30893 - protein, 9 aa, Artificial Sequence
  Description of Artificial Sequence: Synthetic peptide
  XENP021114 vlCDR3
QQSNEDPFT

SEQ ID NO: 30894 - protein, 226 aa, Artificial Sequence; identical to SEQ ID NO: 29134
  Description of Artificial Sequence: Synthetic polypeptide
  XENP021115 7G8_H0_L0.38_Fab Heavy Chain

SEQ ID NO: 30895 - protein, 121 aa, Artificial Sequence; identical to SEQ ID NO: 17586
  Description of Artificial Sequence: Synthetic polypeptide
  VH of XENP021115

SEQ ID NO: 30896 - protein, 5 aa, Artificial Sequence
  Description of Artificial Sequence: Synthetic peptide
  XENP021115 vhCDR1
DAWMD

SEQ ID NO: 30897 - protein, 19 aa, Artificial Sequence
  Description of Artificial Sequence: Synthetic peptide
  XENP021115 vhCDR2
EIRTKANNHATYYAESVKG

SEQ ID NO: 30898 - protein, 10 aa, Artificial Sequence
  Description of Artificial Sequence: Synthetic peptide
  XENP021115 vhCDR3
LANWDWYFDV

SEQ ID NO: 30899 - protein, 218 aa, Artificial Sequence; identical to SEQ ID NO: 20070
  Description of Artificial Sequence: Synthetic polypeptide
  XENP021115 7G8_H0_L0.38_Fab Light Chain

SEQ ID NO: 30900 - protein, 111 aa, Artificial Sequence; identical to SEQ ID NO: 20071
  Description of Artificial Sequence: Synthetic polypeptide
  VL of XENP021115

SEQ ID NO: 30901 - protein, 15 aa, Artificial Sequence
  Description of Artificial Sequence: Synthetic peptide
  XENP021115 vlCDR1
KASQSVDYDGNSYMN

SEQ ID NO: 30902 - protein, 7 aa, Artificial Sequence
  Description of Artificial Sequence: Synthetic peptide
  XENP021115 vlCDR2
AASNLES

SEQ ID NO: 30903 - protein, 9 aa, Artificial Sequence
  Description of Artificial Sequence: Synthetic peptide
  XENP021115 vlCDR3
QQSNEDPFT

SEQ ID NO: 30904 - protein, 226 aa, Artificial Sequence; identical to SEQ ID NO: 29134
  Description of Artificial Sequence: Synthetic polypeptide
  XENP021116 7G8_H0_L0.39_Fab Heavy Chain

SEQ ID NO: 30905 - protein, 121 aa, Artificial Sequence; identical to SEQ ID NO: 17586
  Description of Artificial Sequence: Synthetic polypeptide
  VH of XENP021116

SEQ ID NO: 30906 - protein, 5 aa, Artificial Sequence
  Description of Artificial Sequence: Synthetic peptide
  XENP021116 vhCDR1
DAWMD

SEQ ID NO: 30907 - protein, 19 aa, Artificial Sequence
  Description of Artificial Sequence: Synthetic peptide
  XENP021116 vhCDR2
EIRTKANNHATYYAESVKG

SEQ ID NO: 30908 - protein, 10 aa, Artificial Sequence
  Description of Artificial Sequence: Synthetic peptide
  XENP021116 vhCDR3
LANWDWYFDV

SEQ ID NO: 30909 - protein, 218 aa, Artificial Sequence; identical to SEQ ID NO: 20080
  Description of Artificial Sequence: Synthetic polypeptide
  XENP021116 7G8_H0_L0.39_Fab Light Chain

SEQ ID NO: 30910 - protein, 111 aa, Artificial Sequence; identical to SEQ ID NO: 20081
  Description of Artificial Sequence: Synthetic polypeptide
  VL of XENP021116

SEQ ID NO: 30911 - protein, 15 aa, Artificial Sequence
  Description of Artificial Sequence: Synthetic peptide
  XENP021116 vlCDR1
KASQSVDYDGESYMN

SEQ ID NO: 30912 - protein, 7 aa, Artificial Sequence
  Description of Artificial Sequence: Synthetic peptide
  XENP021116 vlCDR2
AASNLES

SEQ ID NO: 30913 - protein, 9 aa, Artificial Sequence
  Description of Artificial Sequence: Synthetic peptide
  XENP021116 vlCDR3
QQSNEDPFT

SEQ ID NO: 30914 - protein, 226 aa, Artificial Sequence; identical to SEQ ID NO: 29134
  Description of Artificial Sequence: Synthetic polypeptide
  XENP021117 7G8_H0_L0.40_Fab Heavy Chain

SEQ ID NO: 30915 - protein, 121 aa, Artificial Sequence; identical to SEQ ID NO: 17586
  Description of Artificial Sequence: Synthetic polypeptide
  VH of XENP021117

SEQ ID NO: 30916 - protein, 5 aa, Artificial Sequence
  Description of Artificial Sequence: Synthetic peptide
  XENP021117 vhCDR1
DAWMD

SEQ ID NO: 30917 - protein, 19 aa, Artificial Sequence
  Description of Artificial Sequence: Synthetic peptide
  XENP021117 vhCDR2
EIRTKANNHATYYAESVKG

SEQ ID NO: 30918 - protein, 10 aa, Artificial Sequence
  Description of Artificial Sequence: Synthetic peptide
  XENP021117 vhCDR3
LANWDWYFDV

SEQ ID NO: 30919 - protein, 218 aa, Artificial Sequence; identical to SEQ ID NO: 20090
  Description of Artificial Sequence: Synthetic polypeptide
  XENP021117 7G8_H0_L0.40_Fab Light Chain

SEQ ID NO: 30920 - protein, 111 aa, Artificial Sequence; identical to SEQ ID NO: 20091
  Description of Artificial Sequence: Synthetic polypeptide
  VL of XENP021117

SEQ ID NO: 30921 - protein, 15 aa, Artificial Sequence
  Description of Artificial Sequence: Synthetic peptide
  XENP021117 vlCDR1
KASQSVDYDGHSYMN

SEQ ID NO: 30922 - protein, 7 aa, Artificial Sequence
  Description of Artificial Sequence: Synthetic peptide
  XENP021117 vlCDR2
AASNLES

SEQ ID NO: 30923 - protein, 9 aa, Artificial Sequence
  Description of Artificial Sequence: Synthetic peptide
  XENP021117 vlCDR3
QQSNEDPFT

SEQ ID NO: 30924 - protein, 226 aa, Artificial Sequence; identical to SEQ ID NO: 29134
  Description of Artificial Sequence: Synthetic polypeptide
  XENP021118 7G8_H0_L0.41_Fab Heavy Chain

SEQ ID NO: 30925 - protein, 121 aa, Artificial Sequence; identical to SEQ ID NO: 17586
  Description of Artificial Sequence: Synthetic polypeptide
  VH of XENP021118

SEQ ID NO: 30926 - protein, 5 aa, Artificial Sequence
  Description of Artificial Sequence: Synthetic peptide
  XENP021118 vhCDR1
DAWMD

SEQ ID NO: 30927 - protein, 19 aa, Artificial Sequence
  Description of Artificial Sequence: Synthetic peptide
  XENP021118 vhCDR2
EIRTKANNHATYYAESVKG

SEQ ID NO: 30928 - protein, 10 aa, Artificial Sequence
  Description of Artificial Sequence: Synthetic peptide
  XENP021118 vhCDR3
LANWDWYFDV

SEQ ID NO: 30929 - protein, 218 aa, Artificial Sequence; identical to SEQ ID NO: 20100
  Description of Artificial Sequence: Synthetic polypeptide
  XENP021118 7G8_H0_L0.41_Fab Light Chain

SEQ ID NO: 30930 - protein, 111 aa, Artificial Sequence; identical to SEQ ID NO: 20101
  Description of Artificial Sequence: Synthetic polypeptide
  VL of XENP021118

SEQ ID NO: 30931 - protein, 15 aa, Artificial Sequence
  Description of Artificial Sequence: Synthetic peptide
  XENP021118 vlCDR1
KASQSVDYDGSSYMN

SEQ ID NO: 30932 - protein, 7 aa, Artificial Sequence
  Description of Artificial Sequence: Synthetic peptide
  XENP021118 vlCDR2
AASNLES

SEQ ID NO: 30933 - protein, 9 aa, Artificial Sequence
  Description of Artificial Sequence: Synthetic peptide
  XENP021118 vlCDR3
QQSNEDPFT

SEQ ID NO: 30934 - protein, 226 aa, Artificial Sequence; identical to SEQ ID NO: 29134
  Description of Artificial Sequence: Synthetic polypeptide
  XENP021119 7G8_H0_L0.42_Fab Heavy Chain

SEQ ID NO: 30935 - protein, 121 aa, Artificial Sequence; identical to SEQ ID NO: 17586
  Description of Artificial Sequence: Synthetic polypeptide
  VH of XENP021119

SEQ ID NO: 30936 - protein, 5 aa, Artificial Sequence
  Description of Artificial Sequence: Synthetic peptide
  XENP021119 vhCDR1
DAWMD

SEQ ID NO: 30937 - protein, 19 aa, Artificial Sequence
  Description of Artificial Sequence: Synthetic peptide
  XENP021119 vhCDR2
EIRTKANNHATYYAESVKG

SEQ ID NO: 30938 - protein, 10 aa, Artificial Sequence
  Description of Artificial Sequence: Synthetic peptide
  XENP021119 vhCDR3
LANWDWYFDV

SEQ ID NO: 30939 - protein, 218 aa, Artificial Sequence; identical to SEQ ID NO: 20110
  Description of Artificial Sequence: Synthetic polypeptide
  XENP021119 7G8_H0_L0.42_Fab Light Chain

SEQ ID NO: 30940 - protein, 111 aa, Artificial Sequence; identical to SEQ ID NO: 20111
  Description of Artificial Sequence: Synthetic polypeptide
  VL of XENP021119

SEQ ID NO: 30941 - protein, 15 aa, Artificial Sequence
  Description of Artificial Sequence: Synthetic peptide
  XENP021119 vlCDR1
KASQSVDYDGRSYMN

SEQ ID NO: 30942 - protein, 7 aa, Artificial Sequence
  Description of Artificial Sequence: Synthetic peptide
  XENP021119 vlCDR2
AASNLES

SEQ ID NO: 30943 - protein, 9 aa, Artificial Sequence
  Description of Artificial Sequence: Synthetic peptide
  XENP021119 vlCDR3
QQSNEDPFT

SEQ ID NO: 30944 - protein, 226 aa, Artificial Sequence; identical to SEQ ID NO: 29134
  Description of Artificial Sequence: Synthetic polypeptide
  XENP021120 7G8_H0_L0.43_Fab Heavy Chain

SEQ ID NO: 30945 - protein, 121 aa, Artificial Sequence; identical to SEQ ID NO: 17586
  Description of Artificial Sequence: Synthetic polypeptide
  VH of XENP021120

SEQ ID NO: 30946 - protein, 5 aa, Artificial Sequence
  Description of Artificial Sequence: Synthetic peptide
  XENP021120 vhCDR1
DAWMD

SEQ ID NO: 30947 - protein, 19 aa, Artificial Sequence
  Description of Artificial Sequence: Synthetic peptide
  XENP021120 vhCDR2
EIRTKANNHATYYAESVKG

SEQ ID NO: 30948 - protein, 10 aa, Artificial Sequence
  Description of Artificial Sequence: Synthetic peptide
  XENP021120 vhCDR3
LANWDWYFDV

SEQ ID NO: 30949 - protein, 218 aa, Artificial Sequence; identical to SEQ ID NO: 20120
  Description of Artificial Sequence: Synthetic polypeptide
  XENP021120 7G8_H0_L0.43_Fab Light Chain

SEQ ID NO: 30950 - protein, 111 aa, Artificial Sequence; identical to SEQ ID NO: 20121
  Description of Artificial Sequence: Synthetic polypeptide
  VL of XENP021120

SEQ ID NO: 30951 - protein, 15 aa, Artificial Sequence
  Description of Artificial Sequence: Synthetic peptide
  XENP021120 vlCDR1
KASQSVDYDGLSYMN

SEQ ID NO: 30952 - protein, 7 aa, Artificial Sequence
  Description of Artificial Sequence: Synthetic peptide
  XENP021120 vlCDR2
AASNLES

SEQ ID NO: 30953 - protein, 9 aa, Artificial Sequence
  Description of Artificial Sequence: Synthetic peptide
  XENP021120 vlCDR3
QQSNEDPFT

SEQ ID NO: 30954 - protein, 226 aa, Artificial Sequence; identical to SEQ ID NO: 29134
  Description of Artificial Sequence: Synthetic polypeptide
  XENP021121 7G8_H0_L0.44_Fab Heavy Chain

SEQ ID NO: 30955 - protein, 121 aa, Artificial Sequence; identical to SEQ ID NO: 17586
  Description of Artificial Sequence: Synthetic polypeptide
  VH of XENP021121

SEQ ID NO: 30956 - protein, 5 aa, Artificial Sequence
  Description of Artificial Sequence: Synthetic peptide
  XENP021121 vhCDR1
DAWMD

SEQ ID NO: 30957 - protein, 19 aa, Artificial Sequence
  Description of Artificial Sequence: Synthetic peptide
  XENP021121 vhCDR2
EIRTKANNHATYYAESVKG

SEQ ID NO: 30958 - protein, 10 aa, Artificial Sequence
  Description of Artificial Sequence: Synthetic peptide
  XENP021121 vhCDR3
LANWDWYFDV

SEQ ID NO: 30959 - protein, 218 aa, Artificial Sequence; identical to SEQ ID NO: 20130
  Description of Artificial Sequence: Synthetic polypeptide
  XENP021121 7G8_H0_L0.44_Fab Light Chain

SEQ ID NO: 30960 - protein, 111 aa, Artificial Sequence; identical to SEQ ID NO: 20131
  Description of Artificial Sequence: Synthetic polypeptide
  VL of XENP021121

SEQ ID NO: 30961 - protein, 15 aa, Artificial Sequence
  Description of Artificial Sequence: Synthetic peptide
  XENP021121 vlCDR1
KASQSVDYDGTSYMN

SEQ ID NO: 30962 - protein, 7 aa, Artificial Sequence
  Description of Artificial Sequence: Synthetic peptide
  XENP021121 vlCDR2
AASNLES

SEQ ID NO: 30963 - protein, 9 aa, Artificial Sequence
  Description of Artificial Sequence: Synthetic peptide
  XENP021121 vlCDR3
QQSNEDPFT

SEQ ID NO: 30964 - protein, 226 aa, Artificial Sequence; identical to SEQ ID NO: 29134
  Description of Artificial Sequence: Synthetic polypeptide
  XENP021122 7G8_H0_L0.45_Fab Heavy Chain

SEQ ID NO: 30965 - protein, 121 aa, Artificial Sequence; identical to SEQ ID NO: 17586
  Description of Artificial Sequence: Synthetic polypeptide
  VH of XENP021122

SEQ ID NO: 30966 - protein, 5 aa, Artificial Sequence
  Description of Artificial Sequence: Synthetic peptide
  XENP021122 vhCDR1
DAWMD

SEQ ID NO: 30967 - protein, 19 aa, Artificial Sequence
  Description of Artificial Sequence: Synthetic peptide
  XENP021122 vhCDR2
EIRTKANNHATYYAESVKG

SEQ ID NO: 30968 - protein, 10 aa, Artificial Sequence
  Description of Artificial Sequence: Synthetic peptide
  XENP021122 vhCDR3
LANWDWYFDV

SEQ ID NO: 30969 - protein, 218 aa, Artificial Sequence; identical to SEQ ID NO: 20140
  Description of Artificial Sequence: Synthetic polypeptide
  XENP021122 7G8_H0_L0.45_Fab Light Chain

SEQ ID NO: 30970 - protein, 111 aa, Artificial Sequence; identical to SEQ ID NO: 20141
  Description of Artificial Sequence: Synthetic polypeptide
  VL of XENP021122

SEQ ID NO: 30971 - protein, 15 aa, Artificial Sequence
  Description of Artificial Sequence: Synthetic peptide
  XENP021122 vlCDR1
KASQSVDYDGGSYMN

SEQ ID NO: 30972 - protein, 7 aa, Artificial Sequence
  Description of Artificial Sequence: Synthetic peptide
  XENP021122 vlCDR2
AASNLES

SEQ ID NO: 30973 - protein, 9 aa, Artificial Sequence
  Description of Artificial Sequence: Synthetic peptide
  XENP021122 vlCDR3
QQSNEDPFT

SEQ ID NO: 30974 - protein, 226 aa, Artificial Sequence; identical to SEQ ID NO: 29134
  Description of Artificial Sequence: Synthetic polypeptide
  XENP021123 7G8_H0_L0.46_Fab Heavy Chain

SEQ ID NO: 30975 - protein, 121 aa, Artificial Sequence; identical to SEQ ID NO: 17586
  Description of Artificial Sequence: Synthetic polypeptide
  VH of XENP021123

SEQ ID NO: 30976 - protein, 5 aa, Artificial Sequence
  Description of Artificial Sequence: Synthetic peptide
  XENP021123 vhCDR1
DAWMD

SEQ ID NO: 30977 - protein, 19 aa, Artificial Sequence
  Description of Artificial Sequence: Synthetic peptide
  XENP021123 vhCDR2
EIRTKANNHATYYAESVKG

SEQ ID NO: 30978 - protein, 10 aa, Artificial Sequence
  Description of Artificial Sequence: Synthetic peptide
  XENP021123 vhCDR3
LANWDWYFDV

SEQ ID NO: 30979 - protein, 218 aa, Artificial Sequence; identical to SEQ ID NO: 20150
  Description of Artificial Sequence: Synthetic polypeptide
  XENP021123 7G8_H0_L0.46_Fab Light Chain

SEQ ID NO: 30980 - protein, 111 aa, Artificial Sequence; identical to SEQ ID NO: 20151
  Description of Artificial Sequence: Synthetic polypeptide
  VL of XENP021123

SEQ ID NO: 30981 - protein, 15 aa, Artificial Sequence
  Description of Artificial Sequence: Synthetic peptide
  XENP021123 vlCDR1
KASQSVDYDGYSYMN

SEQ ID NO: 30982 - protein, 7 aa, Artificial Sequence
  Description of Artificial Sequence: Synthetic peptide
  XENP021123 vlCDR2
AASNLES

SEQ ID NO: 30983 - protein, 9 aa, Artificial Sequence
  Description of Artificial Sequence: Synthetic peptide
  XENP021123 vlCDR3
QQSNEDPFT

SEQ ID NO: 30984 - protein, 226 aa, Artificial Sequence; identical to SEQ ID NO: 29134
  Description of Artificial Sequence: Synthetic polypeptide
  XENP021124 7G8_H0_L0.47_Fab Heavy Chain

SEQ ID NO: 30985 - protein, 121 aa, Artificial Sequence; identical to SEQ ID NO: 17586
  Description of Artificial Sequence: Synthetic polypeptide
  VH of XENP021124

SEQ ID NO: 30986 - protein, 5 aa, Artificial Sequence
  Description of Artificial Sequence: Synthetic peptide
  XENP021124 vhCDR1
DAWMD

SEQ ID NO: 30987 - protein, 19 aa, Artificial Sequence
  Description of Artificial Sequence: Synthetic peptide
  XENP021124 vhCDR2
EIRTKANNHATYYAESVKG

SEQ ID NO: 30988 - protein, 10 aa, Artificial Sequence
  Description of Artificial Sequence: Synthetic peptide
  XENP021124 vhCDR3
LANWDWYFDV

SEQ ID NO: 30989 - protein, 218 aa, Artificial Sequence; identical to SEQ ID NO: 20160
  Description of Artificial Sequence: Synthetic polypeptide
  XENP021124 7G8_H0_L0.47_Fab Light Chain

SEQ ID NO: 30990 - protein, 111 aa, Artificial Sequence; identical to SEQ ID NO: 20161
  Description of Artificial Sequence: Synthetic polypeptide
  VL of XENP021124

SEQ ID NO: 30991 - protein, 15 aa, Artificial Sequence
  Description of Artificial Sequence: Synthetic peptide
  XENP021124 vlCDR1
KASQSVDYDGDSYMN

SEQ ID NO: 30992 - protein, 7 aa, Artificial Sequence
  Description of Artificial Sequence: Synthetic peptide
  XENP021124 vlCDR2
AASNLES

SEQ ID NO: 30993 - protein, 9 aa, Artificial Sequence
  Description of Artificial Sequence: Synthetic peptide
  XENP021124 vlCDR3
QQSNEDPFT

SEQ ID NO: 30994 - protein, 226 aa, Artificial Sequence; identical to SEQ ID NO: 29134
  Description of Artificial Sequence: Synthetic polypeptide
  XENP021125 7G8_H0_L0.48_Fab Heavy Chain

SEQ ID NO: 30995 - protein, 121 aa, Artificial Sequence; identical to SEQ ID NO: 17586
  Description of Artificial Sequence: Synthetic polypeptide
  VH of XENP021125

SEQ ID NO: 30996 - protein, 5 aa, Artificial Sequence
  Description of Artificial Sequence: Synthetic peptide
  XENP021125 vhCDR1
DAWMD

SEQ ID NO: 30997 - protein, 19 aa, Artificial Sequence
  Description of Artificial Sequence: Synthetic peptide
  XENP021125 vhCDR2
EIRTKANNHATYYAESVKG

SEQ ID NO: 30998 - protein, 10 aa, Artificial Sequence
  Description of Artificial Sequence: Synthetic peptide
  XENP021125 vhCDR3
LANWDWYFDV

SEQ ID NO: 30999 - protein, 218 aa, Artificial Sequence; identical to SEQ ID NO: 20170
  Description of Artificial Sequence: Synthetic polypeptide
  XENP021125 7G8_H0_L0.48_Fab Light Chain

SEQ ID NO: 31000 - protein, 111 aa, Artificial Sequence; identical to SEQ ID NO: 20171
  Description of Artificial Sequence: Synthetic polypeptide
  VL of XENP021125

SEQ ID NO: 31001 - protein, 15 aa, Artificial Sequence
  Description of Artificial Sequence: Synthetic peptide
  XENP021125 vlCDR1
KASQSVDYDGDSYMN

SEQ ID NO: 31002 - protein, 7 aa, Artificial Sequence
  Description of Artificial Sequence: Synthetic peptide
  XENP021125 vlCDR2
SASNLES

SEQ ID NO: 31003 - protein, 9 aa, Artificial Sequence
  Description of Artificial Sequence: Synthetic peptide
  XENP021125 vlCDR3
QQSNEDPFT

SEQ ID NO: 31004 - protein, 226 aa, Artificial Sequence; identical to SEQ ID NO: 29134
  Description of Artificial Sequence: Synthetic polypeptide
  XENP021126 7G8_H0_L0.49_Fab Heavy Chain

SEQ ID NO: 31005 - protein, 121 aa, Artificial Sequence; identical to SEQ ID NO: 17586
  Description of Artificial Sequence: Synthetic polypeptide
  VH of XENP021126

SEQ ID NO: 31006 - protein, 5 aa, Artificial Sequence
  Description of Artificial Sequence: Synthetic peptide
  XENP021126 vhCDR1
DAWMD

SEQ ID NO: 31007 - protein, 19 aa, Artificial Sequence
  Description of Artificial Sequence: Synthetic peptide
  XENP021126 vhCDR2
EIRTKANNHATYYAESVKG

SEQ ID NO: 31008 - protein, 10 aa, Artificial Sequence
  Description of Artificial Sequence: Synthetic peptide
  XENP021126 vhCDR3
LANWDWYFDV

SEQ ID NO: 31009 - protein, 218 aa, Artificial Sequence; identical to SEQ ID NO: 20180
  Description of Artificial Sequence: Synthetic polypeptide
  XENP021126 7G8_H0_L0.49_Fab Light Chain

SEQ ID NO: 31010 - protein, 111 aa, Artificial Sequence; identical to SEQ ID NO: 20181
  Description of Artificial Sequence: Synthetic polypeptide
  VL of XENP021126

SEQ ID NO: 31011 - protein, 15 aa, Artificial Sequence
  Description of Artificial Sequence: Synthetic peptide
  XENP021126 vlCDR1
KASQSVDYDGDSYMN

SEQ ID NO: 31012 - protein, 7 aa, Artificial Sequence
  Description of Artificial Sequence: Synthetic peptide
  XENP021126 vlCDR2
TASNLES

SEQ ID NO: 31013 - protein, 9 aa, Artificial Sequence
  Description of Artificial Sequence: Synthetic peptide
  XENP021126 vlCDR3
QQSNEDPFT

SEQ ID NO: 31014 - protein, 226 aa, Artificial Sequence; identical to SEQ ID NO: 29134
  Description of Artificial Sequence: Synthetic polypeptide
  XENP021127 7G8_H0_L0.50_Fab Heavy Chain

SEQ ID NO: 31015 - protein, 121 aa, Artificial Sequence; identical to SEQ ID NO: 17586
  Description of Artificial Sequence: Synthetic polypeptide
  VH of XENP021127

SEQ ID NO: 31016 - protein, 5 aa, Artificial Sequence
  Description of Artificial Sequence: Synthetic peptide
  XENP021127 vhCDR1
DAWMD

SEQ ID NO: 31017 - protein, 19 aa, Artificial Sequence
  Description of Artificial Sequence: Synthetic peptide
  XENP021127 vhCDR2
EIRTKANNHATYYAESVKG

SEQ ID NO: 31018 - protein, 10 aa, Artificial Sequence
  Description of Artificial Sequence: Synthetic peptide
  XENP021127 vhCDR3
LANWDWYFDV

SEQ ID NO: 31019 - protein, 218 aa, Artificial Sequence; identical to SEQ ID NO: 20190
  Description of Artificial Sequence: Synthetic polypeptide
  XENP021127 7G8_H0_L0.50_Fab Light Chain

SEQ ID NO: 31020 - protein, 111 aa, Artificial Sequence; identical to SEQ ID NO: 20191
  Description of Artificial Sequence: Synthetic polypeptide
  VL of XENP021127

SEQ ID NO: 31021 - protein, 15 aa, Artificial Sequence
  Description of Artificial Sequence: Synthetic peptide
  XENP021127 vlCDR1
KASQSVDYDGDSYMN

SEQ ID NO: 31022 - protein, 7 aa, Artificial Sequence
  Description of Artificial Sequence: Synthetic peptide
  XENP021127 vlCDR2
GASNLES

SEQ ID NO: 31023 - protein, 9 aa, Artificial Sequence
  Description of Artificial Sequence: Synthetic peptide
  XENP021127 vlCDR3
QQSNEDPFT

SEQ ID NO: 31024 - protein, 226 aa, Artificial Sequence; identical to SEQ ID NO: 29134
  Description of Artificial Sequence: Synthetic polypeptide
  XENP021128 7G8_H0_L0.51_Fab Heavy Chain

SEQ ID NO: 31025 - protein, 121 aa, Artificial Sequence; identical to SEQ ID NO: 17586
  Description of Artificial Sequence: Synthetic polypeptide
  VH of XENP021128

SEQ ID NO: 31026 - protein, 5 aa, Artificial Sequence
  Description of Artificial Sequence: Synthetic peptide
  XENP021128 vhCDR1
DAWMD

SEQ ID NO: 31027 - protein, 19 aa, Artificial Sequence
  Description of Artificial Sequence: Synthetic peptide
  XENP021128 vhCDR2
EIRTKANNHATYYAESVKG

SEQ ID NO: 31028 - protein, 10 aa, Artificial Sequence
  Description of Artificial Sequence: Synthetic peptide
  XENP021128 vhCDR3
LANWDWYFDV

SEQ ID NO: 31029 - protein, 218 aa, Artificial Sequence; identical to SEQ ID NO: 20200
  Description of Artificial Sequence: Synthetic polypeptide
  XENP021128 7G8_H0_L0.51_Fab Light Chain

SEQ ID NO: 31030 - protein, 111 aa, Artificial Sequence; identical to SEQ ID NO: 20201
  Description of Artificial Sequence: Synthetic polypeptide
  VL of XENP021128

SEQ ID NO: 31031 - protein, 15 aa, Artificial Sequence
  Description of Artificial Sequence: Synthetic peptide
  XENP021128 vlCDR1
KASQSVDYDGDSYMN

SEQ ID NO: 31032 - protein, 7 aa, Artificial Sequence
  Description of Artificial Sequence: Synthetic peptide
  XENP021128 vlCDR2
HASNLES

SEQ ID NO: 31033 - protein, 9 aa, Artificial Sequence
  Description of Artificial Sequence: Synthetic peptide
  XENP021128 vlCDR3
QQSNEDPFT

SEQ ID NO: 31034 - protein, 226 aa, Artificial Sequence; identical to SEQ ID NO: 29134
  Description of Artificial Sequence: Synthetic polypeptide
  XENP021129 7G8_H0_L0.52_Fab Heavy Chain

SEQ ID NO: 31035 - protein, 121 aa, Artificial Sequence; identical to SEQ ID NO: 17586
  Description of Artificial Sequence: Synthetic polypeptide
  VH of XENP021129

SEQ ID NO: 31036 - protein, 5 aa, Artificial Sequence
  Description of Artificial Sequence: Synthetic peptide
  XENP021129 vhCDR1
DAWMD

SEQ ID NO: 31037 - protein, 19 aa, Artificial Sequence
  Description of Artificial Sequence: Synthetic peptide
  XENP021129 vhCDR2
EIRTKANNHATYYAESVKG

SEQ ID NO: 31038 - protein, 10 aa, Artificial Sequence
  Description of Artificial Sequence: Synthetic peptide
  XENP021129 vhCDR3
LANWDWYFDV

SEQ ID NO: 31039 - protein, 218 aa, Artificial Sequence; identical to SEQ ID NO: 20210
  Description of Artificial Sequence: Synthetic polypeptide
  XENP021129 7G8_H0_L0.52_Fab Light Chain

SEQ ID NO: 31040 - protein, 111 aa, Artificial Sequence; identical to SEQ ID NO: 20211
  Description of Artificial Sequence: Synthetic polypeptide
  VL of XENP021129

SEQ ID NO: 31041 - protein, 15 aa, Artificial Sequence
  Description of Artificial Sequence: Synthetic peptide
  XENP021129 vlCDR1
KASQSVDYDGDSYMN

SEQ ID NO: 31042 - protein, 7 aa, Artificial Sequence
  Description of Artificial Sequence: Synthetic peptide
  XENP021129 vlCDR2
QASNLES

SEQ ID NO: 31043 - protein, 9 aa, Artificial Sequence
  Description of Artificial Sequence: Synthetic peptide
  XENP021129 vlCDR3
QQSNEDPFT

SEQ ID NO: 31044 - protein, 226 aa, Artificial Sequence; identical to SEQ ID NO: 29134
  Description of Artificial Sequence: Synthetic polypeptide
  XENP021130 7G8_H0_L0.53_Fab Heavy Chain

SEQ ID NO: 31045 - protein, 121 aa, Artificial Sequence; identical to SEQ ID NO: 17586
  Description of Artificial Sequence: Synthetic polypeptide
  VH of XENP021130

SEQ ID NO: 31046 - protein, 5 aa, Artificial Sequence
  Description of Artificial Sequence: Synthetic peptide
  XENP021130 vhCDR1
DAWMD

SEQ ID NO: 31047 - protein, 19 aa, Artificial Sequence
  Description of Artificial Sequence: Synthetic peptide
  XENP021130 vhCDR2
EIRTKANNHATYYAESVKG

SEQ ID NO: 31048 - protein, 10 aa, Artificial Sequence
  Description of Artificial Sequence: Synthetic peptide
  XENP021130 vhCDR3
LANWDWYFDV

SEQ ID NO: 31049 - protein, 218 aa, Artificial Sequence; identical to SEQ ID NO: 20220
  Description of Artificial Sequence: Synthetic polypeptide
  XENP021130 7G8_H0_L0.53_Fab Light Chain

SEQ ID NO: 31050 - protein, 111 aa, Artificial Sequence; identical to SEQ ID NO: 20221
  Description of Artificial Sequence: Synthetic polypeptide
  VL of XENP021130

SEQ ID NO: 31051 - protein, 15 aa, Artificial Sequence
  Description of Artificial Sequence: Synthetic peptide
  XENP021130 vlCDR1
KASQSVDYDGDSYMN

SEQ ID NO: 31052 - protein, 7 aa, Artificial Sequence
  Description of Artificial Sequence: Synthetic peptide
  XENP021130 vlCDR2
DASNLES

SEQ ID NO: 31053 - protein, 9 aa, Artificial Sequence
  Description of Artificial Sequence: Synthetic peptide
  XENP021130 vlCDR3
QQSNEDPFT

SEQ ID NO: 31054 - protein, 226 aa, Artificial Sequence; identical to SEQ ID NO: 29134
  Description of Artificial Sequence: Synthetic polypeptide
  XENP021131 7G8_H0_L0.54_Fab Heavy Chain

SEQ ID NO: 31055 - protein, 121 aa, Artificial Sequence; identical to SEQ ID NO: 17586
  Description of Artificial Sequence: Synthetic polypeptide
  VH of XENP021131

SEQ ID NO: 31056 - protein, 5 aa, Artificial Sequence
  Description of Artificial Sequence: Synthetic peptide
  XENP021131 vhCDR1
DAWMD

SEQ ID NO: 31057 - protein, 19 aa, Artificial Sequence
  Description of Artificial Sequence: Synthetic peptide
  XENP021131 vhCDR2
EIRTKANNHATYYAESVKG

SEQ ID NO: 31058 - protein, 10 aa, Artificial Sequence
  Description of Artificial Sequence: Synthetic peptide
  XENP021131 vhCDR3
LANWDWYFDV

SEQ ID NO: 31059 - protein, 218 aa, Artificial Sequence; identical to SEQ ID NO: 20230
  Description of Artificial Sequence: Synthetic polypeptide
  XENP021131 7G8_H0_L0.54_Fab Light Chain

SEQ ID NO: 31060 - protein, 111 aa, Artificial Sequence; identical to SEQ ID NO: 20231
  Description of Artificial Sequence: Synthetic polypeptide
  VL of XENP021131

SEQ ID NO: 31061 - protein, 15 aa, Artificial Sequence
  Description of Artificial Sequence: Synthetic peptide
  XENP021131 vlCDR1
KASQSVDYDGDSYMN

SEQ ID NO: 31062 - protein, 7 aa, Artificial Sequence
  Description of Artificial Sequence: Synthetic peptide
  XENP021131 vlCDR2
LASNLES

SEQ ID NO: 31063 - protein, 9 aa, Artificial Sequence
  Description of Artificial Sequence: Synthetic peptide
  XENP021131 vlCDR3
QQSNEDPFT

SEQ ID NO: 31064 - protein, 226 aa, Artificial Sequence; identical to SEQ ID NO: 29134
  Description of Artificial Sequence: Synthetic polypeptide
  XENP021132 7G8_H0_L0.55_Fab Heavy Chain

SEQ ID NO: 31065 - protein, 121 aa, Artificial Sequence; identical to SEQ ID NO: 17586
  Description of Artificial Sequence: Synthetic polypeptide
  VH of XENP021132

SEQ ID NO: 31066 - protein, 5 aa, Artificial Sequence
  Description of Artificial Sequence: Synthetic peptide
  XENP021132 vhCDR1
DAWMD

SEQ ID NO: 31067 - protein, 19 aa, Artificial Sequence
  Description of Artificial Sequence: Synthetic peptide
  XENP021132 vhCDR2
EIRTKANNHATYYAESVKG

SEQ ID NO: 31068 - protein, 10 aa, Artificial Sequence
  Description of Artificial Sequence: Synthetic peptide
  XENP021132 vhCDR3
LANWDWYFDV

SEQ ID NO: 31069 - protein, 218 aa, Artificial Sequence; identical to SEQ ID NO: 20240
  Description of Artificial Sequence: Synthetic polypeptide
  XENP021132 7G8_H0_L0.55_Fab Light Chain

SEQ ID NO: 31070 - protein, 111 aa, Artificial Sequence; identical to SEQ ID NO: 20241
  Description of Artificial Sequence: Synthetic polypeptide
  VL of XENP021132

SEQ ID NO: 31071 - protein, 15 aa, Artificial Sequence
  Description of Artificial Sequence: Synthetic peptide
  XENP021132 vlCDR1
KASQSVDYDGDSYMN

SEQ ID NO: 31072 - protein, 7 aa, Artificial Sequence
  Description of Artificial Sequence: Synthetic peptide
  XENP021132 vlCDR2
KASNLES

SEQ ID NO: 31073 - protein, 9 aa, Artificial Sequence
  Description of Artificial Sequence: Synthetic peptide
  XENP021132 vlCDR3
QQSNEDPFT

SEQ ID NO: 31074 - protein, 226 aa, Artificial Sequence; identical to SEQ ID NO: 29134
  Description of Artificial Sequence: Synthetic polypeptide
  XENP021133 7G8_H0_L0.56_Fab Heavy Chain

SEQ ID NO: 31075 - protein, 121 aa, Artificial Sequence; identical to SEQ ID NO: 17586
  Description of Artificial Sequence: Synthetic polypeptide
  VH of XENP021133

SEQ ID NO: 31076 - protein, 5 aa, Artificial Sequence
  Description of Artificial Sequence: Synthetic peptide
  XENP021133 vhCDR1
DAWMD

SEQ ID NO: 31077 - protein, 19 aa, Artificial Sequence
  Description of Artificial Sequence: Synthetic peptide
  XENP021133 vhCDR2
EIRTKANNHATYYAESVKG

SEQ ID NO: 31078 - protein, 10 aa, Artificial Sequence
  Description of Artificial Sequence: Synthetic peptide
  XENP021133 vhCDR3
LANWDWYFDV

SEQ ID NO: 31079 - protein, 218 aa, Artificial Sequence; identical to SEQ ID NO: 20250
  Description of Artificial Sequence: Synthetic polypeptide
  XENP021133 7G8_H0_L0.56_Fab Light Chain

SEQ ID NO: 31080 - protein, 111 aa, Artificial Sequence; identical to SEQ ID NO: 20251
  Description of Artificial Sequence: Synthetic polypeptide
  VL of XENP021133

SEQ ID NO: 31081 - protein, 15 aa, Artificial Sequence
  Description of Artificial Sequence: Synthetic peptide
  XENP021133 vlCDR1
KASQSVDYDGDSYMN

SEQ ID NO: 31082 - protein, 7 aa, Artificial Sequence
  Description of Artificial Sequence: Synthetic peptide
  XENP021133 vlCDR2
YASNLES

SEQ ID NO: 31083 - protein, 9 aa, Artificial Sequence
  Description of Artificial Sequence: Synthetic peptide
  XENP021133 vlCDR3
QQSNEDPFT

SEQ ID NO: 31084 - protein, 226 aa, Artificial Sequence; identical to SEQ ID NO: 29134
  Description of Artificial Sequence: Synthetic polypeptide
  XENP021134 7G8_H0_L0.57_Fab Heavy Chain

SEQ ID NO: 31085 - protein, 121 aa, Artificial Sequence; identical to SEQ ID NO: 17586
  Description of Artificial Sequence: Synthetic polypeptide
  VH of XENP021134

SEQ ID NO: 31086 - protein, 5 aa, Artificial Sequence
  Description of Artificial Sequence: Synthetic peptide
  XENP021134 vhCDR1
DAWMD

SEQ ID NO: 31087 - protein, 19 aa, Artificial Sequence
  Description of Artificial Sequence: Synthetic peptide
  XENP021134 vhCDR2
EIRTKANNHATYYAESVKG

SEQ ID NO: 31088 - protein, 10 aa, Artificial Sequence
  Description of Artificial Sequence: Synthetic peptide
  XENP021134 vhCDR3
LANWDWYFDV

SEQ ID NO: 31089 - protein, 218 aa, Artificial Sequence; identical to SEQ ID NO: 20260
  Description of Artificial Sequence: Synthetic polypeptide
  XENP021134 7G8_H0_L0.57_Fab Light Chain

SEQ ID NO: 31090 - protein, 111 aa, Artificial Sequence; identical to SEQ ID NO: 20261
  Description of Artificial Sequence: Synthetic polypeptide
  VL of XENP021134

SEQ ID NO: 31091 - protein, 15 aa, Artificial Sequence
  Description of Artificial Sequence: Synthetic peptide
  XENP021134 vlCDR1
KASQSVDYDGDSYMN

SEQ ID NO: 31092 - protein, 7 aa, Artificial Sequence
  Description of Artificial Sequence: Synthetic peptide
  XENP021134 vlCDR2
AASDLES

SEQ ID NO: 31093 - protein, 9 aa, Artificial Sequence
  Description of Artificial Sequence: Synthetic peptide
  XENP021134 vlCDR3
QQSNEDPFT

SEQ ID NO: 31094 - protein, 226 aa, Artificial Sequence; identical to SEQ ID NO: 29134
  Description of Artificial Sequence: Synthetic polypeptide
  XENP021135 7G8_H0_L0.58_Fab Heavy Chain

SEQ ID NO: 31095 - protein, 121 aa, Artificial Sequence; identical to SEQ ID NO: 17586
  Description of Artificial Sequence: Synthetic polypeptide
  VH of XENP021135

SEQ ID NO: 31096 - protein, 5 aa, Artificial Sequence
  Description of Artificial Sequence: Synthetic peptide
  XENP021135 vhCDR1
DAWMD

SEQ ID NO: 31097 - protein, 19 aa, Artificial Sequence
  Description of Artificial Sequence: Synthetic peptide
  XENP021135 vhCDR2
EIRTKANNHATYYAESVKG

SEQ ID NO: 31098 - protein, 10 aa, Artificial Sequence
  Description of Artificial Sequence: Synthetic peptide
  XENP021135 vhCDR3
LANWDWYFDV

SEQ ID NO: 31099 - protein, 218 aa, Artificial Sequence; identical to SEQ ID NO: 20270
  Description of Artificial Sequence: Synthetic polypeptide
  XENP021135 7G8_H0_L0.58_Fab Light Chain

SEQ ID NO: 31100 - protein, 111 aa, Artificial Sequence; identical to SEQ ID NO: 20271
  Description of Artificial Sequence: Synthetic polypeptide
  VL of XENP021135

SEQ ID NO: 31101 - protein, 15 aa, Artificial Sequence
  Description of Artificial Sequence: Synthetic peptide
  XENP021135 vlCDR1
KASQSVDYDGDSYMN

SEQ ID NO: 31102 - protein, 7 aa, Artificial Sequence
  Description of Artificial Sequence: Synthetic peptide
  XENP021135 vlCDR2
AASHLES

SEQ ID NO: 31103 - protein, 9 aa, Artificial Sequence
  Description of Artificial Sequence: Synthetic peptide
  XENP021135 vlCDR3
QQSNEDPFT

SEQ ID NO: 31104 - protein, 226 aa, Artificial Sequence; identical to SEQ ID NO: 29134
  Description of Artificial Sequence: Synthetic polypeptide
  XENP021136 7G8_H0_L0.59_Fab Heavy Chain

SEQ ID NO: 31105 - protein, 121 aa, Artificial Sequence; identical to SEQ ID NO: 17586
  Description of Artificial Sequence: Synthetic polypeptide
  VH of XENP021136

SEQ ID NO: 31106 - protein, 5 aa, Artificial Sequence
  Description of Artificial Sequence: Synthetic peptide
  XENP021136 vhCDR1
DAWMD

SEQ ID NO: 31107 - protein, 19 aa, Artificial Sequence
  Description of Artificial Sequence: Synthetic peptide
  XENP021136 vhCDR2
EIRTKANNHATYYAESVKG

SEQ ID NO: 31108 - protein, 10 aa, Artificial Sequence
  Description of Artificial Sequence: Synthetic peptide
  XENP021136 vhCDR3
LANWDWYFDV

SEQ ID NO: 31109 - protein, 218 aa, Artificial Sequence; identical to SEQ ID NO: 20280
  Description of Artificial Sequence: Synthetic polypeptide
  XENP021136 7G8_H0_L0.59_Fab Light Chain

SEQ ID NO: 31110 - protein, 111 aa, Artificial Sequence; identical to SEQ ID NO: 20281
  Description of Artificial Sequence: Synthetic polypeptide
  VL of XENP021136

SEQ ID NO: 31111 - protein, 15 aa, Artificial Sequence
  Description of Artificial Sequence: Synthetic peptide
  XENP021136 vlCDR1
KASQSVDYDGDSYMN

SEQ ID NO: 31112 - protein, 7 aa, Artificial Sequence
  Description of Artificial Sequence: Synthetic peptide
  XENP021136 vlCDR2
AASELES

SEQ ID NO: 31113 - protein, 9 aa, Artificial Sequence
  Description of Artificial Sequence: Synthetic peptide
  XENP021136 vlCDR3
QQSNEDPFT

SEQ ID NO: 31114 - protein, 226 aa, Artificial Sequence; identical to SEQ ID NO: 29134
  Description of Artificial Sequence: Synthetic polypeptide
  XENP021137 7G8_H0_L0.60_Fab Heavy Chain

SEQ ID NO: 31115 - protein, 121 aa, Artificial Sequence; identical to SEQ ID NO: 17586
  Description of Artificial Sequence: Synthetic polypeptide
  VH of XENP021137

SEQ ID NO: 31116 - protein, 5 aa, Artificial Sequence
  Description of Artificial Sequence: Synthetic peptide
  XENP021137 vhCDR1
DAWMD

SEQ ID NO: 31117 - protein, 19 aa, Artificial Sequence
  Description of Artificial Sequence: Synthetic peptide
  XENP021137 vhCDR2
EIRTKANNHATYYAESVKG

SEQ ID NO: 31118 - protein, 10 aa, Artificial Sequence
  Description of Artificial Sequence: Synthetic peptide
  XENP021137 vhCDR3
LANWDWYFDV

SEQ ID NO: 31119 - protein, 218 aa, Artificial Sequence; identical to SEQ ID NO: 20290
  Description of Artificial Sequence: Synthetic polypeptide
  XENP021137 7G8_H0_L0.60_Fab Light Chain

SEQ ID NO: 31120 - protein, 111 aa, Artificial Sequence; identical to SEQ ID NO: 20291
  Description of Artificial Sequence: Synthetic polypeptide
  VL of XENP021137

SEQ ID NO: 31121 - protein, 15 aa, Artificial Sequence
  Description of Artificial Sequence: Synthetic peptide
  XENP021137 vlCDR1
KASQSVDYDGDSYMN

SEQ ID NO: 31122 - protein, 7 aa, Artificial Sequence
  Description of Artificial Sequence: Synthetic peptide
  XENP021137 vlCDR2
AASSLES

SEQ ID NO: 31123 - protein, 9 aa, Artificial Sequence
  Description of Artificial Sequence: Synthetic peptide
  XENP021137 vlCDR3
QQSNEDPFT

SEQ ID NO: 31124 - protein, 226 aa, Artificial Sequence; identical to SEQ ID NO: 29134
  Description of Artificial Sequence: Synthetic polypeptide
  XENP021138 7G8_H0_L0.61_Fab Heavy Chain

SEQ ID NO: 31125 - protein, 121 aa, Artificial Sequence; identical to SEQ ID NO: 17586
  Description of Artificial Sequence: Synthetic polypeptide
  VH of XENP021138

SEQ ID NO: 31126 - protein, 5 aa, Artificial Sequence
  Description of Artificial Sequence: Synthetic peptide
  XENP021138 vhCDR1
DAWMD

SEQ ID NO: 31127 - protein, 19 aa, Artificial Sequence
  Description of Artificial Sequence: Synthetic peptide
  XENP021138 vhCDR2
EIRTKANNHATYYAESVKG

SEQ ID NO: 31128 - protein, 10 aa, Artificial Sequence
  Description of Artificial Sequence: Synthetic peptide
  XENP021138 vhCDR3
LANWDWYFDV

SEQ ID NO: 31129 - protein, 218 aa, Artificial Sequence; identical to SEQ ID NO: 20300
  Description of Artificial Sequence: Synthetic polypeptide
  XENP021138 7G8_H0_L0.61_Fab Light Chain

SEQ ID NO: 31130 - protein, 111 aa, Artificial Sequence; identical to SEQ ID NO: 20301
  Description of Artificial Sequence: Synthetic polypeptide
  VL of XENP021138

SEQ ID NO: 31131 - protein, 15 aa, Artificial Sequence
  Description of Artificial Sequence: Synthetic peptide
  XENP021138 vlCDR1
KASQSVDYDGDSYMN

SEQ ID NO: 31132 - protein, 7 aa, Artificial Sequence
  Description of Artificial Sequence: Synthetic peptide
  XENP021138 vlCDR2
AASRLES

SEQ ID NO: 31133 - protein, 9 aa, Artificial Sequence
  Description of Artificial Sequence: Synthetic peptide
  XENP021138 vlCDR3
QQSNEDPFT

SEQ ID NO: 31134 - protein, 226 aa, Artificial Sequence; identical to SEQ ID NO: 29134
  Description of Artificial Sequence: Synthetic polypeptide
  XENP021139 7G8_H0_L0.62_Fab Heavy Chain

SEQ ID NO: 31135 - protein, 121 aa, Artificial Sequence; identical to SEQ ID NO: 17586
  Description of Artificial Sequence: Synthetic polypeptide
  VH of XENP021139

SEQ ID NO: 31136 - protein, 5 aa, Artificial Sequence
  Description of Artificial Sequence: Synthetic peptide
  XENP021139 vhCDR1
DAWMD

SEQ ID NO: 31137 - protein, 19 aa, Artificial Sequence
  Description of Artificial Sequence: Synthetic peptide
  XENP021139 vhCDR2
EIRTKANNHATYYAESVKG

SEQ ID NO: 31138 - protein, 10 aa, Artificial Sequence
  Description of Artificial Sequence: Synthetic peptide
  XENP021139 vhCDR3
LANWDWYFDV

SEQ ID NO: 31139 - protein, 218 aa, Artificial Sequence; identical to SEQ ID NO: 20310
  Description of Artificial Sequence: Synthetic polypeptide
  XENP021139 7G8_H0_L0.62_Fab Light Chain

SEQ ID NO: 31140 - protein, 111 aa, Artificial Sequence; identical to SEQ ID NO: 20311
  Description of Artificial Sequence: Synthetic polypeptide
  VL of XENP021139

SEQ ID NO: 31141 - protein, 15 aa, Artificial Sequence
  Description of Artificial Sequence: Synthetic peptide
  XENP021139 vlCDR1
KASQSVDYDGDSYMN

SEQ ID NO: 31142 - protein, 7 aa, Artificial Sequence
  Description of Artificial Sequence: Synthetic peptide
  XENP021139 vlCDR2
AASLLES

SEQ ID NO: 31143 - protein, 9 aa, Artificial Sequence
  Description of Artificial Sequence: Synthetic peptide
  XENP021139 vlCDR3
QQSNEDPFT

SEQ ID NO: 31144 - protein, 226 aa, Artificial Sequence; identical to SEQ ID NO: 29134
  Description of Artificial Sequence: Synthetic polypeptide
  XENP021140 7G8_H0_L0.63_Fab Heavy Chain

SEQ ID NO: 31145 - protein, 121 aa, Artificial Sequence; identical to SEQ ID NO: 17586
  Description of Artificial Sequence: Synthetic polypeptide
  VH of XENP021140

SEQ ID NO: 31146 - protein, 5 aa, Artificial Sequence
  Description of Artificial Sequence: Synthetic peptide
  XENP021140 vhCDR1
DAWMD

SEQ ID NO: 31147 - protein, 19 aa, Artificial Sequence
  Description of Artificial Sequence: Synthetic peptide
  XENP021140 vhCDR2
EIRTKANNHATYYAESVKG

SEQ ID NO: 31148 - protein, 10 aa, Artificial Sequence
  Description of Artificial Sequence: Synthetic peptide
  XENP021140 vhCDR3
LANWDWYFDV

SEQ ID NO: 31149 - protein, 218 aa, Artificial Sequence; identical to SEQ ID NO: 20320
  Description of Artificial Sequence: Synthetic polypeptide
  XENP021140 7G8_H0_L0.63_Fab Light Chain

SEQ ID NO: 31150 - protein, 111 aa, Artificial Sequence; identical to SEQ ID NO: 20321
  Description of Artificial Sequence: Synthetic polypeptide
  VL of XENP021140

SEQ ID NO: 31151 - protein, 15 aa, Artificial Sequence
  Description of Artificial Sequence: Synthetic peptide
  XENP021140 vlCDR1
KASQSVDYDGDSYMN

SEQ ID NO: 31152 - protein, 7 aa, Artificial Sequence
  Description of Artificial Sequence: Synthetic peptide
  XENP021140 vlCDR2
AASTLES

SEQ ID NO: 31153 - protein, 9 aa, Artificial Sequence
  Description of Artificial Sequence: Synthetic peptide
  XENP021140 vlCDR3
QQSNEDPFT

SEQ ID NO: 31154 - protein, 226 aa, Artificial Sequence; identical to SEQ ID NO: 29134
  Description of Artificial Sequence: Synthetic polypeptide
  XENP021141 7G8_H0_L0.64_Fab Heavy Chain

SEQ ID NO: 31155 - protein, 121 aa, Artificial Sequence; identical to SEQ ID NO: 17586
  Description of Artificial Sequence: Synthetic polypeptide
  VH of XENP021141

SEQ ID NO: 31156 - protein, 5 aa, Artificial Sequence
  Description of Artificial Sequence: Synthetic peptide
  XENP021141 vhCDR1
DAWMD

SEQ ID NO: 31157 - protein, 19 aa, Artificial Sequence
  Description of Artificial Sequence: Synthetic peptide
  XENP021141 vhCDR2
EIRTKANNHATYYAESVKG

SEQ ID NO: 31158 - protein, 10 aa, Artificial Sequence
  Description of Artificial Sequence: Synthetic peptide
  XENP021141 vhCDR3
LANWDWYFDV

SEQ ID NO: 31159 - protein, 218 aa, Artificial Sequence; identical to SEQ ID NO: 20330
  Description of Artificial Sequence: Synthetic polypeptide
  XENP021141 7G8_H0_L0.64_Fab Light Chain

SEQ ID NO: 31160 - protein, 111 aa, Artificial Sequence; identical to SEQ ID NO: 20331
  Description of Artificial Sequence: Synthetic polypeptide
  VL of XENP021141

SEQ ID NO: 31161 - protein, 15 aa, Artificial Sequence
  Description of Artificial Sequence: Synthetic peptide
  XENP021141 vlCDR1
KASQSVDYDGDSYMN

SEQ ID NO: 31162 - protein, 7 aa, Artificial Sequence
  Description of Artificial Sequence: Synthetic peptide
  XENP021141 vlCDR2
AASGLES

SEQ ID NO: 31163 - protein, 9 aa, Artificial Sequence
  Description of Artificial Sequence: Synthetic peptide
  XENP021141 vlCDR3
QQSNEDPFT

SEQ ID NO: 31164 - protein, 226 aa, Artificial Sequence; identical to SEQ ID NO: 29134
  Description of Artificial Sequence: Synthetic polypeptide
  XENP021142 7G8_H0_L0.65_Fab Heavy Chain

SEQ ID NO: 31165 - protein, 121 aa, Artificial Sequence; identical to SEQ ID NO: 17586
  Description of Artificial Sequence: Synthetic polypeptide
  VH of XENP021142

SEQ ID NO: 31166 - protein, 5 aa, Artificial Sequence
  Description of Artificial Sequence: Synthetic peptide
  XENP021142 vhCDR1
DAWMD

SEQ ID NO: 31167 - protein, 19 aa, Artificial Sequence
  Description of Artificial Sequence: Synthetic peptide
  XENP021142 vhCDR2
EIRTKANNHATYYAESVKG

SEQ ID NO: 31168 - protein, 10 aa, Artificial Sequence
  Description of Artificial Sequence: Synthetic peptide
  XENP021142 vhCDR3
LANWDWYFDV

SEQ ID NO: 31169 - protein, 218 aa, Artificial Sequence; identical to SEQ ID NO: 20340
  Description of Artificial Sequence: Synthetic polypeptide
  XENP021142 7G8_H0_L0.65_Fab Light Chain

SEQ ID NO: 31170 - protein, 111 aa, Artificial Sequence; identical to SEQ ID NO: 20341
  Description of Artificial Sequence: Synthetic polypeptide
  VL of XENP021142

SEQ ID NO: 31171 - protein, 15 aa, Artificial Sequence
  Description of Artificial Sequence: Synthetic peptide
  XENP021142 vlCDR1
KASQSVDYDGDSYMN

SEQ ID NO: 31172 - protein, 7 aa, Artificial Sequence
  Description of Artificial Sequence: Synthetic peptide
  XENP021142 vlCDR2
AASYLES

SEQ ID NO: 31173 - protein, 9 aa, Artificial Sequence
  Description of Artificial Sequence: Synthetic peptide
  XENP021142 vlCDR3
QQSNEDPFT

SEQ ID NO: 31174 - protein, 226 aa, Artificial Sequence; identical to SEQ ID NO: 29134
  Description of Artificial Sequence: Synthetic polypeptide
  XENP021143 7G8_H0_L0.66_Fab Heavy Chain

SEQ ID NO: 31175 - protein, 121 aa, Artificial Sequence; identical to SEQ ID NO: 17586
  Description of Artificial Sequence: Synthetic polypeptide
  VH of XENP021143

SEQ ID NO: 31176 - protein, 5 aa, Artificial Sequence
  Description of Artificial Sequence: Synthetic peptide
  XENP021143 vhCDR1
DAWMD

SEQ ID NO: 31177 - protein, 19 aa, Artificial Sequence
  Description of Artificial Sequence: Synthetic peptide
  XENP021143 vhCDR2
EIRTKANNHATYYAESVKG

SEQ ID NO: 31178 - protein, 10 aa, Artificial Sequence
  Description of Artificial Sequence: Synthetic peptide
  XENP021143 vhCDR3
LANWDWYFDV

SEQ ID NO: 31179 - protein, 218 aa, Artificial Sequence; identical to SEQ ID NO: 20350
  Description of Artificial Sequence: Synthetic polypeptide
  XENP021143 7G8_H0_L0.66_Fab Light Chain

SEQ ID NO: 31180 - protein, 111 aa, Artificial Sequence; identical to SEQ ID NO: 20351
  Description of Artificial Sequence: Synthetic polypeptide
  VL of XENP021143

SEQ ID NO: 31181 - protein, 15 aa, Artificial Sequence
  Description of Artificial Sequence: Synthetic peptide
  XENP021143 vlCDR1
KASQSVDYDGDSYMN

SEQ ID NO: 31182 - protein, 7 aa, Artificial Sequence
  Description of Artificial Sequence: Synthetic peptide
  XENP021143 vlCDR2
AASNLQS

SEQ ID NO: 31183 - protein, 9 aa, Artificial Sequence
  Description of Artificial Sequence: Synthetic peptide
  XENP021143 vlCDR3
QQSNEDPFT

SEQ ID NO: 31184 - protein, 226 aa, Artificial Sequence; identical to SEQ ID NO: 29134
  Description of Artificial Sequence: Synthetic polypeptide
  XENP021144 7G8_H0_L0.67_Fab Heavy Chain

SEQ ID NO: 31185 - protein, 121 aa, Artificial Sequence; identical to SEQ ID NO: 17586
  Description of Artificial Sequence: Synthetic polypeptide
  VH of XENP021144

SEQ ID NO: 31186 - protein, 5 aa, Artificial Sequence
  Description of Artificial Sequence: Synthetic peptide
  XENP021144 vhCDR1
DAWMD

SEQ ID NO: 31187 - protein, 19 aa, Artificial Sequence
  Description of Artificial Sequence: Synthetic peptide
  XENP021144 vhCDR2
EIRTKANNHATYYAESVKG

SEQ ID NO: 31188 - protein, 10 aa, Artificial Sequence
  Description of Artificial Sequence: Synthetic peptide
  XENP021144 vhCDR3
LANWDWYFDV

SEQ ID NO: 31189 - protein, 218 aa, Artificial Sequence; identical to SEQ ID NO: 20360
  Description of Artificial Sequence: Synthetic polypeptide
  XENP021144 7G8_H0_L0.67_Fab Light Chain

SEQ ID NO: 31190 - protein, 111 aa, Artificial Sequence; identical to SEQ ID NO: 20361
  Description of Artificial Sequence: Synthetic polypeptide
  VL of XENP021144

SEQ ID NO: 31191 - protein, 15 aa, Artificial Sequence
  Description of Artificial Sequence: Synthetic peptide
  XENP021144 vlCDR1
KASQSVDYDGDSYMN

SEQ ID NO: 31192 - protein, 7 aa, Artificial Sequence
  Description of Artificial Sequence: Synthetic peptide
  XENP021144 vlCDR2
AASNLDS

SEQ ID NO: 31193 - protein, 9 aa, Artificial Sequence
  Description of Artificial Sequence: Synthetic peptide
  XENP021144 vlCDR3
QQSNEDPFT

SEQ ID NO: 31194 - protein, 226 aa, Artificial Sequence; identical to SEQ ID NO: 29134
  Description of Artificial Sequence: Synthetic polypeptide
  XENP021145 7G8_H0_L0.68_Fab Heavy Chain

SEQ ID NO: 31195 - protein, 121 aa, Artificial Sequence; identical to SEQ ID NO: 17586
  Description of Artificial Sequence: Synthetic polypeptide
  VH of XENP021145

SEQ ID NO: 31196 - protein, 5 aa, Artificial Sequence
  Description of Artificial Sequence: Synthetic peptide
  XENP021145 vhCDR1
DAWMD

SEQ ID NO: 31197 - protein, 19 aa, Artificial Sequence
  Description of Artificial Sequence: Synthetic peptide
  XENP021145 vhCDR2
EIRTKANNHATYYAESVKG

SEQ ID NO: 31198 - protein, 10 aa, Artificial Sequence
  Description of Artificial Sequence: Synthetic peptide
  XENP021145 vhCDR3
LANWDWYFDV

SEQ ID NO: 31199 - protein, 218 aa, Artificial Sequence; identical to SEQ ID NO: 20370
  Description of Artificial Sequence: Synthetic polypeptide
  XENP021145 7G8_H0_L0.68_Fab Light Chain

SEQ ID NO: 31200 - protein, 111 aa, Artificial Sequence; identical to SEQ ID NO: 20371
  Description of Artificial Sequence: Synthetic polypeptide
  VL of XENP021145

SEQ ID NO: 31201 - protein, 15 aa, Artificial Sequence
  Description of Artificial Sequence: Synthetic peptide
  XENP021145 vlCDR1
KASQSVDYDGDSYMN

SEQ ID NO: 31202 - protein, 7 aa, Artificial Sequence
  Description of Artificial Sequence: Synthetic peptide
  XENP021145 vlCDR2
AASNLKS

SEQ ID NO: 31203 - protein, 9 aa, Artificial Sequence
  Description of Artificial Sequence: Synthetic peptide
  XENP021145 vlCDR3
QQSNEDPFT

SEQ ID NO: 31204 - protein, 226 aa, Artificial Sequence; identical to SEQ ID NO: 29134
  Description of Artificial Sequence: Synthetic polypeptide
  XENP021146 7G8_H0_L0.69_Fab Heavy Chain

SEQ ID NO: 31205 - protein, 121 aa, Artificial Sequence; identical to SEQ ID NO: 17586
  Description of Artificial Sequence: Synthetic polypeptide
  VH of XENP021146

SEQ ID NO: 31206 - protein, 5 aa, Artificial Sequence
  Description of Artificial Sequence: Synthetic peptide
  XENP021146 vhCDR1
DAWMD

SEQ ID NO: 31207 - protein, 19 aa, Artificial Sequence
  Description of Artificial Sequence: Synthetic peptide
  XENP021146 vhCDR2
EIRTKANNHATYYAESVKG

SEQ ID NO: 31208 - protein, 10 aa, Artificial Sequence
  Description of Artificial Sequence: Synthetic peptide
  XENP021146 vhCDR3
LANWDWYFDV

SEQ ID NO: 31209 - protein, 218 aa, Artificial Sequence; identical to SEQ ID NO: 20380
  Description of Artificial Sequence: Synthetic polypeptide
  XENP021146 7G8_H0_L0.69_Fab Light Chain

SEQ ID NO: 31210 - protein, 111 aa, Artificial Sequence; identical to SEQ ID NO: 20381
  Description of Artificial Sequence: Synthetic polypeptide
  VL of XENP021146

SEQ ID NO: 31211 - protein, 15 aa, Artificial Sequence
  Description of Artificial Sequence: Synthetic peptide
  XENP021146 vlCDR1
KASQSVDYDGDSYMN

SEQ ID NO: 31212 - protein, 7 aa, Artificial Sequence
  Description of Artificial Sequence: Synthetic peptide
  XENP021146 vlCDR2
AASNLHS

SEQ ID NO: 31213 - protein, 9 aa, Artificial Sequence
  Description of Artificial Sequence: Synthetic peptide
  XENP021146 vlCDR3
QQSNEDPFT

SEQ ID NO: 31214 - protein, 226 aa, Artificial Sequence; identical to SEQ ID NO: 29134
  Description of Artificial Sequence: Synthetic polypeptide
  XENP021147 7G8_H0_L0.70_Fab Heavy Chain

SEQ ID NO: 31215 - protein, 121 aa, Artificial Sequence; identical to SEQ ID NO: 17586
  Description of Artificial Sequence: Synthetic polypeptide
  VH of XENP021147

SEQ ID NO: 31216 - protein, 5 aa, Artificial Sequence
  Description of Artificial Sequence: Synthetic peptide
  XENP021147 vhCDR1
DAWMD

SEQ ID NO: 31217 - protein, 19 aa, Artificial Sequence
  Description of Artificial Sequence: Synthetic peptide
  XENP021147 vhCDR2
EIRTKANNHATYYAESVKG

SEQ ID NO: 31218 - protein, 10 aa, Artificial Sequence
  Description of Artificial Sequence: Synthetic peptide
  XENP021147 vhCDR3
LANWDWYFDV

SEQ ID NO: 31219 - protein, 218 aa, Artificial Sequence; identical to SEQ ID NO: 20390
  Description of Artificial Sequence: Synthetic polypeptide
  XENP021147 7G8_H0_L0.70_Fab Light Chain

SEQ ID NO: 31220 - protein, 111 aa, Artificial Sequence; identical to SEQ ID NO: 20391
  Description of Artificial Sequence: Synthetic polypeptide
  VL of XENP021147

SEQ ID NO: 31221 - protein, 15 aa, Artificial Sequence
  Description of Artificial Sequence: Synthetic peptide
  XENP021147 vlCDR1
KASQSVDYDGDSYMN

SEQ ID NO: 31222 - protein, 7 aa, Artificial Sequence
  Description of Artificial Sequence: Synthetic peptide
  XENP021147 vlCDR2
AASNLAS

SEQ ID NO: 31223 - protein, 9 aa, Artificial Sequence
  Description of Artificial Sequence: Synthetic peptide
  XENP021147 vlCDR3
QQSNEDPFT

SEQ ID NO: 31224 - protein, 226 aa, Artificial Sequence; identical to SEQ ID NO: 29134
  Description of Artificial Sequence: Synthetic polypeptide
  XENP021148 7G8_H0_L0.71_Fab Heavy Chain

SEQ ID NO: 31225 - protein, 121 aa, Artificial Sequence; identical to SEQ ID NO: 17586
  Description of Artificial Sequence: Synthetic polypeptide
  VH of XENP021148

SEQ ID NO: 31226 - protein, 5 aa, Artificial Sequence
  Description of Artificial Sequence: Synthetic peptide
  XENP021148 vhCDR1
DAWMD

SEQ ID NO: 31227 - protein, 19 aa, Artificial Sequence
  Description of Artificial Sequence: Synthetic peptide
  XENP021148 vhCDR2
EIRTKANNHATYYAESVKG

SEQ ID NO: 31228 - protein, 10 aa, Artificial Sequence
  Description of Artificial Sequence: Synthetic peptide
  XENP021148 vhCDR3
LANWDWYFDV

SEQ ID NO: 31229 - protein, 218 aa, Artificial Sequence; identical to SEQ ID NO: 20400
  Description of Artificial Sequence: Synthetic polypeptide
  XENP021148 7G8_H0_L0.71_Fab Light Chain

SEQ ID NO: 31230 - protein, 111 aa, Artificial Sequence; identical to SEQ ID NO: 20401
  Description of Artificial Sequence: Synthetic polypeptide
  VL of XENP021148

SEQ ID NO: 31231 - protein, 15 aa, Artificial Sequence
  Description of Artificial Sequence: Synthetic peptide
  XENP021148 vlCDR1
KASQSVDYDGDSYMN

SEQ ID NO: 31232 - protein, 7 aa, Artificial Sequence
  Description of Artificial Sequence: Synthetic peptide
  XENP021148 vlCDR2
AASNLGS

SEQ ID NO: 31233 - protein, 9 aa, Artificial Sequence
  Description of Artificial Sequence: Synthetic peptide
  XENP021148 vlCDR3
QQSNEDPFT

SEQ ID NO: 31234 - protein, 226 aa, Artificial Sequence; identical to SEQ ID NO: 29134
  Description of Artificial Sequence: Synthetic polypeptide
  XENP021149 7G8_H0_L0.72_Fab Heavy Chain

SEQ ID NO: 31235 - protein, 121 aa, Artificial Sequence; identical to SEQ ID NO: 17586
  Description of Artificial Sequence: Synthetic polypeptide
  VH of XENP021149

SEQ ID NO: 31236 - protein, 5 aa, Artificial Sequence
  Description of Artificial Sequence: Synthetic peptide
  XENP021149 vhCDR1
DAWMD

SEQ ID NO: 31237 - protein, 19 aa, Artificial Sequence
  Description of Artificial Sequence: Synthetic peptide
  XENP021149 vhCDR2
EIRTKANNHATYYAESVKG

SEQ ID NO: 31238 - protein, 10 aa, Artificial Sequence
  Description of Artificial Sequence: Synthetic peptide
  XENP021149 vhCDR3
LANWDWYFDV

SEQ ID NO: 31239 - protein, 218 aa, Artificial Sequence; identical to SEQ ID NO: 20410
  Description of Artificial Sequence: Synthetic polypeptide
  XENP021149 7G8_H0_L0.72_Fab Light Chain

SEQ ID NO: 31240 - protein, 111 aa, Artificial Sequence; identical to SEQ ID NO: 20411
  Description of Artificial Sequence: Synthetic polypeptide
  VL of XENP021149

SEQ ID NO: 31241 - protein, 15 aa, Artificial Sequence
  Description of Artificial Sequence: Synthetic peptide
  XENP021149 vlCDR1
KASQSVDYDGDSYMN

SEQ ID NO: 31242 - protein, 7 aa, Artificial Sequence
  Description of Artificial Sequence: Synthetic peptide
  XENP021149 vlCDR2
AASNLYS

SEQ ID NO: 31243 - protein, 9 aa, Artificial Sequence
  Description of Artificial Sequence: Synthetic peptide
  XENP021149 vlCDR3
QQSNEDPFT

SEQ ID NO: 31244 - protein, 226 aa, Artificial Sequence; identical to SEQ ID NO: 29134
  Description of Artificial Sequence: Synthetic polypeptide
  XENP021150 7G8_H0_L0.73_Fab Heavy Chain

SEQ ID NO: 31245 - protein, 121 aa, Artificial Sequence; identical to SEQ ID NO: 17586
  Description of Artificial Sequence: Synthetic polypeptide
  VH of XENP021150

SEQ ID NO: 31246 - protein, 5 aa, Artificial Sequence
  Description of Artificial Sequence: Synthetic peptide
  XENP021150 vhCDR1
DAWMD

SEQ ID NO: 31247 - protein, 19 aa, Artificial Sequence
  Description of Artificial Sequence: Synthetic peptide
  XENP021150 vhCDR2
EIRTKANNHATYYAESVKG

SEQ ID NO: 31248 - protein, 10 aa, Artificial Sequence
  Description of Artificial Sequence: Synthetic peptide
  XENP021150 vhCDR3
LANWDWYFDV

SEQ ID NO: 31249 - protein, 218 aa, Artificial Sequence; identical to SEQ ID NO: 20420
  Description of Artificial Sequence: Synthetic polypeptide
  XENP021150 7G8_H0_L0.73_Fab Light Chain

SEQ ID NO: 31250 - protein, 111 aa, Artificial Sequence; identical to SEQ ID NO: 20421
  Description of Artificial Sequence: Synthetic polypeptide
  VL of XENP021150

SEQ ID NO: 31251 - protein, 15 aa, Artificial Sequence
  Description of Artificial Sequence: Synthetic peptide
  XENP021150 vlCDR1
KASQSVDYDGDSYMN

SEQ ID NO: 31252 - protein, 7 aa, Artificial Sequence
  Description of Artificial Sequence: Synthetic peptide
  XENP021150 vlCDR2
AASNLIS

SEQ ID NO: 31253 - protein, 9 aa, Artificial Sequence
  Description of Artificial Sequence: Synthetic peptide
  XENP021150 vlCDR3
QQSNEDPFT

SEQ ID NO: 31254 - protein, 226 aa, Artificial Sequence; identical to SEQ ID NO: 29134
  Description of Artificial Sequence: Synthetic polypeptide
  XENP021151 7G8_H0_L0.74_Fab Heavy Chain

SEQ ID NO: 31255 - protein, 121 aa, Artificial Sequence; identical to SEQ ID NO: 17586
  Description of Artificial Sequence: Synthetic polypeptide
  VH of XENP021151

SEQ ID NO: 31256 - protein, 5 aa, Artificial Sequence
  Description of Artificial Sequence: Synthetic peptide
  XENP021151 vhCDR1
DAWMD

SEQ ID NO: 31257 - protein, 19 aa, Artificial Sequence
  Description of Artificial Sequence: Synthetic peptide
  XENP021151 vhCDR2
EIRTKANNHATYYAESVKG

SEQ ID NO: 31258 - protein, 10 aa, Artificial Sequence
  Description of Artificial Sequence: Synthetic peptide
  XENP021151 vhCDR3
LANWDWYFDV

SEQ ID NO: 31259 - protein, 218 aa, Artificial Sequence; identical to SEQ ID NO: 20430
  Description of Artificial Sequence: Synthetic polypeptide
  XENP021151 7G8_H0_L0.74_Fab Light Chain

SEQ ID NO: 31260 - protein, 111 aa, Artificial Sequence; identical to SEQ ID NO: 20431
  Description of Artificial Sequence: Synthetic polypeptide
  VL of XENP021151

SEQ ID NO: 31261 - protein, 15 aa, Artificial Sequence
  Description of Artificial Sequence: Synthetic peptide
  XENP021151 vlCDR1
KASQSVDYDGDSYMN

SEQ ID NO: 31262 - protein, 7 aa, Artificial Sequence
  Description of Artificial Sequence: Synthetic peptide
  XENP021151 vlCDR2
AASNLES

SEQ ID NO: 31263 - protein, 9 aa, Artificial Sequence
  Description of Artificial Sequence: Synthetic peptide
  XENP021151 vlCDR3
QQTNEDPFT

SEQ ID NO: 31264 - protein, 226 aa, Artificial Sequence; identical to SEQ ID NO: 29134
  Description of Artificial Sequence: Synthetic polypeptide
  XENP021152 7G8_H0_L0.75_Fab Heavy Chain

SEQ ID NO: 31265 - protein, 121 aa, Artificial Sequence; identical to SEQ ID NO: 17586
  Description of Artificial Sequence: Synthetic polypeptide
  VH of XENP021152

SEQ ID NO: 31266 - protein, 5 aa, Artificial Sequence
  Description of Artificial Sequence: Synthetic peptide
  XENP021152 vhCDR1
DAWMD

SEQ ID NO: 31267 - protein, 19 aa, Artificial Sequence
  Description of Artificial Sequence: Synthetic peptide
  XENP021152 vhCDR2
EIRTKANNHATYYAESVKG

SEQ ID NO: 31268 - protein, 10 aa, Artificial Sequence
  Description of Artificial Sequence: Synthetic peptide
  XENP021152 vhCDR3
LANWDWYFDV

SEQ ID NO: 31269 - protein, 218 aa, Artificial Sequence; identical to SEQ ID NO: 20440
  Description of Artificial Sequence: Synthetic polypeptide
  XENP021152 7G8_H0_L0.75_Fab Light Chain

SEQ ID NO: 31270 - protein, 111 aa, Artificial Sequence; identical to SEQ ID NO: 20441
  Description of Artificial Sequence: Synthetic polypeptide
  VL of XENP021152

SEQ ID NO: 31271 - protein, 15 aa, Artificial Sequence
  Description of Artificial Sequence: Synthetic peptide
  XENP021152 vlCDR1
KASQSVDYDGDSYMN

SEQ ID NO: 31272 - protein, 7 aa, Artificial Sequence
  Description of Artificial Sequence: Synthetic peptide
  XENP021152 vlCDR2
AASNLES

SEQ ID NO: 31273 - protein, 9 aa, Artificial Sequence
  Description of Artificial Sequence: Synthetic peptide
  XENP021152 vlCDR3
QQANEDPFT

SEQ ID NO: 31274 - protein, 226 aa, Artificial Sequence; identical to SEQ ID NO: 29134
  Description of Artificial Sequence: Synthetic polypeptide
  XENP021153 7G8_H0_L0.76_Fab Heavy Chain

SEQ ID NO: 31275 - protein, 121 aa, Artificial Sequence; identical to SEQ ID NO: 17586
  Description of Artificial Sequence: Synthetic polypeptide
  VH of XENP021153

SEQ ID NO: 31276 - protein, 5 aa, Artificial Sequence
  Description of Artificial Sequence: Synthetic peptide
  XENP021153 vhCDR1
DAWMD

SEQ ID NO: 31277 - protein, 19 aa, Artificial Sequence
  Description of Artificial Sequence: Synthetic peptide
  XENP021153 vhCDR2
EIRTKANNHATYYAESVKG

SEQ ID NO: 31278 - protein, 10 aa, Artificial Sequence
  Description of Artificial Sequence: Synthetic peptide
  XENP021153 vhCDR3
LANWDWYFDV

SEQ ID NO: 31279 - protein, 218 aa, Artificial Sequence; identical to SEQ ID NO: 20450
  Description of Artificial Sequence: Synthetic polypeptide
  XENP021153 7G8_H0_L0.76_Fab Light Chain

SEQ ID NO: 31280 - protein, 111 aa, Artificial Sequence; identical to SEQ ID NO: 20451
  Description of Artificial Sequence: Synthetic polypeptide
  VL of XENP021153

SEQ ID NO: 31281 - protein, 15 aa, Artificial Sequence
  Description of Artificial Sequence: Synthetic peptide
  XENP021153 vlCDR1
KASQSVDYDGDSYMN

SEQ ID NO: 31282 - protein, 7 aa, Artificial Sequence
  Description of Artificial Sequence: Synthetic peptide
  XENP021153 vlCDR2
AASNLES

SEQ ID NO: 31283 - protein, 9 aa, Artificial Sequence
  Description of Artificial Sequence: Synthetic peptide
  XENP021153 vlCDR3
QQQNEDPFT

SEQ ID NO: 31284 - protein, 226 aa, Artificial Sequence; identical to SEQ ID NO: 29134
  Description of Artificial Sequence: Synthetic polypeptide
  XENP021154 7G8_H0_L0.77_Fab Heavy Chain

SEQ ID NO: 31285 - protein, 121 aa, Artificial Sequence; identical to SEQ ID NO: 17586
  Description of Artificial Sequence: Synthetic polypeptide
  VH of XENP021154

SEQ ID NO: 31286 - protein, 5 aa, Artificial Sequence
  Description of Artificial Sequence: Synthetic peptide
  XENP021154 vhCDR1
DAWMD

SEQ ID NO: 31287 - protein, 19 aa, Artificial Sequence
  Description of Artificial Sequence: Synthetic peptide
  XENP021154 vhCDR2
EIRTKANNHATYYAESVKG

SEQ ID NO: 31288 - protein, 10 aa, Artificial Sequence
  Description of Artificial Sequence: Synthetic peptide
  XENP021154 vhCDR3
LANWDWYFDV

SEQ ID NO: 31289 - protein, 218 aa, Artificial Sequence; identical to SEQ ID NO: 20460
  Description of Artificial Sequence: Synthetic polypeptide
  XENP021154 7G8_H0_L0.77_Fab Light Chain

SEQ ID NO: 31290 - protein, 111 aa, Artificial Sequence; identical to SEQ ID NO: 20461
  Description of Artificial Sequence: Synthetic polypeptide
  VL of XENP021154

SEQ ID NO: 31291 - protein, 15 aa, Artificial Sequence
  Description of Artificial Sequence: Synthetic peptide
  XENP021154 vlCDR1
KASQSVDYDGDSYMN

SEQ ID NO: 31292 - protein, 7 aa, Artificial Sequence
  Description of Artificial Sequence: Synthetic peptide
  XENP021154 vlCDR2
AASNLES

SEQ ID NO: 31293 - protein, 9 aa, Artificial Sequence
  Description of Artificial Sequence: Synthetic peptide
  XENP021154 vlCDR3
QQGNEDPFT

SEQ ID NO: 31294 - protein, 226 aa, Artificial Sequence; identical to SEQ ID NO: 29134
  Description of Artificial Sequence: Synthetic polypeptide
  XENP021155 7G8_H0_L0.78_Fab Heavy Chain

SEQ ID NO: 31295 - protein, 121 aa, Artificial Sequence; identical to SEQ ID NO: 17586
  Description of Artificial Sequence: Synthetic polypeptide
  VH of XENP021155

SEQ ID NO: 31296 - protein, 5 aa, Artificial Sequence
  Description of Artificial Sequence: Synthetic peptide
  XENP021155 vhCDR1
DAWMD

SEQ ID NO: 31297 - protein, 19 aa, Artificial Sequence
  Description of Artificial Sequence: Synthetic peptide
  XENP021155 vhCDR2
EIRTKANNHATYYAESVKG

SEQ ID NO: 31298 - protein, 10 aa, Artificial Sequence
  Description of Artificial Sequence: Synthetic peptide
  XENP021155 vhCDR3
LANWDWYFDV

SEQ ID NO: 31299 - protein, 218 aa, Artificial Sequence; identical to SEQ ID NO: 20470
  Description of Artificial Sequence: Synthetic polypeptide
  XENP021155 7G8_H0_L0.78_Fab Light Chain

SEQ ID NO: 31300 - protein, 111 aa, Artificial Sequence; identical to SEQ ID NO: 20471
  Description of Artificial Sequence: Synthetic polypeptide
  VL of XENP021155

SEQ ID NO: 31301 - protein, 15 aa, Artificial Sequence
  Description of Artificial Sequence: Synthetic peptide
  XENP021155 vlCDR1
KASQSVDYDGDSYMN

SEQ ID NO: 31302 - protein, 7 aa, Artificial Sequence
  Description of Artificial Sequence: Synthetic peptide
  XENP021155 vlCDR2
AASNLES

SEQ ID NO: 31303 - protein, 9 aa, Artificial Sequence
  Description of Artificial Sequence: Synthetic peptide
  XENP021155 vlCDR3
QQVNEDPFT

SEQ ID NO: 31304 - protein, 226 aa, Artificial Sequence; identical to SEQ ID NO: 29134
  Description of Artificial Sequence: Synthetic polypeptide
  XENP021156 7G8_H0_L0.79_Fab Heavy Chain

SEQ ID NO: 31305 - protein, 121 aa, Artificial Sequence; identical to SEQ ID NO: 17586
  Description of Artificial Sequence: Synthetic polypeptide
  VH of XENP021156

SEQ ID NO: 31306 - protein, 5 aa, Artificial Sequence
  Description of Artificial Sequence: Synthetic peptide
  XENP021156 vhCDR1
DAWMD

SEQ ID NO: 31307 - protein, 19 aa, Artificial Sequence
  Description of Artificial Sequence: Synthetic peptide
  XENP021156 vhCDR2
EIRTKANNHATYYAESVKG

SEQ ID NO: 31308 - protein, 10 aa, Artificial Sequence
  Description of Artificial Sequence: Synthetic peptide
  XENP021156 vhCDR3
LANWDWYFDV

SEQ ID NO: 31309 - protein, 218 aa, Artificial Sequence; identical to SEQ ID NO: 20480
  Description of Artificial Sequence: Synthetic polypeptide
  XENP021156 7G8_H0_L0.79_Fab Light Chain

SEQ ID NO: 31310 - protein, 111 aa, Artificial Sequence; identical to SEQ ID NO: 20481
  Description of Artificial Sequence: Synthetic polypeptide
  VL of XENP021156

SEQ ID NO: 31311 - protein, 15 aa, Artificial Sequence
  Description of Artificial Sequence: Synthetic peptide
  XENP021156 vlCDR1
KASQSVDYDGDSYMN

SEQ ID NO: 31312 - protein, 7 aa, Artificial Sequence
  Description of Artificial Sequence: Synthetic peptide
  XENP021156 vlCDR2
AASNLES

SEQ ID NO: 31313 - protein, 9 aa, Artificial Sequence
  Description of Artificial Sequence: Synthetic peptide
  XENP021156 vlCDR3
QQHNEDPFT

SEQ ID NO: 31314 - protein, 226 aa, Artificial Sequence; identical to SEQ ID NO: 29134
  Description of Artificial Sequence: Synthetic polypeptide
  XENP021157 7G8_H0_L0.80_Fab Heavy Chain

SEQ ID NO: 31315 - protein, 121 aa, Artificial Sequence; identical to SEQ ID NO: 17586
  Description of Artificial Sequence: Synthetic polypeptide
  VH of XENP021157

SEQ ID NO: 31316 - protein, 5 aa, Artificial Sequence
  Description of Artificial Sequence: Synthetic peptide
  XENP021157 vhCDR1
DAWMD

SEQ ID NO: 31317 - protein, 19 aa, Artificial Sequence
  Description of Artificial Sequence: Synthetic peptide
  XENP021157 vhCDR2
EIRTKANNHATYYAESVKG

SEQ ID NO: 31318 - protein, 10 aa, Artificial Sequence
  Description of Artificial Sequence: Synthetic peptide
  XENP021157 vhCDR3
LANWDWYFDV

SEQ ID NO: 31319 - protein, 218 aa, Artificial Sequence; identical to SEQ ID NO: 20490
  Description of Artificial Sequence: Synthetic polypeptide
  XENP021157 7G8_H0_L0.80_Fab Light Chain

SEQ ID NO: 31320 - protein, 111 aa, Artificial Sequence; identical to SEQ ID NO: 20491
  Description of Artificial Sequence: Synthetic polypeptide
  VL of XENP021157

SEQ ID NO: 31321 - protein, 15 aa, Artificial Sequence
  Description of Artificial Sequence: Synthetic peptide
  XENP021157 vlCDR1
KASQSVDYDGDSYMN

SEQ ID NO: 31322 - protein, 7 aa, Artificial Sequence
  Description of Artificial Sequence: Synthetic peptide
  XENP021157 vlCDR2
AASNLES

SEQ ID NO: 31323 - protein, 9 aa, Artificial Sequence
  Description of Artificial Sequence: Synthetic peptide
  XENP021157 vlCDR3
QQDNEDPFT

SEQ ID NO: 31324 - protein, 226 aa, Artificial Sequence; identical to SEQ ID NO: 29134
  Description of Artificial Sequence: Synthetic polypeptide
  XENP021158 7G8_H0_L0.81_Fab Heavy Chain

SEQ ID NO: 31325 - protein, 121 aa, Artificial Sequence; identical to SEQ ID NO: 17586
  Description of Artificial Sequence: Synthetic polypeptide
  VH of XENP021158

SEQ ID NO: 31326 - protein, 5 aa, Artificial Sequence
  Description of Artificial Sequence: Synthetic peptide
  XENP021158 vhCDR1
DAWMD

SEQ ID NO: 31327 - protein, 19 aa, Artificial Sequence
  Description of Artificial Sequence: Synthetic peptide
  XENP021158 vhCDR2
EIRTKANNHATYYAESVKG

SEQ ID NO: 31328 - protein, 10 aa, Artificial Sequence
  Description of Artificial Sequence: Synthetic peptide
  XENP021158 vhCDR3
LANWDWYFDV

SEQ ID NO: 31329 - protein, 218 aa, Artificial Sequence; identical to SEQ ID NO: 20500
  Description of Artificial Sequence: Synthetic polypeptide
  XENP021158 7G8_H0_L0.81_Fab Light Chain

SEQ ID NO: 31330 - protein, 111 aa, Artificial Sequence; identical to SEQ ID NO: 20501
  Description of Artificial Sequence: Synthetic polypeptide
  VL of XENP021158

SEQ ID NO: 31331 - protein, 15 aa, Artificial Sequence
  Description of Artificial Sequence: Synthetic peptide
  XENP021158 vlCDR1
KASQSVDYDGDSYMN

SEQ ID NO: 31332 - protein, 7 aa, Artificial Sequence
  Description of Artificial Sequence: Synthetic peptide
  XENP021158 vlCDR2
AASNLES

SEQ ID NO: 31333 - protein, 9 aa, Artificial Sequence
  Description of Artificial Sequence: Synthetic peptide
  XENP021158 vlCDR3
QQKNEDPFT

SEQ ID NO: 31334 - protein, 226 aa, Artificial Sequence; identical to SEQ ID NO: 29134
  Description of Artificial Sequence: Synthetic polypeptide
  XENP021159 7G8_H0_L0.82_Fab Heavy Chain

SEQ ID NO: 31335 - protein, 121 aa, Artificial Sequence; identical to SEQ ID NO: 17586
  Description of Artificial Sequence: Synthetic polypeptide
  VH of XENP021159

SEQ ID NO: 31336 - protein, 5 aa, Artificial Sequence
  Description of Artificial Sequence: Synthetic peptide
  XENP021159 vhCDR1
DAWMD

SEQ ID NO: 31337 - protein, 19 aa, Artificial Sequence
  Description of Artificial Sequence: Synthetic peptide
  XENP021159 vhCDR2
EIRTKANNHATYYAESVKG

SEQ ID NO: 31338 - protein, 10 aa, Artificial Sequence
  Description of Artificial Sequence: Synthetic peptide
  XENP021159 vhCDR3
LANWDWYFDV

SEQ ID NO: 31339 - protein, 218 aa, Artificial Sequence; identical to SEQ ID NO: 20510
  Description of Artificial Sequence: Synthetic polypeptide
  XENP021159 7G8_H0_L0.82_Fab Light Chain

SEQ ID NO: 31340 - protein, 111 aa, Artificial Sequence; identical to SEQ ID NO: 20511
  Description of Artificial Sequence: Synthetic polypeptide
  VL of XENP021159

SEQ ID NO: 31341 - protein, 15 aa, Artificial Sequence
  Description of Artificial Sequence: Synthetic peptide
  XENP021159 vlCDR1
KASQSVDYDGDSYMN

SEQ ID NO: 31342 - protein, 7 aa, Artificial Sequence
  Description of Artificial Sequence: Synthetic peptide
  XENP021159 vlCDR2
AASNLES

SEQ ID NO: 31343 - protein, 9 aa, Artificial Sequence
  Description of Artificial Sequence: Synthetic peptide
  XENP021159 vlCDR3
QQYNEDPFT

SEQ ID NO: 31344 - protein, 226 aa, Artificial Sequence; identical to SEQ ID NO: 29134
  Description of Artificial Sequence: Synthetic polypeptide
  XENP021160 7G8_H0_L0.83_Fab Heavy Chain

SEQ ID NO: 31345 - protein, 121 aa, Artificial Sequence; identical to SEQ ID NO: 17586
  Description of Artificial Sequence: Synthetic polypeptide
  VH of XENP021160

SEQ ID NO: 31346 - protein, 5 aa, Artificial Sequence
  Description of Artificial Sequence: Synthetic peptide
  XENP021160 vhCDR1
DAWMD

SEQ ID NO: 31347 - protein, 19 aa, Artificial Sequence
  Description of Artificial Sequence: Synthetic peptide
  XENP021160 vhCDR2
EIRTKANNHATYYAESVKG

SEQ ID NO: 31348 - protein, 10 aa, Artificial Sequence
  Description of Artificial Sequence: Synthetic peptide
  XENP021160 vhCDR3
LANWDWYFDV

SEQ ID NO: 31349 - protein, 218 aa, Artificial Sequence; identical to SEQ ID NO: 20520
  Description of Artificial Sequence: Synthetic polypeptide
  XENP021160 7G8_H0_L0.83_Fab Light Chain

SEQ ID NO: 31350 - protein, 111 aa, Artificial Sequence; identical to SEQ ID NO: 20521
  Description of Artificial Sequence: Synthetic polypeptide
  VL of XENP021160

SEQ ID NO: 31351 - protein, 15 aa, Artificial Sequence
  Description of Artificial Sequence: Synthetic peptide
  XENP021160 vlCDR1
KASQSVDYDGDSYMN

SEQ ID NO: 31352 - protein, 7 aa, Artificial Sequence
  Description of Artificial Sequence: Synthetic peptide
  XENP021160 vlCDR2
AASNLES

SEQ ID NO: 31353 - protein, 9 aa, Artificial Sequence
  Description of Artificial Sequence: Synthetic peptide
  XENP021160 vlCDR3
QQSDEDPFT

SEQ ID NO: 31354 - protein, 226 aa, Artificial Sequence; identical to SEQ ID NO: 29134
  Description of Artificial Sequence: Synthetic polypeptide
  XENP021161 7G8_H0_L0.84_Fab Heavy Chain

SEQ ID NO: 31355 - protein, 121 aa, Artificial Sequence; identical to SEQ ID NO: 17586
  Description of Artificial Sequence: Synthetic polypeptide
  VH of XENP021161

SEQ ID NO: 31356 - protein, 5 aa, Artificial Sequence
  Description of Artificial Sequence: Synthetic peptide
  XENP021161 vhCDR1
DAWMD

SEQ ID NO: 31357 - protein, 19 aa, Artificial Sequence
  Description of Artificial Sequence: Synthetic peptide
  XENP021161 vhCDR2
EIRTKANNHATYYAESVKG

SEQ ID NO: 31358 - protein, 10 aa, Artificial Sequence
  Description of Artificial Sequence: Synthetic peptide
  XENP021161 vhCDR3
LANWDWYFDV

SEQ ID NO: 31359 - protein, 218 aa, Artificial Sequence; identical to SEQ ID NO: 20530
  Description of Artificial Sequence: Synthetic polypeptide
  XENP021161 7G8_H0_L0.84_Fab Light Chain

SEQ ID NO: 31360 - protein, 111 aa, Artificial Sequence; identical to SEQ ID NO: 20531
  Description of Artificial Sequence: Synthetic polypeptide
  VL of XENP021161

SEQ ID NO: 31361 - protein, 15 aa, Artificial Sequence
  Description of Artificial Sequence: Synthetic peptide
  XENP021161 vlCDR1
KASQSVDYDGDSYMN

SEQ ID NO: 31362 - protein, 7 aa, Artificial Sequence
  Description of Artificial Sequence: Synthetic peptide
  XENP021161 vlCDR2
AASNLES

SEQ ID NO: 31363 - protein, 9 aa, Artificial Sequence
  Description of Artificial Sequence: Synthetic peptide
  XENP021161 vlCDR3
QQSHEDPFT

SEQ ID NO: 31364 - protein, 226 aa, Artificial Sequence; identical to SEQ ID NO: 29134
  Description of Artificial Sequence: Synthetic polypeptide
  XENP021162 7G8_H0_L0.85_Fab Heavy Chain

SEQ ID NO: 31365 - protein, 121 aa, Artificial Sequence; identical to SEQ ID NO: 17586
  Description of Artificial Sequence: Synthetic polypeptide
  VH of XENP021162

SEQ ID NO: 31366 - protein, 5 aa, Artificial Sequence
  Description of Artificial Sequence: Synthetic peptide
  XENP021162 vhCDR1
DAWMD

SEQ ID NO: 31367 - protein, 19 aa, Artificial Sequence
  Description of Artificial Sequence: Synthetic peptide
  XENP021162 vhCDR2
EIRTKANNHATYYAESVKG

SEQ ID NO: 31368 - protein, 10 aa, Artificial Sequence
  Description of Artificial Sequence: Synthetic peptide
  XENP021162 vhCDR3
LANWDWYFDV

SEQ ID NO: 31369 - protein, 218 aa, Artificial Sequence; identical to SEQ ID NO: 20540
  Description of Artificial Sequence: Synthetic polypeptide
  XENP021162 7G8_H0_L0.85_Fab Light Chain

SEQ ID NO: 31370 - protein, 111 aa, Artificial Sequence; identical to SEQ ID NO: 20541
  Description of Artificial Sequence: Synthetic polypeptide
  VL of XENP021162

SEQ ID NO: 31371 - protein, 15 aa, Artificial Sequence
  Description of Artificial Sequence: Synthetic peptide
  XENP021162 vlCDR1
KASQSVDYDGDSYMN

SEQ ID NO: 31372 - protein, 7 aa, Artificial Sequence
  Description of Artificial Sequence: Synthetic peptide
  XENP021162 vlCDR2
AASNLES

SEQ ID NO: 31373 - protein, 9 aa, Artificial Sequence
  Description of Artificial Sequence: Synthetic peptide
  XENP021162 vlCDR3
QQSEEDPFT

SEQ ID NO: 31374 - protein, 226 aa, Artificial Sequence; identical to SEQ ID NO: 29134
  Description of Artificial Sequence: Synthetic polypeptide
  XENP021163 7G8_H0_L0.86_Fab Heavy Chain

SEQ ID NO: 31375 - protein, 121 aa, Artificial Sequence; identical to SEQ ID NO: 17586
  Description of Artificial Sequence: Synthetic polypeptide
  VH of XENP021163

SEQ ID NO: 31376 - protein, 5 aa, Artificial Sequence
  Description of Artificial Sequence: Synthetic peptide
  XENP021163 vhCDR1
DAWMD

SEQ ID NO: 31377 - protein, 19 aa, Artificial Sequence
  Description of Artificial Sequence: Synthetic peptide
  XENP021163 vhCDR2
EIRTKANNHATYYAESVKG

SEQ ID NO: 31378 - protein, 10 aa, Artificial Sequence
  Description of Artificial Sequence: Synthetic peptide
  XENP021163 vhCDR3
LANWDWYFDV

SEQ ID NO: 31379 - protein, 218 aa, Artificial Sequence; identical to SEQ ID NO: 20550
  Description of Artificial Sequence: Synthetic polypeptide
  XENP021163 7G8_H0_L0.86_Fab Light Chain

SEQ ID NO: 31380 - protein, 111 aa, Artificial Sequence; identical to SEQ ID NO: 20551
  Description of Artificial Sequence: Synthetic polypeptide
  VL of XENP021163

SEQ ID NO: 31381 - protein, 15 aa, Artificial Sequence
  Description of Artificial Sequence: Synthetic peptide
  XENP021163 vlCDR1
KASQSVDYDGDSYMN

SEQ ID NO: 31382 - protein, 7 aa, Artificial Sequence
  Description of Artificial Sequence: Synthetic peptide
  XENP021163 vlCDR2
AASNLES

SEQ ID NO: 31383 - protein, 9 aa, Artificial Sequence
  Description of Artificial Sequence: Synthetic peptide
  XENP021163 vlCDR3
QQSSEDPFT

SEQ ID NO: 31384 - protein, 226 aa, Artificial Sequence; identical to SEQ ID NO: 29134
  Description of Artificial Sequence: Synthetic polypeptide
  XENP021164 7G8_H0_L0.87_Fab Heavy Chain

SEQ ID NO: 31385 - protein, 121 aa, Artificial Sequence; identical to SEQ ID NO: 17586
  Description of Artificial Sequence: Synthetic polypeptide
  VH of XENP021164

SEQ ID NO: 31386 - protein, 5 aa, Artificial Sequence
  Description of Artificial Sequence: Synthetic peptide
  XENP021164 vhCDR1
DAWMD

SEQ ID NO: 31387 - protein, 19 aa, Artificial Sequence
  Description of Artificial Sequence: Synthetic peptide
  XENP021164 vhCDR2
EIRTKANNHATYYAESVKG

SEQ ID NO: 31388 - protein, 10 aa, Artificial Sequence
  Description of Artificial Sequence: Synthetic peptide
  XENP021164 vhCDR3
LANWDWYFDV

SEQ ID NO: 31389 - protein, 218 aa, Artificial Sequence; identical to SEQ ID NO: 20560
  Description of Artificial Sequence: Synthetic polypeptide
  XENP021164 7G8_H0_L0.87_Fab Light Chain

SEQ ID NO: 31390 - protein, 111 aa, Artificial Sequence; identical to SEQ ID NO: 20561
  Description of Artificial Sequence: Synthetic polypeptide
  VL of XENP021164

SEQ ID NO: 31391 - protein, 15 aa, Artificial Sequence
  Description of Artificial Sequence: Synthetic peptide
  XENP021164 vlCDR1
KASQSVDYDGDSYMN

SEQ ID NO: 31392 - protein, 7 aa, Artificial Sequence
  Description of Artificial Sequence: Synthetic peptide
  XENP021164 vlCDR2
AASNLES

SEQ ID NO: 31393 - protein, 9 aa, Artificial Sequence
  Description of Artificial Sequence: Synthetic peptide
  XENP021164 vlCDR3
QQSREDPFT

SEQ ID NO: 31394 - protein, 226 aa, Artificial Sequence; identical to SEQ ID NO: 29134
  Description of Artificial Sequence: Synthetic polypeptide
  XENP021165 7G8_H0_L0.88_Fab Heavy Chain

SEQ ID NO: 31395 - protein, 121 aa, Artificial Sequence; identical to SEQ ID NO: 17586
  Description of Artificial Sequence: Synthetic polypeptide
  VH of XENP021165

SEQ ID NO: 31396 - protein, 5 aa, Artificial Sequence
  Description of Artificial Sequence: Synthetic peptide
  XENP021165 vhCDR1
DAWMD

SEQ ID NO: 31397 - protein, 19 aa, Artificial Sequence
  Description of Artificial Sequence: Synthetic peptide
  XENP021165 vhCDR2
EIRTKANNHATYYAESVKG

SEQ ID NO: 31398 - protein, 10 aa, Artificial Sequence
  Description of Artificial Sequence: Synthetic peptide
  XENP021165 vhCDR3
LANWDWYFDV

SEQ ID NO: 31399 - protein, 218 aa, Artificial Sequence; identical to SEQ ID NO: 20570
  Description of Artificial Sequence: Synthetic polypeptide
  XENP021165 7G8_H0_L0.88_Fab Light Chain

SEQ ID NO: 31400 - protein, 111 aa, Artificial Sequence; identical to SEQ ID NO: 20571
  Description of Artificial Sequence: Synthetic polypeptide
  VL of XENP021165

SEQ ID NO: 31401 - protein, 15 aa, Artificial Sequence
  Description of Artificial Sequence: Synthetic peptide
  XENP021165 vlCDR1
KASQSVDYDGDSYMN

SEQ ID NO: 31402 - protein, 7 aa, Artificial Sequence
  Description of Artificial Sequence: Synthetic peptide
  XENP021165 vlCDR2
AASNLES

SEQ ID NO: 31403 - protein, 9 aa, Artificial Sequence
  Description of Artificial Sequence: Synthetic peptide
  XENP021165 vlCDR3
QQSLEDPFT

SEQ ID NO: 31404 - protein, 226 aa, Artificial Sequence; identical to SEQ ID NO: 29134
  Description of Artificial Sequence: Synthetic polypeptide
  XENP021166 7G8_H0_L0.89_Fab Heavy Chain

SEQ ID NO: 31405 - protein, 121 aa, Artificial Sequence; identical to SEQ ID NO: 17586
  Description of Artificial Sequence: Synthetic polypeptide
  VH of XENP021166

SEQ ID NO: 31406 - protein, 5 aa, Artificial Sequence
  Description of Artificial Sequence: Synthetic peptide
  XENP021166 vhCDR1
DAWMD

SEQ ID NO: 31407 - protein, 19 aa, Artificial Sequence
  Description of Artificial Sequence: Synthetic peptide
  XENP021166 vhCDR2
EIRTKANNHATYYAESVKG

SEQ ID NO: 31408 - protein, 10 aa, Artificial Sequence
  Description of Artificial Sequence: Synthetic peptide
  XENP021166 vhCDR3
LANWDWYFDV

SEQ ID NO: 31409 - protein, 218 aa, Artificial Sequence; identical to SEQ ID NO: 20580
  Description of Artificial Sequence: Synthetic polypeptide
  XENP021166 7G8_H0_L0.89_Fab Light Chain

SEQ ID NO: 31410 - protein, 111 aa, Artificial Sequence; identical to SEQ ID NO: 20581
  Description of Artificial Sequence: Synthetic polypeptide
  VL of XENP021166

SEQ ID NO: 31411 - protein, 15 aa, Artificial Sequence
  Description of Artificial Sequence: Synthetic peptide
  XENP021166 vlCDR1
KASQSVDYDGDSYMN

SEQ ID NO: 31412 - protein, 7 aa, Artificial Sequence
  Description of Artificial Sequence: Synthetic peptide
  XENP021166 vlCDR2
AASNLES

SEQ ID NO: 31413 - protein, 9 aa, Artificial Sequence
  Description of Artificial Sequence: Synthetic peptide
  XENP021166 vlCDR3
QQSTEDPFT

SEQ ID NO: 31414 - protein, 226 aa, Artificial Sequence; identical to SEQ ID NO: 29134
  Description of Artificial Sequence: Synthetic polypeptide
  XENP021167 7G8_H0_L0.90_Fab Heavy Chain

SEQ ID NO: 31415 - protein, 121 aa, Artificial Sequence; identical to SEQ ID NO: 17586
  Description of Artificial Sequence: Synthetic polypeptide
  VH of XENP021167

SEQ ID NO: 31416 - protein, 5 aa, Artificial Sequence
  Description of Artificial Sequence: Synthetic peptide
  XENP021167 vhCDR1
DAWMD

SEQ ID NO: 31417 - protein, 19 aa, Artificial Sequence
  Description of Artificial Sequence: Synthetic peptide
  XENP021167 vhCDR2
EIRTKANNHATYYAESVKG

SEQ ID NO: 31418 - protein, 10 aa, Artificial Sequence
  Description of Artificial Sequence: Synthetic peptide
  XENP021167 vhCDR3
LANWDWYFDV

SEQ ID NO: 31419 - protein, 218 aa, Artificial Sequence; identical to SEQ ID NO: 20590
  Description of Artificial Sequence: Synthetic polypeptide
  XENP021167 7G8_H0_L0.90_Fab Light Chain

SEQ ID NO: 31420 - protein, 111 aa, Artificial Sequence; identical to SEQ ID NO: 20591
  Description of Artificial Sequence: Synthetic polypeptide
  VL of XENP021167

SEQ ID NO: 31421 - protein, 15 aa, Artificial Sequence
  Description of Artificial Sequence: Synthetic peptide
  XENP021167 vlCDR1
KASQSVDYDGDSYMN

SEQ ID NO: 31422 - protein, 7 aa, Artificial Sequence
  Description of Artificial Sequence: Synthetic peptide
  XENP021167 vlCDR2
AASNLES

SEQ ID NO: 31423 - protein, 9 aa, Artificial Sequence
  Description of Artificial Sequence: Synthetic peptide
  XENP021167 vlCDR3
QQSGEDPFT

SEQ ID NO: 31424 - protein, 226 aa, Artificial Sequence; identical to SEQ ID NO: 29134
  Description of Artificial Sequence: Synthetic polypeptide
  XENP021168 7G8_H0_L0.91_Fab Heavy Chain

SEQ ID NO: 31425 - protein, 121 aa, Artificial Sequence; identical to SEQ ID NO: 17586
  Description of Artificial Sequence: Synthetic polypeptide
  VH of XENP021168

SEQ ID NO: 31426 - protein, 5 aa, Artificial Sequence
  Description of Artificial Sequence: Synthetic peptide
  XENP021168 vhCDR1
DAWMD

SEQ ID NO: 31427 - protein, 19 aa, Artificial Sequence
  Description of Artificial Sequence: Synthetic peptide
  XENP021168 vhCDR2
EIRTKANNHATYYAESVKG

SEQ ID NO: 31428 - protein, 10 aa, Artificial Sequence
  Description of Artificial Sequence: Synthetic peptide
  XENP021168 vhCDR3
LANWDWYFDV

SEQ ID NO: 31429 - protein, 218 aa, Artificial Sequence; identical to SEQ ID NO: 20600
  Description of Artificial Sequence: Synthetic polypeptide
  XENP021168 7G8_H0_L0.91_Fab Light Chain

SEQ ID NO: 31430 - protein, 111 aa, Artificial Sequence; identical to SEQ ID NO: 20601
  Description of Artificial Sequence: Synthetic polypeptide
  VL of XENP021168

SEQ ID NO: 31431 - protein, 15 aa, Artificial Sequence
  Description of Artificial Sequence: Synthetic peptide
  XENP021168 vlCDR1
KASQSVDYDGDSYMN

SEQ ID NO: 31432 - protein, 7 aa, Artificial Sequence
  Description of Artificial Sequence: Synthetic peptide
  XENP021168 vlCDR2
AASNLES

SEQ ID NO: 31433 - protein, 9 aa, Artificial Sequence
  Description of Artificial Sequence: Synthetic peptide
  XENP021168 vlCDR3
QQSYEDPFT

SEQ ID NO: 31434 - protein, 226 aa, Artificial Sequence; identical to SEQ ID NO: 29134
  Description of Artificial Sequence: Synthetic polypeptide
  XENP021169 7G8_H0_L0.92_Fab Heavy Chain

SEQ ID NO: 31435 - protein, 121 aa, Artificial Sequence; identical to SEQ ID NO: 17586
  Description of Artificial Sequence: Synthetic polypeptide
  VH of XENP021169

SEQ ID NO: 31436 - protein, 5 aa, Artificial Sequence
  Description of Artificial Sequence: Synthetic peptide
  XENP021169 vhCDR1
DAWMD

SEQ ID NO: 31437 - protein, 19 aa, Artificial Sequence
  Description of Artificial Sequence: Synthetic peptide
  XENP021169 vhCDR2
EIRTKANNHATYYAESVKG

SEQ ID NO: 31438 - protein, 10 aa, Artificial Sequence
  Description of Artificial Sequence: Synthetic peptide
  XENP021169 vhCDR3
LANWDWYFDV

SEQ ID NO: 31439 - protein, 218 aa, Artificial Sequence; identical to SEQ ID NO: 20610
  Description of Artificial Sequence: Synthetic polypeptide
  XENP021169 7G8_H0_L0.92_Fab Light Chain

SEQ ID NO: 31440 - protein, 111 aa, Artificial Sequence; identical to SEQ ID NO: 20611
  Description of Artificial Sequence: Synthetic polypeptide
  VL of XENP021169

SEQ ID NO: 31441 - protein, 15 aa, Artificial Sequence
  Description of Artificial Sequence: Synthetic peptide
  XENP021169 vlCDR1
KASQSVDYDGDSYMN

SEQ ID NO: 31442 - protein, 7 aa, Artificial Sequence
  Description of Artificial Sequence: Synthetic peptide
  XENP021169 vlCDR2
AASNLES

SEQ ID NO: 31443 - protein, 9 aa, Artificial Sequence
  Description of Artificial Sequence: Synthetic peptide
  XENP021169 vlCDR3
QQSNQDPFT

SEQ ID NO: 31444 - protein, 226 aa, Artificial Sequence; identical to SEQ ID NO: 29134
  Description of Artificial Sequence: Synthetic polypeptide
  XENP021170 7G8_H0_L0.93_Fab Heavy Chain

SEQ ID NO: 31445 - protein, 121 aa, Artificial Sequence; identical to SEQ ID NO: 17586
  Description of Artificial Sequence: Synthetic polypeptide
  VH of XENP021170

SEQ ID NO: 31446 - protein, 5 aa, Artificial Sequence
  Description of Artificial Sequence: Synthetic peptide
  XENP021170 vhCDR1
DAWMD

SEQ ID NO: 31447 - protein, 19 aa, Artificial Sequence
  Description of Artificial Sequence: Synthetic peptide
  XENP021170 vhCDR2
EIRTKANNHATYYAESVKG

SEQ ID NO: 31448 - protein, 10 aa, Artificial Sequence
  Description of Artificial Sequence: Synthetic peptide
  XENP021170 vhCDR3
LANWDWYFDV

SEQ ID NO: 31449 - protein, 218 aa, Artificial Sequence; identical to SEQ ID NO: 20620
  Description of Artificial Sequence: Synthetic polypeptide
  XENP021170 7G8_H0_L0.93_Fab Light Chain

SEQ ID NO: 31450 - protein, 111 aa, Artificial Sequence; identical to SEQ ID NO: 20621
  Description of Artificial Sequence: Synthetic polypeptide
  VL of XENP021170

SEQ ID NO: 31451 - protein, 15 aa, Artificial Sequence
  Description of Artificial Sequence: Synthetic peptide
  XENP021170 vlCDR1
KASQSVDYDGDSYMN

SEQ ID NO: 31452 - protein, 7 aa, Artificial Sequence
  Description of Artificial Sequence: Synthetic peptide
  XENP021170 vlCDR2
AASNLES

SEQ ID NO: 31453 - protein, 9 aa, Artificial Sequence
  Description of Artificial Sequence: Synthetic peptide
  XENP021170 vlCDR3
QQSNDDPFT

SEQ ID NO: 31454 - protein, 226 aa, Artificial Sequence; identical to SEQ ID NO: 29134
  Description of Artificial Sequence: Synthetic polypeptide
  XENP021171 7G8_H0_L0.94_Fab Heavy Chain

SEQ ID NO: 31455 - protein, 121 aa, Artificial Sequence; identical to SEQ ID NO: 17586
  Description of Artificial Sequence: Synthetic polypeptide
  VH of XENP021171

SEQ ID NO: 31456 - protein, 5 aa, Artificial Sequence
  Description of Artificial Sequence: Synthetic peptide
  XENP021171 vhCDR1
DAWMD

SEQ ID NO: 31457 - protein, 19 aa, Artificial Sequence
  Description of Artificial Sequence: Synthetic peptide
  XENP021171 vhCDR2
EIRTKANNHATYYAESVKG

SEQ ID NO: 31458 - protein, 10 aa, Artificial Sequence
  Description of Artificial Sequence: Synthetic peptide
  XENP021171 vhCDR3
LANWDWYFDV

SEQ ID NO: 31459 - protein, 218 aa, Artificial Sequence; identical to SEQ ID NO: 20630
  Description of Artificial Sequence: Synthetic polypeptide
  XENP021171 7G8_H0_L0.94_Fab Light Chain

SEQ ID NO: 31460 - protein, 111 aa, Artificial Sequence; identical to SEQ ID NO: 20631
  Description of Artificial Sequence: Synthetic polypeptide
  VL of XENP021171

SEQ ID NO: 31461 - protein, 15 aa, Artificial Sequence
  Description of Artificial Sequence: Synthetic peptide
  XENP021171 vlCDR1
KASQSVDYDGDSYMN

SEQ ID NO: 31462 - protein, 7 aa, Artificial Sequence
  Description of Artificial Sequence: Synthetic peptide
  XENP021171 vlCDR2
AASNLES

SEQ ID NO: 31463 - protein, 9 aa, Artificial Sequence
  Description of Artificial Sequence: Synthetic peptide
  XENP021171 vlCDR3
QQSNKDPFT

SEQ ID NO: 31464 - protein, 226 aa, Artificial Sequence; identical to SEQ ID NO: 29134
  Description of Artificial Sequence: Synthetic polypeptide
  XENP021172 7G8_H0_L0.95_Fab Heavy Chain

SEQ ID NO: 31465 - protein, 121 aa, Artificial Sequence; identical to SEQ ID NO: 17586
  Description of Artificial Sequence: Synthetic polypeptide
  VH of XENP021172

SEQ ID NO: 31466 - protein, 5 aa, Artificial Sequence
  Description of Artificial Sequence: Synthetic peptide
  XENP021172 vhCDR1
DAWMD

SEQ ID NO: 31467 - protein, 19 aa, Artificial Sequence
  Description of Artificial Sequence: Synthetic peptide
  XENP021172 vhCDR2
EIRTKANNHATYYAESVKG

SEQ ID NO: 31468 - protein, 10 aa, Artificial Sequence
  Description of Artificial Sequence: Synthetic peptide
  XENP021172 vhCDR3
LANWDWYFDV

SEQ ID NO: 31469 - protein, 218 aa, Artificial Sequence; identical to SEQ ID NO: 20640
  Description of Artificial Sequence: Synthetic polypeptide
  XENP021172 7G8_H0_L0.95_Fab Light Chain

SEQ ID NO: 31470 - protein, 111 aa, Artificial Sequence; identical to SEQ ID NO: 20641
  Description of Artificial Sequence: Synthetic polypeptide
  VL of XENP021172

SEQ ID NO: 31471 - protein, 15 aa, Artificial Sequence
  Description of Artificial Sequence: Synthetic peptide
  XENP021172 vlCDR1
KASQSVDYDGDSYMN

SEQ ID NO: 31472 - protein, 7 aa, Artificial Sequence
  Description of Artificial Sequence: Synthetic peptide
  XENP021172 vlCDR2
AASNLES

SEQ ID NO: 31473 - protein, 9 aa, Artificial Sequence
  Description of Artificial Sequence: Synthetic peptide
  XENP021172 vlCDR3
QQSNSDPFT

SEQ ID NO: 31474 - protein, 226 aa, Artificial Sequence; identical to SEQ ID NO: 29134
  Description of Artificial Sequence: Synthetic polypeptide
  XENP021173 7G8_H0_L0.96_Fab Heavy Chain

SEQ ID NO: 31475 - protein, 121 aa, Artificial Sequence; identical to SEQ ID NO: 17586
  Description of Artificial Sequence: Synthetic polypeptide
  VH of XENP021173

SEQ ID NO: 31476 - protein, 5 aa, Artificial Sequence
  Description of Artificial Sequence: Synthetic peptide
  XENP021173 vhCDR1
DAWMD

SEQ ID NO: 31477 - protein, 19 aa, Artificial Sequence
  Description of Artificial Sequence: Synthetic peptide
  XENP021173 vhCDR2
EIRTKANNHATYYAESVKG

SEQ ID NO: 31478 - protein, 10 aa, Artificial Sequence
  Description of Artificial Sequence: Synthetic peptide
  XENP021173 vhCDR3
LANWDWYFDV

SEQ ID NO: 31479 - protein, 218 aa, Artificial Sequence; identical to SEQ ID NO: 20650
  Description of Artificial Sequence: Synthetic polypeptide
  XENP021173 7G8_H0_L0.96_Fab Light Chain

SEQ ID NO: 31480 - protein, 111 aa, Artificial Sequence; identical to SEQ ID NO: 20651
  Description of Artificial Sequence: Synthetic polypeptide
  VL of XENP021173

SEQ ID NO: 31481 - protein, 15 aa, Artificial Sequence
  Description of Artificial Sequence: Synthetic peptide
  XENP021173 vlCDR1
KASQSVDYDGDSYMN

SEQ ID NO: 31482 - protein, 7 aa, Artificial Sequence
  Description of Artificial Sequence: Synthetic peptide
  XENP021173 vlCDR2
AASNLES

SEQ ID NO: 31483 - protein, 9 aa, Artificial Sequence
  Description of Artificial Sequence: Synthetic peptide
  XENP021173 vlCDR3
QQSNHDPFT

SEQ ID NO: 31484 - protein, 226 aa, Artificial Sequence; identical to SEQ ID NO: 29134
  Description of Artificial Sequence: Synthetic polypeptide
  XENP021174 7G8_H0_L0.97_Fab Heavy Chain

SEQ ID NO: 31485 - protein, 121 aa, Artificial Sequence; identical to SEQ ID NO: 17586
  Description of Artificial Sequence: Synthetic polypeptide
  VH of XENP021174

SEQ ID NO: 31486 - protein, 5 aa, Artificial Sequence
  Description of Artificial Sequence: Synthetic peptide
  XENP021174 vhCDR1
DAWMD

SEQ ID NO: 31487 - protein, 19 aa, Artificial Sequence
  Description of Artificial Sequence: Synthetic peptide
  XENP021174 vhCDR2
EIRTKANNHATYYAESVKG

SEQ ID NO: 31488 - protein, 10 aa, Artificial Sequence
  Description of Artificial Sequence: Synthetic peptide
  XENP021174 vhCDR3
LANWDWYFDV

SEQ ID NO: 31489 - protein, 218 aa, Artificial Sequence; identical to SEQ ID NO: 20660
  Description of Artificial Sequence: Synthetic polypeptide
  XENP021174 7G8_H0_L0.97_Fab Light Chain

SEQ ID NO: 31490 - protein, 111 aa, Artificial Sequence; identical to SEQ ID NO: 20661
  Description of Artificial Sequence: Synthetic polypeptide
  VL of XENP021174

SEQ ID NO: 31491 - protein, 15 aa, Artificial Sequence
  Description of Artificial Sequence: Synthetic peptide
  XENP021174 vlCDR1
KASQSVDYDGDSYMN

SEQ ID NO: 31492 - protein, 7 aa, Artificial Sequence
  Description of Artificial Sequence: Synthetic peptide
  XENP021174 vlCDR2
AASNLES

SEQ ID NO: 31493 - protein, 9 aa, Artificial Sequence
  Description of Artificial Sequence: Synthetic peptide
  XENP021174 vlCDR3
QQSNADPFT

SEQ ID NO: 31494 - protein, 226 aa, Artificial Sequence; identical to SEQ ID NO: 29134
  Description of Artificial Sequence: Synthetic polypeptide
  XENP021175 7G8_H0_L0.98_Fab Heavy Chain

SEQ ID NO: 31495 - protein, 121 aa, Artificial Sequence; identical to SEQ ID NO: 17586
  Description of Artificial Sequence: Synthetic polypeptide
  VH of XENP021175

SEQ ID NO: 31496 - protein, 5 aa, Artificial Sequence
  Description of Artificial Sequence: Synthetic peptide
  XENP021175 vhCDR1
DAWMD

SEQ ID NO: 31497 - protein, 19 aa, Artificial Sequence
  Description of Artificial Sequence: Synthetic peptide
  XENP021175 vhCDR2
EIRTKANNHATYYAESVKG

SEQ ID NO: 31498 - protein, 10 aa, Artificial Sequence
  Description of Artificial Sequence: Synthetic peptide
  XENP021175 vhCDR3
LANWDWYFDV

SEQ ID NO: 31499 - protein, 218 aa, Artificial Sequence; identical to SEQ ID NO: 20670
  Description of Artificial Sequence: Synthetic polypeptide
  XENP021175 7G8_H0_L0.98_Fab Light Chain

SEQ ID NO: 31500 - protein, 111 aa, Artificial Sequence; identical to SEQ ID NO: 20671
  Description of Artificial Sequence: Synthetic polypeptide
  VL of XENP021175

SEQ ID NO: 31501 - protein, 15 aa, Artificial Sequence
  Description of Artificial Sequence: Synthetic peptide
  XENP021175 vlCDR1
KASQSVDYDGDSYMN

SEQ ID NO: 31502 - protein, 7 aa, Artificial Sequence
  Description of Artificial Sequence: Synthetic peptide
  XENP021175 vlCDR2
AASNLES

SEQ ID NO: 31503 - protein, 9 aa, Artificial Sequence
  Description of Artificial Sequence: Synthetic peptide
  XENP021175 vlCDR3
QQSNGDPFT

SEQ ID NO: 31504 - protein, 226 aa, Artificial Sequence; identical to SEQ ID NO: 29134
  Description of Artificial Sequence: Synthetic polypeptide
  XENP021176 7G8_H0_L0.99_Fab Heavy Chain

SEQ ID NO: 31505 - protein, 121 aa, Artificial Sequence; identical to SEQ ID NO: 17586
  Description of Artificial Sequence: Synthetic polypeptide
  VH of XENP021176

SEQ ID NO: 31506 - protein, 5 aa, Artificial Sequence
  Description of Artificial Sequence: Synthetic peptide
  XENP021176 vhCDR1
DAWMD

SEQ ID NO: 31507 - protein, 19 aa, Artificial Sequence
  Description of Artificial Sequence: Synthetic peptide
  XENP021176 vhCDR2
EIRTKANNHATYYAESVKG

SEQ ID NO: 31508 - protein, 10 aa, Artificial Sequence
  Description of Artificial Sequence: Synthetic peptide
  XENP021176 vhCDR3
LANWDWYFDV

SEQ ID NO: 31509 - protein, 218 aa, Artificial Sequence; identical to SEQ ID NO: 20680
  Description of Artificial Sequence: Synthetic polypeptide
  XENP021176 7G8_H0_L0.99_Fab Light Chain

SEQ ID NO: 31510 - protein, 111 aa, Artificial Sequence; identical to SEQ ID NO: 20681
  Description of Artificial Sequence: Synthetic polypeptide
  VL of XENP021176

SEQ ID NO: 31511 - protein, 15 aa, Artificial Sequence
  Description of Artificial Sequence: Synthetic peptide
  XENP021176 vlCDR1
KASQSVDYDGDSYMN

SEQ ID NO: 31512 - protein, 7 aa, Artificial Sequence
  Description of Artificial Sequence: Synthetic peptide
  XENP021176 vlCDR2
AASNLES

SEQ ID NO: 31513 - protein, 9 aa, Artificial Sequence
  Description of Artificial Sequence: Synthetic peptide
  XENP021176 vlCDR3
QQSNYDPFT

SEQ ID NO: 31514 - protein, 226 aa, Artificial Sequence; identical to SEQ ID NO: 29134
  Description of Artificial Sequence: Synthetic polypeptide
  XENP021177 7G8_H0_L0.100_Fab Heavy Chain

SEQ ID NO: 31515 - protein, 121 aa, Artificial Sequence; identical to SEQ ID NO: 17586
  Description of Artificial Sequence: Synthetic polypeptide
  VH of XENP021177

SEQ ID NO: 31516 - protein, 5 aa, Artificial Sequence
  Description of Artificial Sequence: Synthetic peptide
  XENP021177 vhCDR1
DAWMD

SEQ ID NO: 31517 - protein, 19 aa, Artificial Sequence
  Description of Artificial Sequence: Synthetic peptide
  XENP021177 vhCDR2
EIRTKANNHATYYAESVKG

SEQ ID NO: 31518 - protein, 10 aa, Artificial Sequence
  Description of Artificial Sequence: Synthetic peptide
  XENP021177 vhCDR3
LANWDWYFDV

SEQ ID NO: 31519 - protein, 218 aa, Artificial Sequence; identical to SEQ ID NO: 20690
  Description of Artificial Sequence: Synthetic polypeptide
  XENP021177 7G8_H0_L0.100_Fab Light Chain

SEQ ID NO: 31520 - protein, 111 aa, Artificial Sequence; identical to SEQ ID NO: 20691
  Description of Artificial Sequence: Synthetic polypeptide
  VL of XENP021177

SEQ ID NO: 31521 - protein, 15 aa, Artificial Sequence
  Description of Artificial Sequence: Synthetic peptide
  XENP021177 vlCDR1
KASQSVDYDGDSYMN

SEQ ID NO: 31522 - protein, 7 aa, Artificial Sequence
  Description of Artificial Sequence: Synthetic peptide
  XENP021177 vlCDR2
AASNLES

SEQ ID NO: 31523 - protein, 9 aa, Artificial Sequence
  Description of Artificial Sequence: Synthetic peptide
  XENP021177 vlCDR3
QQSNIDPFT

SEQ ID NO: 31524 - protein, 226 aa, Artificial Sequence; identical to SEQ ID NO: 29134
  Description of Artificial Sequence: Synthetic polypeptide
  XENP021178 7G8_H0_L0.101_Fab Heavy Chain

SEQ ID NO: 31525 - protein, 121 aa, Artificial Sequence; identical to SEQ ID NO: 17586
  Description of Artificial Sequence: Synthetic polypeptide
  VH of XENP021178

SEQ ID NO: 31526 - protein, 5 aa, Artificial Sequence
  Description of Artificial Sequence: Synthetic peptide
  XENP021178 vhCDR1
DAWMD

SEQ ID NO: 31527 - protein, 19 aa, Artificial Sequence
  Description of Artificial Sequence: Synthetic peptide
  XENP021178 vhCDR2
EIRTKANNHATYYAESVKG

SEQ ID NO: 31528 - protein, 10 aa, Artificial Sequence
  Description of Artificial Sequence: Synthetic peptide
  XENP021178 vhCDR3
LANWDWYFDV

SEQ ID NO: 31529 - protein, 218 aa, Artificial Sequence; identical to SEQ ID NO: 20700
  Description of Artificial Sequence: Synthetic polypeptide
  XENP021178 7G8_H0_L0.101_Fab Light Chain

SEQ ID NO: 31530 - protein, 111 aa, Artificial Sequence; identical to SEQ ID NO: 20701
  Description of Artificial Sequence: Synthetic polypeptide
  VL of XENP021178

SEQ ID NO: 31531 - protein, 15 aa, Artificial Sequence
  Description of Artificial Sequence: Synthetic peptide
  XENP021178 vlCDR1
KASQSVDYDGDSYMN

SEQ ID NO: 31532 - protein, 7 aa, Artificial Sequence
  Description of Artificial Sequence: Synthetic peptide
  XENP021178 vlCDR2
AASNLES

SEQ ID NO: 31533 - protein, 9 aa, Artificial Sequence
  Description of Artificial Sequence: Synthetic peptide
  XENP021178 vlCDR3
QQSNENPFT

SEQ ID NO: 31534 - protein, 226 aa, Artificial Sequence; identical to SEQ ID NO: 29134
  Description of Artificial Sequence: Synthetic polypeptide
  XENP021179 7G8_H0_L0.102_Fab Heavy Chain

SEQ ID NO: 31535 - protein, 121 aa, Artificial Sequence; identical to SEQ ID NO: 17586
  Description of Artificial Sequence: Synthetic polypeptide
  VH of XENP021179

SEQ ID NO: 31536 - protein, 5 aa, Artificial Sequence
  Description of Artificial Sequence: Synthetic peptide
  XENP021179 vhCDR1
DAWMD

SEQ ID NO: 31537 - protein, 19 aa, Artificial Sequence
  Description of Artificial Sequence: Synthetic peptide
  XENP021179 vhCDR2
EIRTKANNHATYYAESVKG

SEQ ID NO: 31538 - protein, 10 aa, Artificial Sequence
  Description of Artificial Sequence: Synthetic peptide
  XENP021179 vhCDR3
LANWDWYFDV

SEQ ID NO: 31539 - protein, 218 aa, Artificial Sequence; identical to SEQ ID NO: 20710
  Description of Artificial Sequence: Synthetic polypeptide
  XENP021179 7G8_H0_L0.102_Fab Light Chain

SEQ ID NO: 31540 - protein, 111 aa, Artificial Sequence; identical to SEQ ID NO: 20711
  Description of Artificial Sequence: Synthetic polypeptide
  VL of XENP021179

SEQ ID NO: 31541 - protein, 15 aa, Artificial Sequence
  Description of Artificial Sequence: Synthetic peptide
  XENP021179 vlCDR1
KASQSVDYDGDSYMN

SEQ ID NO: 31542 - protein, 7 aa, Artificial Sequence
  Description of Artificial Sequence: Synthetic peptide
  XENP021179 vlCDR2
AASNLES

SEQ ID NO: 31543 - protein, 9 aa, Artificial Sequence
  Description of Artificial Sequence: Synthetic peptide
  XENP021179 vlCDR3
QQSNEEPFT

SEQ ID NO: 31544 - protein, 226 aa, Artificial Sequence; identical to SEQ ID NO: 29134
  Description of Artificial Sequence: Synthetic polypeptide
  XENP021180 7G8_H0_L0.103_Fab Heavy Chain

SEQ ID NO: 31545 - protein, 121 aa, Artificial Sequence; identical to SEQ ID NO: 17586
  Description of Artificial Sequence: Synthetic polypeptide
  VH of XENP021180

SEQ ID NO: 31546 - protein, 5 aa, Artificial Sequence
  Description of Artificial Sequence: Synthetic peptide
  XENP021180 vhCDR1
DAWMD

SEQ ID NO: 31547 - protein, 19 aa, Artificial Sequence
  Description of Artificial Sequence: Synthetic peptide
  XENP021180 vhCDR2
EIRTKANNHATYYAESVKG

SEQ ID NO: 31548 - protein, 10 aa, Artificial Sequence
  Description of Artificial Sequence: Synthetic peptide
  XENP021180 vhCDR3
LANWDWYFDV

SEQ ID NO: 31549 - protein, 218 aa, Artificial Sequence; identical to SEQ ID NO: 20720
  Description of Artificial Sequence: Synthetic polypeptide
  XENP021180 7G8_H0_L0.103_Fab Light Chain

SEQ ID NO: 31550 - protein, 111 aa, Artificial Sequence; identical to SEQ ID NO: 20721
  Description of Artificial Sequence: Synthetic polypeptide
  VL of XENP021180

SEQ ID NO: 31551 - protein, 15 aa, Artificial Sequence
  Description of Artificial Sequence: Synthetic peptide
  XENP021180 vlCDR1
KASQSVDYDGDSYMN

SEQ ID NO: 31552 - protein, 7 aa, Artificial Sequence
  Description of Artificial Sequence: Synthetic peptide
  XENP021180 vlCDR2
AASNLES

SEQ ID NO: 31553 - protein, 9 aa, Artificial Sequence
  Description of Artificial Sequence: Synthetic peptide
  XENP021180 vlCDR3
QQSNEHPFT

SEQ ID NO: 31554 - protein, 226 aa, Artificial Sequence; identical to SEQ ID NO: 29134
  Description of Artificial Sequence: Synthetic polypeptide
  XENP021181 7G8_H0_L0.104_Fab Heavy Chain

SEQ ID NO: 31555 - protein, 121 aa, Artificial Sequence; identical to SEQ ID NO: 17586
  Description of Artificial Sequence: Synthetic polypeptide
  VH of XENP021181

SEQ ID NO: 31556 - protein, 5 aa, Artificial Sequence
  Description of Artificial Sequence: Synthetic peptide
  XENP021181 vhCDR1
DAWMD

SEQ ID NO: 31557 - protein, 19 aa, Artificial Sequence
  Description of Artificial Sequence: Synthetic peptide
  XENP021181 vhCDR2
EIRTKANNHATYYAESVKG

SEQ ID NO: 31558 - protein, 10 aa, Artificial Sequence
  Description of Artificial Sequence: Synthetic peptide
  XENP021181 vhCDR3
LANWDWYFDV

SEQ ID NO: 31559 - protein, 218 aa, Artificial Sequence; identical to SEQ ID NO: 20730
  Description of Artificial Sequence: Synthetic polypeptide
  XENP021181 7G8_H0_L0.104_Fab Light Chain

SEQ ID NO: 31560 - protein, 111 aa, Artificial Sequence; identical to SEQ ID NO: 20731
  Description of Artificial Sequence: Synthetic polypeptide
  VL of XENP021181

SEQ ID NO: 31561 - protein, 15 aa, Artificial Sequence
  Description of Artificial Sequence: Synthetic peptide
  XENP021181 vlCDR1
KASQSVDYDGDSYMN

SEQ ID NO: 31562 - protein, 7 aa, Artificial Sequence
  Description of Artificial Sequence: Synthetic peptide
  XENP021181 vlCDR2
AASNLES

SEQ ID NO: 31563 - protein, 9 aa, Artificial Sequence
  Description of Artificial Sequence: Synthetic peptide
  XENP021181 vlCDR3
QQSNERPFT

SEQ ID NO: 31564 - protein, 226 aa, Artificial Sequence; identical to SEQ ID NO: 29134
  Description of Artificial Sequence: Synthetic polypeptide
  XENP021182 7G8_H0_L0.105_Fab Heavy Chain

SEQ ID NO: 31565 - protein, 121 aa, Artificial Sequence; identical to SEQ ID NO: 17586
  Description of Artificial Sequence: Synthetic polypeptide
  VH of XENP021182

SEQ ID NO: 31566 - protein, 5 aa, Artificial Sequence
  Description of Artificial Sequence: Synthetic peptide
  XENP021182 vhCDR1
DAWMD

SEQ ID NO: 31567 - protein, 19 aa, Artificial Sequence
  Description of Artificial Sequence: Synthetic peptide
  XENP021182 vhCDR2
EIRTKANNHATYYAESVKG

SEQ ID NO: 31568 - protein, 10 aa, Artificial Sequence
  Description of Artificial Sequence: Synthetic peptide
  XENP021182 vhCDR3
LANWDWYFDV

SEQ ID NO: 31569 - protein, 218 aa, Artificial Sequence; identical to SEQ ID NO: 20740
  Description of Artificial Sequence: Synthetic polypeptide
  XENP021182 7G8_H0_L0.105_Fab Light Chain

SEQ ID NO: 31570 - protein, 111 aa, Artificial Sequence; identical to SEQ ID NO: 20741
  Description of Artificial Sequence: Synthetic polypeptide
  VL of XENP021182

SEQ ID NO: 31571 - protein, 15 aa, Artificial Sequence
  Description of Artificial Sequence: Synthetic peptide
  XENP021182 vlCDR1
KASQSVDYDGDSYMN

SEQ ID NO: 31572 - protein, 7 aa, Artificial Sequence
  Description of Artificial Sequence: Synthetic peptide
  XENP021182 vlCDR2
AASNLES

SEQ ID NO: 31573 - protein, 9 aa, Artificial Sequence
  Description of Artificial Sequence: Synthetic peptide
  XENP021182 vlCDR3
QQSNELPFT

SEQ ID NO: 31574 - protein, 226 aa, Artificial Sequence; identical to SEQ ID NO: 29134
  Description of Artificial Sequence: Synthetic polypeptide
  XENP021183 7G8_H0_L0.106_Fab Heavy Chain

SEQ ID NO: 31575 - protein, 121 aa, Artificial Sequence; identical to SEQ ID NO: 17586
  Description of Artificial Sequence: Synthetic polypeptide
  VH of XENP021183

SEQ ID NO: 31576 - protein, 5 aa, Artificial Sequence
  Description of Artificial Sequence: Synthetic peptide
  XENP021183 vhCDR1
DAWMD

SEQ ID NO: 31577 - protein, 19 aa, Artificial Sequence
  Description of Artificial Sequence: Synthetic peptide
  XENP021183 vhCDR2
EIRTKANNHATYYAESVKG

SEQ ID NO: 31578 - protein, 10 aa, Artificial Sequence
  Description of Artificial Sequence: Synthetic peptide
  XENP021183 vhCDR3
LANWDWYFDV

SEQ ID NO: 31579 - protein, 218 aa, Artificial Sequence; identical to SEQ ID NO: 20750
  Description of Artificial Sequence: Synthetic polypeptide
  XENP021183 7G8_H0_L0.106_Fab Light Chain

SEQ ID NO: 31580 - protein, 111 aa, Artificial Sequence; identical to SEQ ID NO: 20751
  Description of Artificial Sequence: Synthetic polypeptide
  VL of XENP021183

SEQ ID NO: 31581 - protein, 15 aa, Artificial Sequence
  Description of Artificial Sequence: Synthetic peptide
  XENP021183 vlCDR1
KASQSVDYDGDSYMN

SEQ ID NO: 31582 - protein, 7 aa, Artificial Sequence
  Description of Artificial Sequence: Synthetic peptide
  XENP021183 vlCDR2
AASNLES

SEQ ID NO: 31583 - protein, 9 aa, Artificial Sequence
  Description of Artificial Sequence: Synthetic peptide
  XENP021183 vlCDR3
QQSNEGPFT

SEQ ID NO: 31584 - protein, 226 aa, Artificial Sequence; identical to SEQ ID NO: 29134
  Description of Artificial Sequence: Synthetic polypeptide
  XENP021184 7G8_H0_L0.107_Fab Heavy Chain

SEQ ID NO: 31585 - protein, 121 aa, Artificial Sequence; identical to SEQ ID NO: 17586
  Description of Artificial Sequence: Synthetic polypeptide
  VH of XENP021184

SEQ ID NO: 31586 - protein, 5 aa, Artificial Sequence
  Description of Artificial Sequence: Synthetic peptide
  XENP021184 vhCDR1
DAWMD

SEQ ID NO: 31587 - protein, 19 aa, Artificial Sequence
  Description of Artificial Sequence: Synthetic peptide
  XENP021184 vhCDR2
EIRTKANNHATYYAESVKG

SEQ ID NO: 31588 - protein, 10 aa, Artificial Sequence
  Description of Artificial Sequence: Synthetic peptide
  XENP021184 vhCDR3
LANWDWYFDV

SEQ ID NO: 31589 - protein, 218 aa, Artificial Sequence; identical to SEQ ID NO: 20760
  Description of Artificial Sequence: Synthetic polypeptide
  XENP021184 7G8_H0_L0.107_Fab Light Chain

SEQ ID NO: 31590 - protein, 111 aa, Artificial Sequence; identical to SEQ ID NO: 20761
  Description of Artificial Sequence: Synthetic polypeptide
  VL of XENP021184

SEQ ID NO: 31591 - protein, 15 aa, Artificial Sequence
  Description of Artificial Sequence: Synthetic peptide
  XENP021184 vlCDR1
KASQSVDYDGDSYMN

SEQ ID NO: 31592 - protein, 7 aa, Artificial Sequence
  Description of Artificial Sequence: Synthetic peptide
  XENP021184 vlCDR2
AASNLES

SEQ ID NO: 31593 - protein, 9 aa, Artificial Sequence
  Description of Artificial Sequence: Synthetic peptide
  XENP021184 vlCDR3
QQSNEYPFT

SEQ ID NO: 31594 - protein, 226 aa, Artificial Sequence; identical to SEQ ID NO: 28944
  Description of Artificial Sequence: Synthetic polypeptide
  XENP021558 7G8_H3.1_L0.59_Fab Heavy Chain

SEQ ID NO: 31595 - protein, 121 aa, Artificial Sequence; identical to SEQ ID NO: 28945
  Description of Artificial Sequence: Synthetic polypeptide
  VH of XENP021558

SEQ ID NO: 31596 - protein, 5 aa, Artificial Sequence
  Description of Artificial Sequence: Synthetic peptide
  XENP021558 vhCDR1
DAWMD

SEQ ID NO: 31597 - protein, 19 aa, Artificial Sequence
  Description of Artificial Sequence: Synthetic peptide
  XENP021558 vhCDR2
EIRTKANNHATYYAESVKG

SEQ ID NO: 31598 - protein, 10 aa, Artificial Sequence
  Description of Artificial Sequence: Synthetic peptide
  XENP021558 vhCDR3
LATWDWYFDV

SEQ ID NO: 31599 - protein, 218 aa, Artificial Sequence; identical to SEQ ID NO: 20280
  Description of Artificial Sequence: Synthetic polypeptide
  XENP021558 7G8_H3.1_L0.59_Fab Light Chain

SEQ ID NO: 31600 - protein, 111 aa, Artificial Sequence; identical to SEQ ID NO: 20281
  Description of Artificial Sequence: Synthetic polypeptide
  VL of XENP021558

SEQ ID NO: 31601 - protein, 15 aa, Artificial Sequence
  Description of Artificial Sequence: Synthetic peptide
  XENP021558 vlCDR1
KASQSVDYDGDSYMN

SEQ ID NO: 31602 - protein, 7 aa, Artificial Sequence
  Description of Artificial Sequence: Synthetic peptide
  XENP021558 vlCDR2
AASELES

SEQ ID NO: 31603 - protein, 9 aa, Artificial Sequence
  Description of Artificial Sequence: Synthetic peptide
  XENP021558 vlCDR3
QQSNEDPFT

SEQ ID NO: 31604 - protein, 226 aa, Artificial Sequence; identical to SEQ ID NO: 28974
  Description of Artificial Sequence: Synthetic polypeptide
  XENP021559 7G8_H3.4_L0.59_Fab Heavy Chain

SEQ ID NO: 31605 - protein, 121 aa, Artificial Sequence; identical to SEQ ID NO: 28975
  Description of Artificial Sequence: Synthetic polypeptide
  VH of XENP021559

SEQ ID NO: 31606 - protein, 5 aa, Artificial Sequence
  Description of Artificial Sequence: Synthetic peptide
  XENP021559 vhCDR1
DAWMD

SEQ ID NO: 31607 - protein, 19 aa, Artificial Sequence
  Description of Artificial Sequence: Synthetic peptide
  XENP021559 vhCDR2
EIRTKANNHATYYAESVKG

SEQ ID NO: 31608 - protein, 10 aa, Artificial Sequence
  Description of Artificial Sequence: Synthetic peptide
  XENP021559 vhCDR3
LATWDWYFDV

SEQ ID NO: 31609 - protein, 218 aa, Artificial Sequence; identical to SEQ ID NO: 20280
  Description of Artificial Sequence: Synthetic polypeptide
  XENP021559 7G8_H3.4_L0.59_Fab Light Chain

SEQ ID NO: 31610 - protein, 111 aa, Artificial Sequence; identical to SEQ ID NO: 20281
  Description of Artificial Sequence: Synthetic polypeptide
  VL of XENP021559

SEQ ID NO: 31611 - protein, 15 aa, Artificial Sequence
  Description of Artificial Sequence: Synthetic peptide
  XENP021559 vlCDR1
KASQSVDYDGDSYMN

SEQ ID NO: 31612 - protein, 7 aa, Artificial Sequence
  Description of Artificial Sequence: Synthetic peptide
  XENP021559 vlCDR2
AASELES

SEQ ID NO: 31613 - protein, 9 aa, Artificial Sequence
  Description of Artificial Sequence: Synthetic peptide
  XENP021559 vlCDR3
QQSNEDPFT

SEQ ID NO: 31614 - protein, 226 aa, Artificial Sequence; identical to SEQ ID NO: 30404
  Description of Artificial Sequence: Synthetic polypeptide
  XENP021560 7G8_H0.129_L0.59_Fab Heavy Chain

SEQ ID NO: 31615 - protein, 121 aa, Artificial Sequence; identical to SEQ ID NO: 19496
  Description of Artificial Sequence: Synthetic polypeptide
  VH of XENP021560

SEQ ID NO: 31616 - protein, 5 aa, Artificial Sequence
  Description of Artificial Sequence: Synthetic peptide
  XENP021560 vhCDR1
DAWMD

SEQ ID NO: 31617 - protein, 19 aa, Artificial Sequence
  Description of Artificial Sequence: Synthetic peptide
  XENP021560 vhCDR2
EIRTKANNHATYYAESVKG

SEQ ID NO: 31618 - protein, 10 aa, Artificial Sequence
  Description of Artificial Sequence: Synthetic peptide
  XENP021560 vhCDR3
LATWDWYFDV

SEQ ID NO: 31619 - protein, 218 aa, Artificial Sequence; identical to SEQ ID NO: 20280
  Description of Artificial Sequence: Synthetic polypeptide
  XENP021560 7G8_H0.129_L0.59_Fab Light Chain

SEQ ID NO: 31620 - protein, 111 aa, Artificial Sequence; identical to SEQ ID NO: 20281
  Description of Artificial Sequence: Synthetic polypeptide
  VL of XENP021560

SEQ ID NO: 31621 - protein, 15 aa, Artificial Sequence
  Description of Artificial Sequence: Synthetic peptide
  XENP021560 vlCDR1
KASQSVDYDGDSYMN

SEQ ID NO: 31622 - protein, 7 aa, Artificial Sequence
  Description of Artificial Sequence: Synthetic peptide
  XENP021560 vlCDR2
AASELES

SEQ ID NO: 31623 - protein, 9 aa, Artificial Sequence
  Description of Artificial Sequence: Synthetic peptide
  XENP021560 vlCDR3
QQSNEDPFT

SEQ ID NO: 31624 - protein, 226 aa, Artificial Sequence; identical to SEQ ID NO: 29454
  Description of Artificial Sequence: Synthetic polypeptide
  XENP021561 7G8_H0.31_L0.59_Fab Heavy Chain

SEQ ID NO: 31625 - protein, 121 aa, Artificial Sequence; identical to SEQ ID NO: 18516
  Description of Artificial Sequence: Synthetic polypeptide
  VH of XENP021561

SEQ ID NO: 31626 - protein, 5 aa, Artificial Sequence
  Description of Artificial Sequence: Synthetic peptide
  XENP021561 vhCDR1
DAWMD

SEQ ID NO: 31627 - protein, 19 aa, Artificial Sequence
  Description of Artificial Sequence: Synthetic peptide
  XENP021561 vhCDR2
EISTKANNHATYYAESVKG

SEQ ID NO: 31628 - protein, 10 aa, Artificial Sequence
  Description of Artificial Sequence: Synthetic peptide
  XENP021561 vhCDR3
LANWDWYFDV

SEQ ID NO: 31629 - protein, 218 aa, Artificial Sequence; identical to SEQ ID NO: 20280
  Description of Artificial Sequence: Synthetic polypeptide
  XENP021561 7G8_H0.31_L0.59_Fab Light Chain

SEQ ID NO: 31630 - protein, 111 aa, Artificial Sequence; identical to SEQ ID NO: 20281
  Description of Artificial Sequence: Synthetic polypeptide
  VL of XENP021561

SEQ ID NO: 31631 - protein, 15 aa, Artificial Sequence
  Description of Artificial Sequence: Synthetic peptide
  XENP021561 vlCDR1
KASQSVDYDGDSYMN

SEQ ID NO: 31632 - protein, 7 aa, Artificial Sequence
  Description of Artificial Sequence: Synthetic peptide
  XENP021561 vlCDR2
AASELES

SEQ ID NO: 31633 - protein, 9 aa, Artificial Sequence
  Description of Artificial Sequence: Synthetic peptide
  XENP021561 vlCDR3
QQSNEDPFT

SEQ ID NO: 31634 - protein, 226 aa, Artificial Sequence; identical to SEQ ID NO: 30174
  Description of Artificial Sequence: Synthetic polypeptide
  XENP021562 7G8_H0.103_L0.59_Fab Heavy Chain

SEQ ID NO: 31635 - protein, 121 aa, Artificial Sequence; identical to SEQ ID NO: 19236
  Description of Artificial Sequence: Synthetic polypeptide
  VH of XENP021562

SEQ ID NO: 31636 - protein, 5 aa, Artificial Sequence
  Description of Artificial Sequence: Synthetic peptide
  XENP021562 vhCDR1
DAWMD

SEQ ID NO: 31637 - protein, 19 aa, Artificial Sequence
  Description of Artificial Sequence: Synthetic peptide
  XENP021562 vhCDR2
EIRTKANNHATDYAESVKG

SEQ ID NO: 31638 - protein, 10 aa, Artificial Sequence
  Description of Artificial Sequence: Synthetic peptide
  XENP021562 vhCDR3
LANWDWYFDV

SEQ ID NO: 31639 - protein, 218 aa, Artificial Sequence; identical to SEQ ID NO: 20280
  Description of Artificial Sequence: Synthetic polypeptide
  XENP021562 7G8_H0.103_L0.59_Fab Light Chain

SEQ ID NO: 31640 - protein, 111 aa, Artificial Sequence; identical to SEQ ID NO: 20281
  Description of Artificial Sequence: Synthetic polypeptide
  VL of XENP021562

SEQ ID NO: 31641 - protein, 15 aa, Artificial Sequence
  Description of Artificial Sequence: Synthetic peptide
  XENP021562 vlCDR1
KASQSVDYDGDSYMN

SEQ ID NO: 31642 - protein, 7 aa, Artificial Sequence
  Description of Artificial Sequence: Synthetic peptide
  XENP021562 vlCDR2
AASELES

SEQ ID NO: 31643 - protein, 9 aa, Artificial Sequence
  Description of Artificial Sequence: Synthetic peptide
  XENP021562 vlCDR3
QQSNEDPFT

SEQ ID NO: 31644 - protein, 226 aa, Artificial Sequence; identical to SEQ ID NO: 29854
  Description of Artificial Sequence: Synthetic polypeptide
  XENP021563 7G8_H0.71_L0.59_Fab Heavy Chain

SEQ ID NO: 31645 - protein, 121 aa, Artificial Sequence; identical to SEQ ID NO: 18916
  Description of Artificial Sequence: Synthetic polypeptide
  VH of XENP021563

SEQ ID NO: 31646 - protein, 5 aa, Artificial Sequence
  Description of Artificial Sequence: Synthetic peptide
  XENP021563 vhCDR1
DAWMD

SEQ ID NO: 31647 - protein, 19 aa, Artificial Sequence
  Description of Artificial Sequence: Synthetic peptide
  XENP021563 vhCDR2
EIRTKAYNHATYYAESVKG

SEQ ID NO: 31648 - protein, 10 aa, Artificial Sequence
  Description of Artificial Sequence: Synthetic peptide
  XENP021563 vhCDR3
LANWDWYFDV

SEQ ID NO: 31649 - protein, 218 aa, Artificial Sequence; identical to SEQ ID NO: 20280
  Description of Artificial Sequence: Synthetic polypeptide
  XENP021563 7G8_H0.71_L0.59_Fab Light Chain

SEQ ID NO: 31650 - protein, 111 aa, Artificial Sequence; identical to SEQ ID NO: 20281
  Description of Artificial Sequence: Synthetic polypeptide
  VL of XENP021563

SEQ ID NO: 31651 - protein, 15 aa, Artificial Sequence
  Description of Artificial Sequence: Synthetic peptide
  XENP021563 vlCDR1
KASQSVDYDGDSYMN

SEQ ID NO: 31652 - protein, 7 aa, Artificial Sequence
  Description of Artificial Sequence: Synthetic peptide
  XENP021563 vlCDR2
AASELES

SEQ ID NO: 31653 - protein, 9 aa, Artificial Sequence
  Description of Artificial Sequence: Synthetic peptide
  XENP021563 vlCDR3
QQSNEDPFT

SEQ ID NO: 31654 - protein, 226 aa, Artificial Sequence; identical to SEQ ID NO: 28944
  Description of Artificial Sequence: Synthetic polypeptide
  XENP021564 7G8_H3.1_L0_Fab Heavy Chain

SEQ ID NO: 31655 - protein, 121 aa, Artificial Sequence; identical to SEQ ID NO: 28945
  Description of Artificial Sequence: Synthetic polypeptide
  VH of XENP021564

SEQ ID NO: 31656 - protein, 5 aa, Artificial Sequence
  Description of Artificial Sequence: Synthetic peptide
  XENP021564 vhCDR1
DAWMD

SEQ ID NO: 31657 - protein, 19 aa, Artificial Sequence
  Description of Artificial Sequence: Synthetic peptide
  XENP021564 vhCDR2
EIRTKANNHATYYAESVKG

SEQ ID NO: 31658 - protein, 10 aa, Artificial Sequence
  Description of Artificial Sequence: Synthetic peptide
  XENP021564 vhCDR3
LATWDWYFDV

SEQ ID NO: 31659 - protein, 218 aa, Artificial Sequence; identical to SEQ ID NO: 17590
  Description of Artificial Sequence: Synthetic polypeptide
  XENP021564 7G8_H3.1_L0_Fab Light Chain

SEQ ID NO: 31660 - protein, 111 aa, Artificial Sequence; identical to SEQ ID NO: 17591
  Description of Artificial Sequence: Synthetic polypeptide
  VL of XENP021564

SEQ ID NO: 31661 - protein, 15 aa, Artificial Sequence
  Description of Artificial Sequence: Synthetic peptide
  XENP021564 vlCDR1
KASQSVDYDGDSYMN

SEQ ID NO: 31662 - protein, 7 aa, Artificial Sequence
  Description of Artificial Sequence: Synthetic peptide
  XENP021564 vlCDR2
AASNLES

SEQ ID NO: 31663 - protein, 9 aa, Artificial Sequence
  Description of Artificial Sequence: Synthetic peptide
  XENP021564 vlCDR3
QQSNEDPFT

SEQ ID NO: 31664 - protein, 226 aa, Artificial Sequence; identical to SEQ ID NO: 28974
  Description of Artificial Sequence: Synthetic polypeptide
  XENP021565 7G8_H3.4_L0_Fab Heavy Chain

SEQ ID NO: 31665 - protein, 121 aa, Artificial Sequence; identical to SEQ ID NO: 28975
  Description of Artificial Sequence: Synthetic polypeptide
  VH of XENP021565

SEQ ID NO: 31666 - protein, 5 aa, Artificial Sequence
  Description of Artificial Sequence: Synthetic peptide
  XENP021565 vhCDR1
DAWMD

SEQ ID NO: 31667 - protein, 19 aa, Artificial Sequence
  Description of Artificial Sequence: Synthetic peptide
  XENP021565 vhCDR2
EIRTKANNHATYYAESVKG

SEQ ID NO: 31668 - protein, 10 aa, Artificial Sequence
  Description of Artificial Sequence: Synthetic peptide
  XENP021565 vhCDR3
LATWDWYFDV

SEQ ID NO: 31669 - protein, 218 aa, Artificial Sequence; identical to SEQ ID NO: 17590
  Description of Artificial Sequence: Synthetic polypeptide
  XENP021565 7G8_H3.4_L0_Fab Light Chain

SEQ ID NO: 31670 - protein, 111 aa, Artificial Sequence; identical to SEQ ID NO: 17591
  Description of Artificial Sequence: Synthetic polypeptide
  VL of XENP021565

SEQ ID NO: 31671 - protein, 15 aa, Artificial Sequence
  Description of Artificial Sequence: Synthetic peptide
  XENP021565 vlCDR1
KASQSVDYDGDSYMN

SEQ ID NO: 31672 - protein, 7 aa, Artificial Sequence
  Description of Artificial Sequence: Synthetic peptide
  XENP021565 vlCDR2
AASNLES

SEQ ID NO: 31673 - protein, 9 aa, Artificial Sequence
  Description of Artificial Sequence: Synthetic peptide
  XENP021565 vlCDR3
QQSNEDPFT

SEQ ID NO: 31674 - protein, 226 aa, Artificial Sequence; identical to SEQ ID NO: 28944
  Description of Artificial Sequence: Synthetic polypeptide
  XENP021566 7G8_H3.1_L0.11_Fab Heavy Chain

SEQ ID NO: 31675 - protein, 121 aa, Artificial Sequence; identical to SEQ ID NO: 28945
  Description of Artificial Sequence: Synthetic polypeptide
  VH of XENP021566

SEQ ID NO: 31676 - protein, 5 aa, Artificial Sequence
  Description of Artificial Sequence: Synthetic peptide
  XENP021566 vhCDR1
DAWMD

SEQ ID NO: 31677 - protein, 19 aa, Artificial Sequence
  Description of Artificial Sequence: Synthetic peptide
  XENP021566 vhCDR2
EIRTKANNHATYYAESVKG

SEQ ID NO: 31678 - protein, 10 aa, Artificial Sequence
  Description of Artificial Sequence: Synthetic peptide
  XENP021566 vhCDR3
LATWDWYFDV

SEQ ID NO: 31679 - protein, 218 aa, Artificial Sequence; identical to SEQ ID NO: 19800
  Description of Artificial Sequence: Synthetic polypeptide
  XENP021566 7G8_H3.1_L0.11_Fab Light Chain

SEQ ID NO: 31680 - protein, 111 aa, Artificial Sequence; identical to SEQ ID NO: 19801
  Description of Artificial Sequence: Synthetic polypeptide
  VL of XENP021566

SEQ ID NO: 31681 - protein, 15 aa, Artificial Sequence
  Description of Artificial Sequence: Synthetic peptide
  XENP021566 vlCDR1
KASQSVDHDGDSYMN

SEQ ID NO: 31682 - protein, 7 aa, Artificial Sequence
  Description of Artificial Sequence: Synthetic peptide
  XENP021566 vlCDR2
AASNLES

SEQ ID NO: 31683 - protein, 9 aa, Artificial Sequence
  Description of Artificial Sequence: Synthetic peptide
  XENP021566 vlCDR3
QQSNEDPFT

SEQ ID NO: 31684 - protein, 226 aa, Artificial Sequence; identical to SEQ ID NO: 28974
  Description of Artificial Sequence: Synthetic polypeptide
  XENP021567 7G8_H3.4_L0.11_Fab Heavy Chain

SEQ ID NO: 31685 - protein, 121 aa, Artificial Sequence; identical to SEQ ID NO: 28975
  Description of Artificial Sequence: Synthetic polypeptide
  VH of XENP021567

SEQ ID NO: 31686 - protein, 5 aa, Artificial Sequence
  Description of Artificial Sequence: Synthetic peptide
  XENP021567 vhCDR1
DAWMD

SEQ ID NO: 31687 - protein, 19 aa, Artificial Sequence
  Description of Artificial Sequence: Synthetic peptide
  XENP021567 vhCDR2
EIRTKANNHATYYAESVKG

SEQ ID NO: 31688 - protein, 10 aa, Artificial Sequence
  Description of Artificial Sequence: Synthetic peptide
  XENP021567 vhCDR3
LATWDWYFDV

SEQ ID NO: 31689 - protein, 218 aa, Artificial Sequence; identical to SEQ ID NO: 19800
  Description of Artificial Sequence: Synthetic polypeptide
  XENP021567 7G8_H3.4_L0.11_Fab Light Chain

SEQ ID NO: 31690 - protein, 111 aa, Artificial Sequence; identical to SEQ ID NO: 19801
  Description of Artificial Sequence: Synthetic polypeptide
  VL of XENP021567

SEQ ID NO: 31691 - protein, 15 aa, Artificial Sequence
  Description of Artificial Sequence: Synthetic peptide
  XENP021567 vlCDR1
KASQSVDHDGDSYMN

SEQ ID NO: 31692 - protein, 7 aa, Artificial Sequence
  Description of Artificial Sequence: Synthetic peptide
  XENP021567 vlCDR2
AASNLES

SEQ ID NO: 31693 - protein, 9 aa, Artificial Sequence
  Description of Artificial Sequence: Synthetic peptide
  XENP021567 vlCDR3
QQSNEDPFT

SEQ ID NO: 31694 - protein, 226 aa, Artificial Sequence; identical to SEQ ID NO: 30404
  Description of Artificial Sequence: Synthetic polypeptide
  XENP021568 7G8_H0.129_L0.11_Fab Heavy Chain

SEQ ID NO: 31695 - protein, 121 aa, Artificial Sequence; identical to SEQ ID NO: 19496
  Description of Artificial Sequence: Synthetic polypeptide
  VH of XENP021568

SEQ ID NO: 31696 - protein, 5 aa, Artificial Sequence
  Description of Artificial Sequence: Synthetic peptide
  XENP021568 vhCDR1
DAWMD

SEQ ID NO: 31697 - protein, 19 aa, Artificial Sequence
  Description of Artificial Sequence: Synthetic peptide
  XENP021568 vhCDR2
EIRTKANNHATYYAESVKG

SEQ ID NO: 31698 - protein, 10 aa, Artificial Sequence
  Description of Artificial Sequence: Synthetic peptide
  XENP021568 vhCDR3
LATWDWYFDV

SEQ ID NO: 31699 - protein, 218 aa, Artificial Sequence; identical to SEQ ID NO: 19800
  Description of Artificial Sequence: Synthetic polypeptide
  XENP021568 7G8_H0.129_L0.11_Fab Light Chain

SEQ ID NO: 31700 - protein, 111 aa, Artificial Sequence; identical to SEQ ID NO: 19801
  Description of Artificial Sequence: Synthetic polypeptide
  VL of XENP021568

SEQ ID NO: 31701 - protein, 15 aa, Artificial Sequence
  Description of Artificial Sequence: Synthetic peptide
  XENP021568 vlCDR1
KASQSVDHDGDSYMN

SEQ ID NO: 31702 - protein, 7 aa, Artificial Sequence
  Description of Artificial Sequence: Synthetic peptide
  XENP021568 vlCDR2
AASNLES

SEQ ID NO: 31703 - protein, 9 aa, Artificial Sequence
  Description of Artificial Sequence: Synthetic peptide
  XENP021568 vlCDR3
QQSNEDPFT

SEQ ID NO: 31704 - protein, 226 aa, Artificial Sequence; identical to SEQ ID NO: 28944
  Description of Artificial Sequence: Synthetic polypeptide
  XENP021569 7G8_H3.1_L0.34_Fab Heavy Chain

SEQ ID NO: 31705 - protein, 121 aa, Artificial Sequence; identical to SEQ ID NO: 28945
  Description of Artificial Sequence: Synthetic polypeptide
  VH of XENP021569

SEQ ID NO: 31706 - protein, 5 aa, Artificial Sequence
  Description of Artificial Sequence: Synthetic peptide
  XENP021569 vhCDR1
DAWMD

SEQ ID NO: 31707 - protein, 19 aa, Artificial Sequence
  Description of Artificial Sequence: Synthetic peptide
  XENP021569 vhCDR2
EIRTKANNHATYYAESVKG

SEQ ID NO: 31708 - protein, 10 aa, Artificial Sequence
  Description of Artificial Sequence: Synthetic peptide
  XENP021569 vhCDR3
LATWDWYFDV

SEQ ID NO: 31709 - protein, 218 aa, Artificial Sequence; identical to SEQ ID NO: 20030
  Description of Artificial Sequence: Synthetic polypeptide
  XENP021569 7G8_H3.1_L0.34_Fab Light Chain

SEQ ID NO: 31710 - protein, 111 aa, Artificial Sequence; identical to SEQ ID NO: 20031
  Description of Artificial Sequence: Synthetic polypeptide
  VL of XENP021569

SEQ ID NO: 31711 - protein, 15 aa, Artificial Sequence
  Description of Artificial Sequence: Synthetic peptide
  XENP021569 vlCDR1
KASQSVDYDDDSYMN

SEQ ID NO: 31712 - protein, 7 aa, Artificial Sequence
  Description of Artificial Sequence: Synthetic peptide
  XENP021569 vlCDR2
AASNLES

SEQ ID NO: 31713 - protein, 9 aa, Artificial Sequence
  Description of Artificial Sequence: Synthetic peptide
  XENP021569 vlCDR3
QQSNEDPFT

SEQ ID NO: 31714 - protein, 226 aa, Artificial Sequence; identical to SEQ ID NO: 28974
  Description of Artificial Sequence: Synthetic polypeptide
  XENP021570 7G8_H3.4_L0.34_Fab Heavy Chain

SEQ ID NO: 31715 - protein, 121 aa, Artificial Sequence; identical to SEQ ID NO: 28975
  Description of Artificial Sequence: Synthetic polypeptide
  VH of XENP021570

SEQ ID NO: 31716 - protein, 5 aa, Artificial Sequence
  Description of Artificial Sequence: Synthetic peptide
  XENP021570 vhCDR1
DAWMD

SEQ ID NO: 31717 - protein, 19 aa, Artificial Sequence
  Description of Artificial Sequence: Synthetic peptide
  XENP021570 vhCDR2
EIRTKANNHATYYAESVKG

SEQ ID NO: 31718 - protein, 10 aa, Artificial Sequence
  Description of Artificial Sequence: Synthetic peptide
  XENP021570 vhCDR3
LATWDWYFDV

SEQ ID NO: 31719 - protein, 218 aa, Artificial Sequence; identical to SEQ ID NO: 20030
  Description of Artificial Sequence: Synthetic polypeptide
  XENP021570 7G8_H3.4_L0.34_Fab Light Chain

SEQ ID NO: 31720 - protein, 111 aa, Artificial Sequence; identical to SEQ ID NO: 20031
  Description of Artificial Sequence: Synthetic polypeptide
  VL of XENP021570

SEQ ID NO: 31721 - protein, 15 aa, Artificial Sequence
  Description of Artificial Sequence: Synthetic peptide
  XENP021570 vlCDR1
KASQSVDYDDDSYMN

SEQ ID NO: 31722 - protein, 7 aa, Artificial Sequence
  Description of Artificial Sequence: Synthetic peptide
  XENP021570 vlCDR2
AASNLES

SEQ ID NO: 31723 - protein, 9 aa, Artificial Sequence
  Description of Artificial Sequence: Synthetic peptide
  XENP021570 vlCDR3
QQSNEDPFT

SEQ ID NO: 31724 - protein, 226 aa, Artificial Sequence; identical to SEQ ID NO: 30404
  Description of Artificial Sequence: Synthetic polypeptide
  XENP021571 7G8_H0.129_L0.34_Fab Heavy Chain

SEQ ID NO: 31725 - protein, 121 aa, Artificial Sequence; identical to SEQ ID NO: 19496
  Description of Artificial Sequence: Synthetic polypeptide
  VH of XENP021571

SEQ ID NO: 31726 - protein, 5 aa, Artificial Sequence
  Description of Artificial Sequence: Synthetic peptide
  XENP021571 vhCDR1
DAWMD

SEQ ID NO: 31727 - protein, 19 aa, Artificial Sequence
  Description of Artificial Sequence: Synthetic peptide
  XENP021571 vhCDR2
EIRTKANNHATYYAESVKG

SEQ ID NO: 31728 - protein, 10 aa, Artificial Sequence
  Description of Artificial Sequence: Synthetic peptide
  XENP021571 vhCDR3
LATWDWYFDV

SEQ ID NO: 31729 - protein, 218 aa, Artificial Sequence; identical to SEQ ID NO: 20030
  Description of Artificial Sequence: Synthetic polypeptide
  XENP021571 7G8_H0.129_L0.34_Fab Light Chain

SEQ ID NO: 31730 - protein, 111 aa, Artificial Sequence; identical to SEQ ID NO: 20031
  Description of Artificial Sequence: Synthetic polypeptide
  VL of XENP021571

SEQ ID NO: 31731 - protein, 15 aa, Artificial Sequence
  Description of Artificial Sequence: Synthetic peptide
  XENP021571 vlCDR1
KASQSVDYDDDSYMN

SEQ ID NO: 31732 - protein, 7 aa, Artificial Sequence
  Description of Artificial Sequence: Synthetic peptide
  XENP021571 vlCDR2
AASNLES

SEQ ID NO: 31733 - protein, 9 aa, Artificial Sequence
  Description of Artificial Sequence: Synthetic peptide
  XENP021571 vlCDR3
QQSNEDPFT

SEQ ID NO: 31734 - protein, 226 aa, Artificial Sequence
  Description of Artificial Sequence: Synthetic polypeptide
  XENP021662 7G8_H3.18_L1_Fab Heavy Chain
EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31735 - protein, 121 aa, Artificial Sequence; identical to SEQ ID NO: 22325
  Description of Artificial Sequence: Synthetic polypeptide
  VH of XENP021662

SEQ ID NO: 31736 - protein, 5 aa, Artificial Sequence
  Description of Artificial Sequence: Synthetic peptide
  XENP021662 vhCDR1
DAWMD

SEQ ID NO: 31737 - protein, 19 aa, Artificial Sequence
  Description of Artificial Sequence: Synthetic peptide
  XENP021662 vhCDR2
EISTKANNHATYYAESVKG

SEQ ID NO: 31738 - protein, 10 aa, Artificial Sequence
  Description of Artificial Sequence: Synthetic peptide
  XENP021662 vhCDR3
LATWDWYFDV

SEQ ID NO: 31739 - protein, 218 aa, Artificial Sequence; identical to SEQ ID NO: 17600
  Description of Artificial Sequence: Synthetic polypeptide
  XENP021662 7G8_H3.18_L1_Fab Light Chain

SEQ ID NO: 31740 - protein, 111 aa, Artificial Sequence; identical to SEQ ID NO: 17601
  Description of Artificial Sequence: Synthetic polypeptide
  VL of XENP021662

SEQ ID NO: 31741 - protein, 15 aa, Artificial Sequence
  Description of Artificial Sequence: Synthetic peptide
  XENP021662 vlCDR1
RASQSVDYDGDSYMN

SEQ ID NO: 31742 - protein, 7 aa, Artificial Sequence
  Description of Artificial Sequence: Synthetic peptide
  XENP021662 vlCDR2
AASNLES

SEQ ID NO: 31743 - protein, 9 aa, Artificial Sequence
  Description of Artificial Sequence: Synthetic peptide
  XENP021662 vlCDR3
QQSNEDPFT

SEQ ID NO: 31744 - protein, 226 aa, Artificial Sequence
  Description of Artificial Sequence: Synthetic polypeptide
  XENP021663 7G8_H3.15_L1_Fab Heavy Chain
EVQLVESGGGLVQPGGSLRLSCAASGDTFDDAWMDWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31745 - protein, 121 aa, Artificial Sequence; identical to SEQ ID NO: 22365
  Description of Artificial Sequence: Synthetic polypeptide
  VH of XENP021663

SEQ ID NO: 31746 - protein, 5 aa, Artificial Sequence
  Description of Artificial Sequence: Synthetic peptide
  XENP021663 vhCDR1
DAWMD

SEQ ID NO: 31747 - protein, 19 aa, Artificial Sequence
  Description of Artificial Sequence: Synthetic peptide
  XENP021663 vhCDR2
EISTKANNHATYYAESVKG

SEQ ID NO: 31748 - protein, 10 aa, Artificial Sequence
  Description of Artificial Sequence: Synthetic peptide
  XENP021663 vhCDR3
LATWDWYFDV

SEQ ID NO: 31749 - protein, 218 aa, Artificial Sequence; identical to SEQ ID NO: 17600
  Description of Artificial Sequence: Synthetic polypeptide
  XENP021663 7G8_H3.15_L1_Fab Light Chain

SEQ ID NO: 31750 - protein, 111 aa, Artificial Sequence; identical to SEQ ID NO: 17601
  Description of Artificial Sequence: Synthetic polypeptide
  VL of XENP021663

SEQ ID NO: 31751 - protein, 15 aa, Artificial Sequence
  Description of Artificial Sequence: Synthetic peptide
  XENP021663 vlCDR1
RASQSVDYDGDSYMN

SEQ ID NO: 31752 - protein, 7 aa, Artificial Sequence
  Description of Artificial Sequence: Synthetic peptide
  XENP021663 vlCDR2
AASNLES

SEQ ID NO: 31753 - protein, 9 aa, Artificial Sequence
  Description of Artificial Sequence: Synthetic peptide
  XENP021663 vlCDR3
QQSNEDPFT

SEQ ID NO: 31754 - protein, 226 aa, Artificial Sequence
  Description of Artificial Sequence: Synthetic polypeptide
  XENP021664 7G8_H3.19_L1_Fab Heavy Chain
EVQLVESGGGLVQPGGSLRLSCAASGFTFDDAWMDWVRQAPGKGLEWVAEIRTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31755 - protein, 121 aa, Artificial Sequence
  Description of Artificial Sequence: Synthetic polypeptide
  VH of XENP021664
EVQLVESGGGLVQPGGSLRLSCAASGFTFDDAWMDWVRQAPGKGLEWVAEIRTKAYNHATYYAESVKGRFTISRDDSKSSVYLQMNSLRAEDTAVYYCTRLATWDWYFDVWGQGTTVTVSS

SEQ ID NO: 31756 - protein, 5 aa, Artificial Sequence
  Description of Artificial Sequence: Synthetic peptide
  XENP021664 vhCDR1
DAWMD

SEQ ID NO: 31757 - protein, 19 aa, Artificial Sequence
  Description of Artificial Sequence: Synthetic peptide
  XENP021664 vhCDR2
EIRTKAYNHATYYAESVKG

SEQ ID NO: 31758 - protein, 10 aa, Artificial Sequence
  Description of Artificial Sequence: Synthetic peptide
  XENP021664 vhCDR3
LATWDWYFDV

SEQ ID NO: 31759 - protein, 218 aa, Artificial Sequence; identical to SEQ ID NO: 17600
  Description of Artificial Sequence: Synthetic polypeptide
  XENP021664 7G8_H3.19_L1_Fab Light Chain

SEQ ID NO: 31760 - protein, 111 aa, Artificial Sequence; identical to SEQ ID NO: 17601
  Description of Artificial Sequence: Synthetic polypeptide
  VL of XENP021664

SEQ ID NO: 31761 - protein, 15 aa, Artificial Sequence
  Description of Artificial Sequence: Synthetic peptide
  XENP021664 vlCDR1
RASQSVDYDGDSYMN

SEQ ID NO: 31762 - protein, 7 aa, Artificial Sequence
  Description of Artificial Sequence: Synthetic peptide
  XENP021664 vlCDR2
AASNLES

SEQ ID NO: 31763 - protein, 9 aa, Artificial Sequence
  Description of Artificial Sequence: Synthetic peptide
  XENP021664 vlCDR3
QQSNEDPFT

SEQ ID NO: 31764 - protein, 226 aa, Artificial Sequence
  Description of Artificial Sequence: Synthetic polypeptide
  XENP021665 7G8_H3.17_L1_Fab Heavy Chain
EVQLVESGGGLVQPGGSLRLSCAASGDTFDDAWMDWVRQAPGKGLEWVAEIRTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31765 - protein, 121 aa, Artificial Sequence
  Description of Artificial Sequence: Synthetic polypeptide
  VH of XENP021665
EVQLVESGGGLVQPGGSLRLSCAASGDTFDDAWMDWVRQAPGKGLEWVAEIRTKAYNHATYYAESVKGRFTISRDDSKSSVYLQMNSLRAEDTAVYYCTRLATWDWYFDVWGQGTTVTVSS

SEQ ID NO: 31766 - protein, 5 aa, Artificial Sequence
  Description of Artificial Sequence: Synthetic peptide
  XENP021665 vhCDR1
DAWMD

SEQ ID NO: 31767 - protein, 19 aa, Artificial Sequence
  Description of Artificial Sequence: Synthetic peptide
  XENP021665 vhCDR2
EIRTKAYNHATYYAESVKG

SEQ ID NO: 31768 - protein, 10 aa, Artificial Sequence
  Description of Artificial Sequence: Synthetic peptide
  XENP021665 vhCDR3
LATWDWYFDV

SEQ ID NO: 31769 - protein, 218 aa, Artificial Sequence; identical to SEQ ID NO: 17600
  Description of Artificial Sequence: Synthetic polypeptide
  XENP021665 7G8_H3.17_L1_Fab Light Chain

SEQ ID NO: 31770 - protein, 111 aa, Artificial Sequence; identical to SEQ ID NO: 17601
  Description of Artificial Sequence: Synthetic polypeptide
  VL of XENP021665

SEQ ID NO: 31771 - protein, 15 aa, Artificial Sequence
  Description of Artificial Sequence: Synthetic peptide
  XENP021665 vlCDR1
RASQSVDYDGDSYMN

SEQ ID NO: 31772 - protein, 7 aa, Artificial Sequence
  Description of Artificial Sequence: Synthetic peptide
  XENP021665 vlCDR2
AASNLES

SEQ ID NO: 31773 - protein, 9 aa, Artificial Sequence
  Description of Artificial Sequence: Synthetic peptide
  XENP021665 vlCDR3
QQSNEDPFT

SEQ ID NO: 31774 - protein, 226 aa, Artificial Sequence
  Description of Artificial Sequence: Synthetic polypeptide
  XENP021666 7G8_H3.16_L1_Fab Heavy Chain
EVQLVESGGGLVQPGGSLRLSCAASGDTFDDAWMDWVRQAPGKGLEWVAEIRTKANNHATDYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31775 - protein, 121 aa, Artificial Sequence
  Description of Artificial Sequence: Synthetic polypeptide
  VH of XENP021666
EVQLVESGGGLVQPGGSLRLSCAASGDTFDDAWMDWVRQAPGKGLEWVAEIRTKANNHATDYAESVKGRFTISRDDSKSSVYLQMNSLRAEDTAVYYCTRLATWDWYFDVWGQGTTVTVSS

SEQ ID NO: 31776 - protein, 5 aa, Artificial Sequence
  Description of Artificial Sequence: Synthetic peptide
  XENP021666 vhCDR1
DAWMD

SEQ ID NO: 31777 - protein, 19 aa, Artificial Sequence
  Description of Artificial Sequence: Synthetic peptide
  XENP021666 vhCDR2
EIRTKANNHATDYAESVKG

SEQ ID NO: 31778 - protein, 10 aa, Artificial Sequence
  Description of Artificial Sequence: Synthetic peptide
  XENP021666 vhCDR3
LATWDWYFDV

SEQ ID NO: 31779 - protein, 218 aa, Artificial Sequence; identical to SEQ ID NO: 17600
  Description of Artificial Sequence: Synthetic polypeptide
  XENP021666 7G8_H3.16_L1_Fab Light Chain

SEQ ID NO: 31780 - protein, 111 aa, Artificial Sequence; identical to SEQ ID NO: 17601
  Description of Artificial Sequence: Synthetic polypeptide
  VL of XENP021666

SEQ ID NO: 31781 - protein, 15 aa, Artificial Sequence
  Description of Artificial Sequence: Synthetic peptide
  XENP021666 vlCDR1
RASQSVDYDGDSYMN

SEQ ID NO: 31782 - protein, 7 aa, Artificial Sequence
  Description of Artificial Sequence: Synthetic peptide
  XENP021666 vlCDR2
AASNLES

SEQ ID NO: 31783 - protein, 9 aa, Artificial Sequence
  Description of Artificial Sequence: Synthetic peptide
  XENP021666 vlCDR3
QQSNEDPFT

SEQ ID NO: 31784 - protein, 226 aa, Artificial Sequence
  Description of Artificial Sequence: Synthetic polypeptide
  XENP021667 7G8_H3.21_L1_Fab Heavy Chain
EVQLVESGGGLVQPGGSLRLSCAASGDTFDDAWMDWVRQAPGKGLEWVAEISTKAYNHATDYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31785 - protein, 121 aa, Artificial Sequence
  Description of Artificial Sequence: Synthetic polypeptide
  VH of XENP021667
EVQLVESGGGLVQPGGSLRLSCAASGDTFDDAWMDWVRQAPGKGLEWVAEISTKAYNHATDYAESVKGRFTISRDDSKSSVYLQMNSLRAEDTAVYYCTRLATWDWYFDVWGQGTTVTVSS

SEQ ID NO: 31786 - protein, 5 aa, Artificial Sequence
  Description of Artificial Sequence: Synthetic peptide
  XENP021667 vhCDR1
DAWMD

SEQ ID NO: 31787 - protein, 19 aa, Artificial Sequence
  Description of Artificial Sequence: Synthetic peptide
  XENP021667 vhCDR2
EISTKAYNHATDYAESVKG

SEQ ID NO: 31788 - protein, 10 aa, Artificial Sequence
  Description of Artificial Sequence: Synthetic peptide
  XENP021667 vhCDR3
LATWDWYFDV

SEQ ID NO: 31789 - protein, 218 aa, Artificial Sequence; identical to SEQ ID NO: 17600
  Description of Artificial Sequence: Synthetic polypeptide
  XENP021667 7G8_H3.21_L1_Fab Light Chain

SEQ ID NO: 31790 - protein, 111 aa, Artificial Sequence; identical to SEQ ID NO: 17601
  Description of Artificial Sequence: Synthetic polypeptide
  VL of XENP021667

SEQ ID NO: 31791 - protein, 15 aa, Artificial Sequence
  Description of Artificial Sequence: Synthetic peptide
  XENP021667 vlCDR1
RASQSVDYDGDSYMN

SEQ ID NO: 31792 - protein, 7 aa, Artificial Sequence
  Description of Artificial Sequence: Synthetic peptide
  XENP021667 vlCDR2
AASNLES

SEQ ID NO: 31793 - protein, 9 aa, Artificial Sequence
  Description of Artificial Sequence: Synthetic peptide
  XENP021667 vlCDR3
QQSNEDPFT

SEQ ID NO: 31794 - protein, 226 aa, Artificial Sequence
  Description of Artificial Sequence: Synthetic polypeptide
  XENP021668 7G8_H3.22_L1_Fab Heavy Chain
EVQLVESGGGLVQPGGSLRLSCAASGFTFDDAWMDWVRQAPGKGLEWVAEISTKAYNHATDYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31795 - protein, 121 aa, Artificial Sequence
  Description of Artificial Sequence: Synthetic polypeptide
  VH of XENP021668
EVQLVESGGGLVQPGGSLRLSCAASGFTFDDAWMDWVRQAPGKGLEWVAEISTKAYNHATDYAESVKGRFTISRDDSKSSVYLQMNSLRAEDTAVYYCTRLATWDWYFDVWGQGTTVTVSS

SEQ ID NO: 31796 - protein, 5 aa, Artificial Sequence
  Description of Artificial Sequence: Synthetic peptide
  XENP021668 vhCDR1
DAWMD

SEQ ID NO: 31797 - protein, 19 aa, Artificial Sequence
  Description of Artificial Sequence: Synthetic peptide
  XENP021668 vhCDR2
EISTKAYNHATDYAESVKG

SEQ ID NO: 31798 - protein, 10 aa, Artificial Sequence
  Description of Artificial Sequence: Synthetic peptide
  XENP021668 vhCDR3
LATWDWYFDV

SEQ ID NO: 31799 - protein, 218 aa, Artificial Sequence; identical to SEQ ID NO: 17600
  Description of Artificial Sequence: Synthetic polypeptide
  XENP021668 7G8_H3.22_L1_Fab Light Chain

SEQ ID NO: 31800 - protein, 111 aa, Artificial Sequence; identical to SEQ ID NO: 17601
  Description of Artificial Sequence: Synthetic polypeptide
  VL of XENP021668

SEQ ID NO: 31801 - protein, 15 aa, Artificial Sequence
  Description of Artificial Sequence: Synthetic peptide
  XENP021668 vlCDR1
RASQSVDYDGDSYMN

SEQ ID NO: 31802 - protein, 7 aa, Artificial Sequence
  Description of Artificial Sequence: Synthetic peptide
  XENP021668 vlCDR2
AASNLES

SEQ ID NO: 31803 - protein, 9 aa, Artificial Sequence
  Description of Artificial Sequence: Synthetic peptide
  XENP021668 vlCDR3
QQSNEDPFT

SEQ ID NO: 31804 - protein, 226 aa, Artificial Sequence
  Description of Artificial Sequence: Synthetic polypeptide
  XENP021669 7G8_H3.23_L1_Fab Heavy Chain
EVQLVESGGGLVQPGGSLRLSCAASGFTFSDAWMDWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31805 - protein, 121 aa, Artificial Sequence; identical to SEQ ID NO: 22385
  Description of Artificial Sequence: Synthetic polypeptide
  VH of XENP021669

SEQ ID NO: 31806 - protein, 5 aa, Artificial Sequence
  Description of Artificial Sequence: Synthetic peptide
  XENP021669 vhCDR1
DAWMD

SEQ ID NO: 31807 - protein, 19 aa, Artificial Sequence
  Description of Artificial Sequence: Synthetic peptide
  XENP021669 vhCDR2
EISTKANNHATYYAESVKG

SEQ ID NO: 31808 - protein, 10 aa, Artificial Sequence
  Description of Artificial Sequence: Synthetic peptide
  XENP021669 vhCDR3
LATWDWYFDV

SEQ ID NO: 31809 - protein, 218 aa, Artificial Sequence; identical to SEQ ID NO: 17600
  Description of Artificial Sequence: Synthetic polypeptide
  XENP021669 7G8_H3.23_L1_Fab Light Chain

SEQ ID NO: 31810 - protein, 111 aa, Artificial Sequence; identical to SEQ ID NO: 17601
  Description of Artificial Sequence: Synthetic polypeptide
  VL of XENP021669

SEQ ID NO: 31811 - protein, 15 aa, Artificial Sequence
  Description of Artificial Sequence: Synthetic peptide
  XENP021669 vlCDR1
RASQSVDYDGDSYMN

SEQ ID NO: 31812 - protein, 7 aa, Artificial Sequence
  Description of Artificial Sequence: Synthetic peptide
  XENP021669 vlCDR2
AASNLES

SEQ ID NO: 31813 - protein, 9 aa, Artificial Sequence
  Description of Artificial Sequence: Synthetic peptide
  XENP021669 vlCDR3
QQSNEDPFT

SEQ ID NO: 31814 - protein, 226 aa, Artificial Sequence; identical to SEQ ID NO: 31734
  Description of Artificial Sequence: Synthetic polypeptide
  XENP021670 7G8_H3.18_L1.11_Fab Heavy Chain

SEQ ID NO: 31815 - protein, 121 aa, Artificial Sequence; identical to SEQ ID NO: 22325
  Description of Artificial Sequence: Synthetic polypeptide
  VH of XENP021670

SEQ ID NO: 31816 - protein, 5 aa, Artificial Sequence
  Description of Artificial Sequence: Synthetic peptide
  XENP021670 vhCDR1
DAWMD

SEQ ID NO: 31817 - protein, 19 aa, Artificial Sequence
  Description of Artificial Sequence: Synthetic peptide
  XENP021670 vhCDR2
EISTKANNHATYYAESVKG

SEQ ID NO: 31818 - protein, 10 aa, Artificial Sequence
  Description of Artificial Sequence: Synthetic peptide
  XENP021670 vhCDR3
LATWDWYFDV

SEQ ID NO: 31819 - protein, 218 aa, Artificial Sequence; identical to SEQ ID NO: 22359
  Description of Artificial Sequence: Synthetic polypeptide
  XENP021670 7G8_H3.18_L1.11_Fab Light Chain

SEQ ID NO: 31820 - protein, 111 aa, Artificial Sequence; identical to SEQ ID NO: 22360
  Description of Artificial Sequence: Synthetic polypeptide
  VL of XENP021670

SEQ ID NO: 31821 - protein, 15 aa, Artificial Sequence
  Description of Artificial Sequence: Synthetic peptide
  XENP021670 vlCDR1
RASQSVDYDGDSYMN

SEQ ID NO: 31822 - protein, 7 aa, Artificial Sequence
  Description of Artificial Sequence: Synthetic peptide
  XENP021670 vlCDR2
AASELES

SEQ ID NO: 31823 - protein, 9 aa, Artificial Sequence
  Description of Artificial Sequence: Synthetic peptide
  XENP021670 vlCDR3
QQSNEDPFT

SEQ ID NO: 31824 - protein, 226 aa, Artificial Sequence; identical to SEQ ID NO: 31744
  Description of Artificial Sequence: Synthetic polypeptide
  XENP021671 7G8_H3.15_L1.11_Fab Heavy Chain

SEQ ID NO: 31825 - protein, 121 aa, Artificial Sequence; identical to SEQ ID NO: 22365
  Description of Artificial Sequence: Synthetic polypeptide
  VH of XENP021671

SEQ ID NO: 31826 - protein, 5 aa, Artificial Sequence
  Description of Artificial Sequence: Synthetic peptide
  XENP021671 vhCDR1
DAWMD

SEQ ID NO: 31827 - protein, 19 aa, Artificial Sequence
  Description of Artificial Sequence: Synthetic peptide
  XENP021671 vhCDR2
EISTKANNHATYYAESVKG

SEQ ID NO: 31828 - protein, 10 aa, Artificial Sequence
  Description of Artificial Sequence: Synthetic peptide
  XENP021671 vhCDR3
LATWDWYFDV

SEQ ID NO: 31829 - protein, 218 aa, Artificial Sequence; identical to SEQ ID NO: 22359
  Description of Artificial Sequence: Synthetic polypeptide
  XENP021671 7G8_H3.15_L1.11_Fab Light Chain

SEQ ID NO: 31830 - protein, 111 aa, Artificial Sequence; identical to SEQ ID NO: 22360
  Description of Artificial Sequence: Synthetic polypeptide
  VL of XENP021671

SEQ ID NO: 31831 - protein, 15 aa, Artificial Sequence
  Description of Artificial Sequence: Synthetic peptide
  XENP021671 vlCDR1
RASQSVDYDGDSYMN

SEQ ID NO: 31832 - protein, 7 aa, Artificial Sequence
  Description of Artificial Sequence: Synthetic peptide
  XENP021671 vlCDR2
AASELES

SEQ ID NO: 31833 - protein, 9 aa, Artificial Sequence
  Description of Artificial Sequence: Synthetic peptide
  XENP021671 vlCDR3
QQSNEDPFT

SEQ ID NO: 31834 - protein, 226 aa, Artificial Sequence; identical to SEQ ID NO: 31754
  Description of Artificial Sequence: Synthetic polypeptide
  XENP021672 7G8_H3.19_L1.11_Fab Heavy Chain

SEQ ID NO: 31835 - protein, 121 aa, Artificial Sequence; identical to SEQ ID NO: 31755
  Description of Artificial Sequence: Synthetic polypeptide
  VH of XENP021672

SEQ ID NO: 31836 - protein, 5 aa, Artificial Sequence
  Description of Artificial Sequence: Synthetic peptide
  XENP021672 vhCDR1
DAWMD

SEQ ID NO: 31837 - protein, 19 aa, Artificial Sequence
  Description of Artificial Sequence: Synthetic peptide
  XENP021672 vhCDR2
EIRTKAYNHATYYAESVKG

SEQ ID NO: 31838 - protein, 10 aa, Artificial Sequence
  Description of Artificial Sequence: Synthetic peptide
  XENP021672 vhCDR3
LATWDWYFDV

SEQ ID NO: 31839 - protein, 218 aa, Artificial Sequence; identical to SEQ ID NO: 22359
  Description of Artificial Sequence: Synthetic polypeptide
  XENP021672 7G8_H3.19_L1.11_Fab Light Chain

SEQ ID NO: 31840 - protein, 111 aa, Artificial Sequence; identical to SEQ ID NO: 22360
  Description of Artificial Sequence: Synthetic polypeptide
  VL of XENP021672

SEQ ID NO: 31841 - protein, 15 aa, Artificial Sequence
  Description of Artificial Sequence: Synthetic peptide
  XENP021672 vlCDR1
RASQSVDYDGDSYMN

SEQ ID NO: 31842 - protein, 7 aa, Artificial Sequence
  Description of Artificial Sequence: Synthetic peptide
  XENP021672 vlCDR2
AASELES

SEQ ID NO: 31843 - protein, 9 aa, Artificial Sequence
  Description of Artificial Sequence: Synthetic peptide
  XENP021672 vlCDR3
QQSNEDPFT

SEQ ID NO: 31844 - protein, 226 aa, Artificial Sequence; identical to SEQ ID NO: 31764
  Description of Artificial Sequence: Synthetic polypeptide
  XENP021673 7G8_H3.17_L1.11_Fab Heavy Chain

SEQ ID NO: 31845 - protein, 121 aa, Artificial Sequence; identical to SEQ ID NO: 31765
  Description of Artificial Sequence: Synthetic polypeptide
  VH of XENP021673

SEQ ID NO: 31846 - protein, 5 aa, Artificial Sequence
  Description of Artificial Sequence: Synthetic peptide
  XENP021673 vhCDR1
DAWMD

SEQ ID NO: 31847 - protein, 19 aa, Artificial Sequence
  Description of Artificial Sequence: Synthetic peptide
  XENP021673 vhCDR2
EIRTKAYNHATYYAESVKG

SEQ ID NO: 31848 - protein, 10 aa, Artificial Sequence
  Description of Artificial Sequence: Synthetic peptide
  XENP021673 vhCDR3
LATWDWYFDV

SEQ ID NO: 31849 - protein, 218 aa, Artificial Sequence; identical to SEQ ID NO: 22359
  Description of Artificial Sequence: Synthetic polypeptide
  XENP021673 7G8_H3.17_L1.11_Fab Light Chain

SEQ ID NO: 31850 - protein, 111 aa, Artificial Sequence; identical to SEQ ID NO: 22360
  Description of Artificial Sequence: Synthetic polypeptide
  VL of XENP021673

SEQ ID NO: 31851 - protein, 15 aa, Artificial Sequence
  Description of Artificial Sequence: Synthetic peptide
  XENP021673 vlCDR1
RASQSVDYDGDSYMN

SEQ ID NO: 31852 - protein, 7 aa, Artificial Sequence
  Description of Artificial Sequence: Synthetic peptide
  XENP021673 vlCDR2
AASELES

SEQ ID NO: 31853 - protein, 9 aa, Artificial Sequence
  Description of Artificial Sequence: Synthetic peptide
  XENP021673 vlCDR3
QQSNEDPFT

SEQ ID NO: 31854 - protein, 226 aa, Artificial Sequence; identical to SEQ ID NO: 31774
  Description of Artificial Sequence: Synthetic polypeptide
  XENP021674 7G8_H3.16_L1.11_Fab Heavy Chain

SEQ ID NO: 31855 - protein, 121 aa, Artificial Sequence; identical to SEQ ID NO: 31775
  Description of Artificial Sequence: Synthetic polypeptide
  VH of XENP021674

SEQ ID NO: 31856 - protein, 5 aa, Artificial Sequence
  Description of Artificial Sequence: Synthetic peptide
  XENP021674 vhCDR1
DAWMD

SEQ ID NO: 31857 - protein, 19 aa, Artificial Sequence
  Description of Artificial Sequence: Synthetic peptide
  XENP021674 vhCDR2
EIRTKANNHATDYAESVKG

SEQ ID NO: 31858 - protein, 10 aa, Artificial Sequence
  Description of Artificial Sequence: Synthetic peptide
  XENP021674 vhCDR3
LATWDWYFDV

SEQ ID NO: 31859 - protein, 218 aa, Artificial Sequence; identical to SEQ ID NO: 22359
  Description of Artificial Sequence: Synthetic polypeptide
  XENP021674 7G8_H3.16_L1.11_Fab Light Chain

SEQ ID NO: 31860 - protein, 111 aa, Artificial Sequence; identical to SEQ ID NO: 22360
  Description of Artificial Sequence: Synthetic polypeptide
  VL of XENP021674

SEQ ID NO: 31861 - protein, 15 aa, Artificial Sequence
  Description of Artificial Sequence: Synthetic peptide
  XENP021674 vlCDR1
RASQSVDYDGDSYMN

SEQ ID NO: 31862 - protein, 7 aa, Artificial Sequence
  Description of Artificial Sequence: Synthetic peptide
  XENP021674 vlCDR2
AASELES

SEQ ID NO: 31863 - protein, 9 aa, Artificial Sequence
  Description of Artificial Sequence: Synthetic peptide
  XENP021674 vlCDR3
QQSNEDPFT

SEQ ID NO: 31864 - protein, 226 aa, Artificial Sequence; identical to SEQ ID NO: 31784
  Description of Artificial Sequence: Synthetic polypeptide
  XENP021675 7G8_H3.21_L1.11_Fab Heavy Chain

SEQ ID NO: 31865 - protein, 121 aa, Artificial Sequence; identical to SEQ ID NO: 31785
  Description of Artificial Sequence: Synthetic polypeptide
  VH of XENP021675

SEQ ID NO: 31866 - protein, 5 aa, Artificial Sequence
  Description of Artificial Sequence: Synthetic peptide
  XENP021675 vhCDR1
DAWMD

SEQ ID NO: 31867 - protein, 19 aa, Artificial Sequence
  Description of Artificial Sequence: Synthetic peptide
  XENP021675 vhCDR2
EISTKAYNHATDYAESVKG

SEQ ID NO: 31868 - protein, 10 aa, Artificial Sequence
  Description of Artificial Sequence: Synthetic peptide
  XENP021675 vhCDR3
LATWDWYFDV

SEQ ID NO: 31869 - protein, 218 aa, Artificial Sequence; identical to SEQ ID NO: 22359
  Description of Artificial Sequence: Synthetic polypeptide
  XENP021675 7G8_H3.21_L1.11_Fab Light Chain

SEQ ID NO: 31870 - protein, 111 aa, Artificial Sequence; identical to SEQ ID NO: 22360
  Description of Artificial Sequence: Synthetic polypeptide
  VL of XENP021675

SEQ ID NO: 31871 - protein, 15 aa, Artificial Sequence
  Description of Artificial Sequence: Synthetic peptide
  XENP021675 vlCDR1
RASQSVDYDGDSYMN

SEQ ID NO: 31872 - protein, 7 aa, Artificial Sequence
  Description of Artificial Sequence: Synthetic peptide
  XENP021675 vlCDR2
AASELES

SEQ ID NO: 31873 - protein, 9 aa, Artificial Sequence
  Description of Artificial Sequence: Synthetic peptide
  XENP021675 vlCDR3
QQSNEDPFT

SEQ ID NO: 31874 - protein, 226 aa, Artificial Sequence; identical to SEQ ID NO: 31794
  Description of Artificial Sequence: Synthetic polypeptide
  XENP021676 7G8_H3.22_L1.11_Fab Heavy Chain

SEQ ID NO: 31875 - protein, 121 aa, Artificial Sequence; identical to SEQ ID NO: 31795
  Description of Artificial Sequence: Synthetic polypeptide
  VH of XENP021676

SEQ ID NO: 31876 - protein, 5 aa, Artificial Sequence
  Description of Artificial Sequence: Synthetic peptide
  XENP021676 vhCDR1
DAWMD

SEQ ID NO: 31877 - protein, 19 aa, Artificial Sequence
  Description of Artificial Sequence: Synthetic peptide
  XENP021676 vhCDR2
EISTKAYNHATDYAESVKG

SEQ ID NO: 31878 - protein, 10 aa, Artificial Sequence
  Description of Artificial Sequence: Synthetic peptide
  XENP021676 vhCDR3
LATWDWYFDV

SEQ ID NO: 31879 - protein, 218 aa, Artificial Sequence; identical to SEQ ID NO: 22359
  Description of Artificial Sequence: Synthetic polypeptide
  XENP021676 7G8_H3.22_L1.11_Fab Light Chain

SEQ ID NO: 31880 - protein, 111 aa, Artificial Sequence; identical to SEQ ID NO: 22360
  Description of Artificial Sequence: Synthetic polypeptide
  VL of XENP021676

SEQ ID NO: 31881 - protein, 15 aa, Artificial Sequence
  Description of Artificial Sequence: Synthetic peptide
  XENP021676 vlCDR1
RASQSVDYDGDSYMN

SEQ ID NO: 31882 - protein, 7 aa, Artificial Sequence
  Description of Artificial Sequence: Synthetic peptide
  XENP021676 vlCDR2
AASELES

SEQ ID NO: 31883 - protein, 9 aa, Artificial Sequence
  Description of Artificial Sequence: Synthetic peptide
  XENP021676 vlCDR3
QQSNEDPFT

SEQ ID NO: 31884 - protein, 226 aa, Artificial Sequence; identical to SEQ ID NO: 31804
  Description of Artificial Sequence: Synthetic polypeptide
  XENP021677 7G8_H3.23_L1.11_Fab Heavy Chain

SEQ ID NO: 31885 - protein, 121 aa, Artificial Sequence; identical to SEQ ID NO: 22385
  Description of Artificial Sequence: Synthetic polypeptide
  VH of XENP021677

SEQ ID NO: 31886 - protein, 5 aa, Artificial Sequence
  Description of Artificial Sequence: Synthetic peptide
  XENP021677 vhCDR1
DAWMD

SEQ ID NO: 31887 - protein, 19 aa, Artificial Sequence
  Description of Artificial Sequence: Synthetic peptide
  XENP021677 vhCDR2
EISTKANNHATYYAESVKG

SEQ ID NO: 31888 - protein, 10 aa, Artificial Sequence
  Description of Artificial Sequence: Synthetic peptide
  XENP021677 vhCDR3
LATWDWYFDV

SEQ ID NO: 31889 - protein, 218 aa, Artificial Sequence; identical to SEQ ID NO: 22359
  Description of Artificial Sequence: Synthetic polypeptide
  XENP021677 7G8_H3.23_L1.11_Fab Light Chain

SEQ ID NO: 31890 - protein, 111 aa, Artificial Sequence; identical to SEQ ID NO: 22360
  Description of Artificial Sequence: Synthetic polypeptide
  VL of XENP021677

SEQ ID NO: 31891 - protein, 15 aa, Artificial Sequence
  Description of Artificial Sequence: Synthetic peptide
  XENP021677 vlCDR1
RASQSVDYDGDSYMN

SEQ ID NO: 31892 - protein, 7 aa, Artificial Sequence
  Description of Artificial Sequence: Synthetic peptide
  XENP021677 vlCDR2
AASELES

SEQ ID NO: 31893 - protein, 9 aa, Artificial Sequence
  Description of Artificial Sequence: Synthetic peptide
  XENP021677 vlCDR3
QQSNEDPFT

SEQ ID NO: 31894 - protein, 226 aa, Artificial Sequence; identical to SEQ ID NO: 31734
  Description of Artificial Sequence: Synthetic polypeptide
  XENP021678 7G8_H3.18_L1.13_Fab Heavy Chain

SEQ ID NO: 31895 - protein, 121 aa, Artificial Sequence; identical to SEQ ID NO: 22325
  Description of Artificial Sequence: Synthetic polypeptide
  VH of XENP021678

SEQ ID NO: 31896 - protein, 5 aa, Artificial Sequence
  Description of Artificial Sequence: Synthetic peptide
  XENP021678 vhCDR1
DAWMD

SEQ ID NO: 31897 - protein, 19 aa, Artificial Sequence
  Description of Artificial Sequence: Synthetic peptide
  XENP021678 vhCDR2
EISTKANNHATYYAESVKG

SEQ ID NO: 31898 - protein, 10 aa, Artificial Sequence
  Description of Artificial Sequence: Synthetic peptide
  XENP021678 vhCDR3
LATWDWYFDV

SEQ ID NO: 31899 - protein, 218 aa, Artificial Sequence; identical to SEQ ID NO: 22419
  Description of Artificial Sequence: Synthetic polypeptide
  XENP021678 7G8_H3.18_L1.13_Fab Light Chain

SEQ ID NO: 31900 - protein, 111 aa, Artificial Sequence; identical to SEQ ID NO: 22420
  Description of Artificial Sequence: Synthetic polypeptide
  VL of XENP021678

SEQ ID NO: 31901 - protein, 15 aa, Artificial Sequence
  Description of Artificial Sequence: Synthetic peptide
  XENP021678 vlCDR1
RASQSVDHDGDSYMN

SEQ ID NO: 31902 - protein, 7 aa, Artificial Sequence
  Description of Artificial Sequence: Synthetic peptide
  XENP021678 vlCDR2
AASELES

SEQ ID NO: 31903 - protein, 9 aa, Artificial Sequence
  Description of Artificial Sequence: Synthetic peptide
  XENP021678 vlCDR3
QQSNEDPFT

SEQ ID NO: 31904 - protein, 226 aa, Artificial Sequence; identical to SEQ ID NO: 31744
  Description of Artificial Sequence: Synthetic polypeptide
  XENP021679 7G8_H3.15_L1.13_Fab Heavy Chain

SEQ ID NO: 31905 - protein, 121 aa, Artificial Sequence; identical to SEQ ID NO: 22365
  Description of Artificial Sequence: Synthetic polypeptide
  VH of XENP021679

SEQ ID NO: 31906 - protein, 5 aa, Artificial Sequence
  Description of Artificial Sequence: Synthetic peptide
  XENP021679 vhCDR1
DAWMD

SEQ ID NO: 31907 - protein, 19 aa, Artificial Sequence
  Description of Artificial Sequence: Synthetic peptide
  XENP021679 vhCDR2
EISTKANNHATYYAESVKG

SEQ ID NO: 31908 - protein, 10 aa, Artificial Sequence
  Description of Artificial Sequence: Synthetic peptide
  XENP021679 vhCDR3
LATWDWYFDV

SEQ ID NO: 31909 - protein, 218 aa, Artificial Sequence; identical to SEQ ID NO: 22419
  Description of Artificial Sequence: Synthetic polypeptide
  XENP021679 7G8_H3.15_L1.13_Fab Light Chain

SEQ ID NO: 31910 - protein, 111 aa, Artificial Sequence; identical to SEQ ID NO: 22420
  Description of Artificial Sequence: Synthetic polypeptide
  VL of XENP021679

SEQ ID NO: 31911 - protein, 15 aa, Artificial Sequence
  Description of Artificial Sequence: Synthetic peptide
  XENP021679 vlCDR1
RASQSVDHDGDSYMN

SEQ ID NO: 31912 - protein, 7 aa, Artificial Sequence
  Description of Artificial Sequence: Synthetic peptide
  XENP021679 vlCDR2
AASELES

SEQ ID NO: 31913 - protein, 9 aa, Artificial Sequence
  Description of Artificial Sequence: Synthetic peptide
  XENP021679 vlCDR3
QQSNEDPFT

SEQ ID NO: 31914 - protein, 226 aa, Artificial Sequence; identical to SEQ ID NO: 31754
  Description of Artificial Sequence: Synthetic polypeptide
  XENP021680 7G8_H3.19_L1.13_Fab Heavy Chain

SEQ ID NO: 31915 - protein, 121 aa, Artificial Sequence; identical to SEQ ID NO: 31755
  Description of Artificial Sequence: Synthetic polypeptide
  VH of XENP021680

SEQ ID NO: 31916 - protein, 5 aa, Artificial Sequence
  Description of Artificial Sequence: Synthetic peptide
  XENP021680 vhCDR1
DAWMD

SEQ ID NO: 31917 - protein, 19 aa, Artificial Sequence
  Description of Artificial Sequence: Synthetic peptide
  XENP021680 vhCDR2
EIRTKAYNHATYYAESVKG

SEQ ID NO: 31918 - protein, 10 aa, Artificial Sequence
  Description of Artificial Sequence: Synthetic peptide
  XENP021680 vhCDR3
LATWDWYFDV

SEQ ID NO: 31919 - protein, 218 aa, Artificial Sequence; identical to SEQ ID NO: 22419
  Description of Artificial Sequence: Synthetic polypeptide
  XENP021680 7G8_H3.19_L1.13_Fab Light Chain

SEQ ID NO: 31920 - protein, 111 aa, Artificial Sequence; identical to SEQ ID NO: 22420
  Description of Artificial Sequence: Synthetic polypeptide
  VL of XENP021680

SEQ ID NO: 31921 - protein, 15 aa, Artificial Sequence
  Description of Artificial Sequence: Synthetic peptide
  XENP021680 vlCDR1
RASQSVDHDGDSYMN

SEQ ID NO: 31922 - protein, 7 aa, Artificial Sequence
  Description of Artificial Sequence: Synthetic peptide
  XENP021680 vlCDR2
AASELES

SEQ ID NO: 31923 - protein, 9 aa, Artificial Sequence
  Description of Artificial Sequence: Synthetic peptide
  XENP021680 vlCDR3
QQSNEDPFT

SEQ ID NO: 31924 - protein, 226 aa, Artificial Sequence; identical to SEQ ID NO: 31764
  Description of Artificial Sequence: Synthetic polypeptide
  XENP021681 7G8_H3.17_L1.13_Fab Heavy Chain

SEQ ID NO: 31925 - protein, 121 aa, Artificial Sequence; identical to SEQ ID NO: 31765
  Description of Artificial Sequence: Synthetic polypeptide
  VH of XENP021681

SEQ ID NO: 31926 - protein, 5 aa, Artificial Sequence
  Description of Artificial Sequence: Synthetic peptide
  XENP021681 vhCDR1
DAWMD

SEQ ID NO: 31927 - protein, 19 aa, Artificial Sequence
  Description of Artificial Sequence: Synthetic peptide
  XENP021681 vhCDR2
EIRTKAYNHATYYAESVKG

SEQ ID NO: 31928 - protein, 10 aa, Artificial Sequence
  Description of Artificial Sequence: Synthetic peptide
  XENP021681 vhCDR3
LATWDWYFDV

SEQ ID NO: 31929 - protein, 218 aa, Artificial Sequence; identical to SEQ ID NO: 22419
  Description of Artificial Sequence: Synthetic polypeptide
  XENP021681 7G8_H3.17_L1.13_Fab Light Chain

SEQ ID NO: 31930 - protein, 111 aa, Artificial Sequence; identical to SEQ ID NO: 22420
  Description of Artificial Sequence: Synthetic polypeptide
  VL of XENP021681

SEQ ID NO: 31931 - protein, 15 aa, Artificial Sequence
  Description of Artificial Sequence: Synthetic peptide
  XENP021681 vlCDR1
RASQSVDHDGDSYMN

SEQ ID NO: 31932 - protein, 7 aa, Artificial Sequence
  Description of Artificial Sequence: Synthetic peptide
  XENP021681 vlCDR2
AASELES

SEQ ID NO: 31933 - protein, 9 aa, Artificial Sequence
  Description of Artificial Sequence: Synthetic peptide
  XENP021681 vlCDR3
QQSNEDPFT

SEQ ID NO: 31934 - protein, 226 aa, Artificial Sequence; identical to SEQ ID NO: 31774
  Description of Artificial Sequence: Synthetic polypeptide
  XENP021682 7G8_H3.16_L1.13_Fab Heavy Chain

SEQ ID NO: 31935 - protein, 121 aa, Artificial Sequence; identical to SEQ ID NO: 31775
  Description of Artificial Sequence: Synthetic polypeptide
  VH of XENP021682

SEQ ID NO: 31936 - protein, 5 aa, Artificial Sequence
  Description of Artificial Sequence: Synthetic peptide
  XENP021682 vhCDR1
DAWMD

SEQ ID NO: 31937 - protein, 19 aa, Artificial Sequence
  Description of Artificial Sequence: Synthetic peptide
  XENP021682 vhCDR2
EIRTKANNHATDYAESVKG

SEQ ID NO: 31938 - protein, 10 aa, Artificial Sequence
  Description of Artificial Sequence: Synthetic peptide
  XENP021682 vhCDR3
LATWDWYFDV

SEQ ID NO: 31939 - protein, 218 aa, Artificial Sequence; identical to SEQ ID NO: 22419
  Description of Artificial Sequence: Synthetic polypeptide
  XENP021682 7G8_H3.16_L1.13_Fab Light Chain

SEQ ID NO: 31940 - protein, 111 aa, Artificial Sequence; identical to SEQ ID NO: 22420
  Description of Artificial Sequence: Synthetic polypeptide
  VL of XENP021682

SEQ ID NO: 31941 - protein, 15 aa, Artificial Sequence
  Description of Artificial Sequence: Synthetic peptide
  XENP021682 vlCDR1
RASQSVDHDGDSYMN

SEQ ID NO: 31942 - protein, 7 aa, Artificial Sequence
  Description of Artificial Sequence: Synthetic peptide
  XENP021682 vlCDR2
AASELES

SEQ ID NO: 31943 - protein, 9 aa, Artificial Sequence
  Description of Artificial Sequence: Synthetic peptide
  XENP021682 vlCDR3
QQSNEDPFT

SEQ ID NO: 31944 - protein, 226 aa, Artificial Sequence; identical to SEQ ID NO: 31784
  Description of Artificial Sequence: Synthetic polypeptide
  XENP021683 7G8_H3.21_L1.13_Fab Heavy Chain

SEQ ID NO: 31945 - protein, 121 aa, Artificial Sequence; identical to SEQ ID NO: 31785
  Description of Artificial Sequence: Synthetic polypeptide
  VH of XENP021683

SEQ ID NO: 31946 - protein, 5 aa, Artificial Sequence
  Description of Artificial Sequence: Synthetic peptide
  XENP021683 vhCDR1
DAWMD

SEQ ID NO: 31947 - protein, 19 aa, Artificial Sequence
  Description of Artificial Sequence: Synthetic peptide
  XENP021683 vhCDR2
EISTKAYNHATDYAESVKG

SEQ ID NO: 31948 - protein, 10 aa, Artificial Sequence
  Description of Artificial Sequence: Synthetic peptide
  XENP021683 vhCDR3
LATWDWYFDV

SEQ ID NO: 31949 - protein, 218 aa, Artificial Sequence; identical to SEQ ID NO: 22419
  Description of Artificial Sequence: Synthetic polypeptide
  XENP021683 7G8_H3.21_L1.13_Fab Light Chain

SEQ ID NO: 31950 - protein, 111 aa, Artificial Sequence; identical to SEQ ID NO: 22420
  Description of Artificial Sequence: Synthetic polypeptide
  VL of XENP021683

SEQ ID NO: 31951 - protein, 15 aa, Artificial Sequence
  Description of Artificial Sequence: Synthetic peptide
  XENP021683 vlCDR1
RASQSVDHDGDSYMN

SEQ ID NO: 31952 - protein, 7 aa, Artificial Sequence
  Description of Artificial Sequence: Synthetic peptide
  XENP021683 vlCDR2
AASELES

SEQ ID NO: 31953 - protein, 9 aa, Artificial Sequence
  Description of Artificial Sequence: Synthetic peptide
  XENP021683 vlCDR3
QQSNEDPFT

SEQ ID NO: 31954 - protein, 226 aa, Artificial Sequence; identical to SEQ ID NO: 31794
  Description of Artificial Sequence: Synthetic polypeptide
  XENP021684 7G8_H3.22_L1.13_Fab Heavy Chain

SEQ ID NO: 31955 - protein, 121 aa, Artificial Sequence; identical to SEQ ID NO: 31795
  Description of Artificial Sequence: Synthetic polypeptide
  VH of XENP021684

SEQ ID NO: 31956 - protein, 5 aa, Artificial Sequence
  Description of Artificial Sequence: Synthetic peptide
  XENP021684 vhCDR1
DAWMD

SEQ ID NO: 31957 - protein, 19 aa, Artificial Sequence
  Description of Artificial Sequence: Synthetic peptide
  XENP021684 vhCDR2
EISTKAYNHATDYAESVKG

SEQ ID NO: 31958 - protein, 10 aa, Artificial Sequence
  Description of Artificial Sequence: Synthetic peptide
  XENP021684 vhCDR3
LATWDWYFDV

SEQ ID NO: 31959 - protein, 218 aa, Artificial Sequence; identical to SEQ ID NO: 22419
  Description of Artificial Sequence: Synthetic polypeptide
  XENP021684 7G8_H3.22_L1.13_Fab Light Chain

SEQ ID NO: 31960 - protein, 111 aa, Artificial Sequence; identical to SEQ ID NO: 22420
  Description of Artificial Sequence: Synthetic polypeptide
  VL of XENP021684

SEQ ID NO: 31961 - protein, 15 aa, Artificial Sequence
  Description of Artificial Sequence: Synthetic peptide
  XENP021684 vlCDR1
RASQSVDHDGDSYMN

SEQ ID NO: 31962 - protein, 7 aa, Artificial Sequence
  Description of Artificial Sequence: Synthetic peptide
  XENP021684 vlCDR2
AASELES

SEQ ID NO: 31963 - protein, 9 aa, Artificial Sequence
  Description of Artificial Sequence: Synthetic peptide
  XENP021684 vlCDR3
QQSNEDPFT

SEQ ID NO: 31964 - protein, 226 aa, Artificial Sequence; identical to SEQ ID NO: 31804
  Description of Artificial Sequence: Synthetic polypeptide
  XENP021685 7G8_H3.23_L1.13_Fab Heavy Chain

SEQ ID NO: 31965 - protein, 121 aa, Artificial Sequence; identical to SEQ ID NO: 22385
  Description of Artificial Sequence: Synthetic polypeptide
  VH of XENP021685

SEQ ID NO: 31966 - protein, 5 aa, Artificial Sequence
  Description of Artificial Sequence: Synthetic peptide
  XENP021685 vhCDR1
DAWMD

SEQ ID NO: 31967 - protein, 19 aa, Artificial Sequence
  Description of Artificial Sequence: Synthetic peptide
  XENP021685 vhCDR2
EISTKANNHATYYAESVKG

SEQ ID NO: 31968 - protein, 10 aa, Artificial Sequence
  Description of Artificial Sequence: Synthetic peptide
  XENP021685 vhCDR3
LATWDWYFDV

SEQ ID NO: 31969 - protein, 218 aa, Artificial Sequence; identical to SEQ ID NO: 22419
  Description of Artificial Sequence: Synthetic polypeptide
  XENP021685 7G8_H3.23_L1.13_Fab Light Chain

SEQ ID NO: 31970 - protein, 111 aa, Artificial Sequence; identical to SEQ ID NO: 22420
  Description of Artificial Sequence: Synthetic polypeptide
  VL of XENP021685

SEQ ID NO: 31971 - protein, 15 aa, Artificial Sequence
  Description of Artificial Sequence: Synthetic peptide
  XENP021685 vlCDR1
RASQSVDHDGDSYMN

SEQ ID NO: 31972 - protein, 7 aa, Artificial Sequence
  Description of Artificial Sequence: Synthetic peptide
  XENP021685 vlCDR2
AASELES

SEQ ID NO: 31973 - protein, 9 aa, Artificial Sequence
  Description of Artificial Sequence: Synthetic peptide
  XENP021685 vlCDR3
QQSNEDPFT

SEQ ID NO: 31974 - protein, 226 aa, Artificial Sequence; identical to SEQ ID NO: 31734
  Description of Artificial Sequence: Synthetic polypeptide
  XENP021686 7G8_H3.18_L1.15_Fab Heavy Chain

SEQ ID NO: 31975 - protein, 121 aa, Artificial Sequence; identical to SEQ ID NO: 22325
  Description of Artificial Sequence: Synthetic polypeptide
  VH of XENP021686

SEQ ID NO: 31976 - protein, 5 aa, Artificial Sequence
  Description of Artificial Sequence: Synthetic peptide
  XENP021686 vhCDR1
DAWMD

SEQ ID NO: 31977 - protein, 19 aa, Artificial Sequence
  Description of Artificial Sequence: Synthetic peptide
  XENP021686 vhCDR2
EISTKANNHATYYAESVKG

SEQ ID NO: 31978 - protein, 10 aa, Artificial Sequence
  Description of Artificial Sequence: Synthetic peptide
  XENP021686 vhCDR3
LATWDWYFDV

SEQ ID NO: 31979 - protein, 218 aa, Artificial Sequence
  Description of Artificial Sequence: Synthetic polypeptide
  XENP021686 7G8_H3.18_L1.15_Fab Light Chain
DTVLTQSPSSLSASVGDRVTITCRASQSVDHDDDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31980 - protein, 111 aa, Artificial Sequence
  Description of Artificial Sequence: Synthetic polypeptide
  VL of XENP021686
DTVLTQSPSSLSASVGDRVTITCRASQSVDHDDDSYMNWYQQKPGKPPKLLIYAASELESGIPARLSGSGSGTDFTLTISSLQPEDFATYYCQQSNEDPFTFGSGTKLEIK

SEQ ID NO: 31981 - protein, 15 aa, Artificial Sequence
  Description of Artificial Sequence: Synthetic peptide
  XENP021686 vlCDR1
RASQSVDHDDDSYMN

SEQ ID NO: 31982 - protein, 7 aa, Artificial Sequence
  Description of Artificial Sequence: Synthetic peptide
  XENP021686 vlCDR2
AASELES

SEQ ID NO: 31983 - protein, 9 aa, Artificial Sequence
  Description of Artificial Sequence: Synthetic peptide
  XENP021686 vlCDR3
QQSNEDPFT

SEQ ID NO: 31984 - protein, 226 aa, Artificial Sequence; identical to SEQ ID NO: 31744
  Description of Artificial Sequence: Synthetic polypeptide
  XENP021687 7G8_H3.15_L1.15_Fab Heavy Chain

SEQ ID NO: 31985 - protein, 121 aa, Artificial Sequence; identical to SEQ ID NO: 22365
  Description of Artificial Sequence: Synthetic polypeptide
  VH of XENP021687

SEQ ID NO: 31986 - protein, 5 aa, Artificial Sequence
  Description of Artificial Sequence: Synthetic peptide
  XENP021687 vhCDR1
DAWMD

SEQ ID NO: 31987 - protein, 19 aa, Artificial Sequence
  Description of Artificial Sequence: Synthetic peptide
  XENP021687 vhCDR2
EISTKANNHATYYAESVKG

SEQ ID NO: 31988 - protein, 10 aa, Artificial Sequence
  Description of Artificial Sequence: Synthetic peptide
  XENP021687 vhCDR3
LATWDWYFDV

SEQ ID NO: 31989 - protein, 218 aa, Artificial Sequence; identical to SEQ ID NO: 31979
  Description of Artificial Sequence: Synthetic polypeptide
  XENP021687 7G8_H3.15_L1.15_Fab Light Chain

SEQ ID NO: 31990 - protein, 111 aa, Artificial Sequence; identical to SEQ ID NO: 31980
  Description of Artificial Sequence: Synthetic polypeptide
  VL of XENP021687

SEQ ID NO: 31991 - protein, 15 aa, Artificial Sequence
  Description of Artificial Sequence: Synthetic peptide
  XENP021687 vlCDR1
RASQSVDHDDDSYMN

SEQ ID NO: 31992 - protein, 7 aa, Artificial Sequence
  Description of Artificial Sequence: Synthetic peptide
  XENP021687 vlCDR2
AASELES

SEQ ID NO: 31993 - protein, 9 aa, Artificial Sequence
  Description of Artificial Sequence: Synthetic peptide
  XENP021687 vlCDR3
QQSNEDPFT

SEQ ID NO: 31994 - protein, 226 aa, Artificial Sequence; identical to SEQ ID NO: 31754
  Description of Artificial Sequence: Synthetic polypeptide
  XENP021688 7G8_H3.19_L1.15_Fab Heavy Chain

SEQ ID NO: 31995 - protein, 121 aa, Artificial Sequence; identical to SEQ ID NO: 31755
  Description of Artificial Sequence: Synthetic polypeptide
  VH of XENP021688

SEQ ID NO: 31996 - protein, 5 aa, Artificial Sequence
  Description of Artificial Sequence: Synthetic peptide
  XENP021688 vhCDR1
DAWMD

SEQ ID NO: 31997 - protein, 19 aa, Artificial Sequence
  Description of Artificial Sequence: Synthetic peptide
  XENP021688 vhCDR2
EIRTKAYNHATYYAESVKG

SEQ ID NO: 31998 - protein, 10 aa, Artificial Sequence
  Description of Artificial Sequence: Synthetic peptide
  XENP021688 vhCDR3
LATWDWYFDV

SEQ ID NO: 31999 - protein, 218 aa, Artificial Sequence; identical to SEQ ID NO: 31979
  Description of Artificial Sequence: Synthetic polypeptide
  XENP021688 7G8_H3.19_L1.15_Fab Light Chain

SEQ ID NO: 32000 - protein, 111 aa, Artificial Sequence; identical to SEQ ID NO: 31980
  Description of Artificial Sequence: Synthetic polypeptide
  VL of XENP021688

SEQ ID NO: 32001 - protein, 15 aa, Artificial Sequence
  Description of Artificial Sequence: Synthetic peptide
  XENP021688 vlCDR1
RASQSVDHDDDSYMN

SEQ ID NO: 32002 - protein, 7 aa, Artificial Sequence
  Description of Artificial Sequence: Synthetic peptide
  XENP021688 vlCDR2
AASELES

SEQ ID NO: 32003 - protein, 9 aa, Artificial Sequence
  Description of Artificial Sequence: Synthetic peptide
  XENP021688 vlCDR3
QQSNEDPFT

SEQ ID NO: 32004 - protein, 226 aa, Artificial Sequence; identical to SEQ ID NO: 31764
  Description of Artificial Sequence: Synthetic polypeptide
  XENP021689 7G8_H3.17_L1.15_Fab Heavy Chain

SEQ ID NO: 32005 - protein, 121 aa, Artificial Sequence; identical to SEQ ID NO: 31765
  Description of Artificial Sequence: Synthetic polypeptide
  VH of XENP021689

SEQ ID NO: 32006 - protein, 5 aa, Artificial Sequence
  Description of Artificial Sequence: Synthetic peptide
  XENP021689 vhCDR1
DAWMD

SEQ ID NO: 32007 - protein, 19 aa, Artificial Sequence
  Description of Artificial Sequence: Synthetic peptide
  XENP021689 vhCDR2
EIRTKAYNHATYYAESVKG

SEQ ID NO: 32008 - protein, 10 aa, Artificial Sequence
  Description of Artificial Sequence: Synthetic peptide
  XENP021689 vhCDR3
LATWDWYFDV

SEQ ID NO: 32009 - protein, 218 aa, Artificial Sequence; identical to SEQ ID NO: 31979
  Description of Artificial Sequence: Synthetic polypeptide
  XENP021689 7G8_H3.17_L1.15_Fab Light Chain

SEQ ID NO: 32010 - protein, 111 aa, Artificial Sequence; identical to SEQ ID NO: 31980
  Description of Artificial Sequence: Synthetic polypeptide
  VL of XENP021689

SEQ ID NO: 32011 - protein, 15 aa, Artificial Sequence
  Description of Artificial Sequence: Synthetic peptide
  XENP021689 vlCDR1
RASQSVDHDDDSYMN

SEQ ID NO: 32012 - protein, 7 aa, Artificial Sequence
  Description of Artificial Sequence: Synthetic peptide
  XENP021689 vlCDR2
AASELES

SEQ ID NO: 32013 - protein, 9 aa, Artificial Sequence
  Description of Artificial Sequence: Synthetic peptide
  XENP021689 vlCDR3
QQSNEDPFT

SEQ ID NO: 32014 - protein, 226 aa, Artificial Sequence; identical to SEQ ID NO: 31774
  Description of Artificial Sequence: Synthetic polypeptide
  XENP021690 7G8_H3.16_L1.15_Fab Heavy Chain

SEQ ID NO: 32015 - protein, 121 aa, Artificial Sequence; identical to SEQ ID NO: 31775
  Description of Artificial Sequence: Synthetic polypeptide
  VH of XENP021690

SEQ ID NO: 32016 - protein, 5 aa, Artificial Sequence
  Description of Artificial Sequence: Synthetic peptide
  XENP021690 vhCDR1
DAWMD

SEQ ID NO: 32017 - protein, 19 aa, Artificial Sequence
  Description of Artificial Sequence: Synthetic peptide
  XENP021690 vhCDR2
EIRTKANNHATDYAESVKG

SEQ ID NO: 32018 - protein, 10 aa, Artificial Sequence
  Description of Artificial Sequence: Synthetic peptide
  XENP021690 vhCDR3
LATWDWYFDV

SEQ ID NO: 32019 - protein, 218 aa, Artificial Sequence; identical to SEQ ID NO: 31979
  Description of Artificial Sequence: Synthetic polypeptide
  XENP021690 7G8_H3.16_L1.15_Fab Light Chain

SEQ ID NO: 32020 - protein, 111 aa, Artificial Sequence; identical to SEQ ID NO: 31980
  Description of Artificial Sequence: Synthetic polypeptide
  VL of XENP021690

SEQ ID NO: 32021 - protein, 15 aa, Artificial Sequence
  Description of Artificial Sequence: Synthetic peptide
  XENP021690 vlCDR1
RASQSVDHDDDSYMN

SEQ ID NO: 32022 - protein, 7 aa, Artificial Sequence
  Description of Artificial Sequence: Synthetic peptide
  XENP021690 vlCDR2
AASELES

SEQ ID NO: 32023 - protein, 9 aa, Artificial Sequence
  Description of Artificial Sequence: Synthetic peptide
  XENP021690 vlCDR3
QQSNEDPFT

SEQ ID NO: 32024 - protein, 226 aa, Artificial Sequence; identical to SEQ ID NO: 31784
  Description of Artificial Sequence: Synthetic polypeptide
  XENP021691 7G8_H3.21_L1.15_Fab Heavy Chain

SEQ ID NO: 32025 - protein, 121 aa, Artificial Sequence; identical to SEQ ID NO: 31785
  Description of Artificial Sequence: Synthetic polypeptide
  VH of XENP021691

SEQ ID NO: 32026 - protein, 5 aa, Artificial Sequence
  Description of Artificial Sequence: Synthetic peptide
  XENP021691 vhCDR1
DAWMD

SEQ ID NO: 32027 - protein, 19 aa, Artificial Sequence
  Description of Artificial Sequence: Synthetic peptide
  XENP021691 vhCDR2
EISTKAYNHATDYAESVKG

SEQ ID NO: 32028 - protein, 10 aa, Artificial Sequence
  Description of Artificial Sequence: Synthetic peptide
  XENP021691 vhCDR3
LATWDWYFDV

SEQ ID NO: 32029 - protein, 218 aa, Artificial Sequence; identical to SEQ ID NO: 31979
  Description of Artificial Sequence: Synthetic polypeptide
  XENP021691 7G8_H3.21_L1.15_Fab Light Chain

SEQ ID NO: 32030 - protein, 111 aa, Artificial Sequence; identical to SEQ ID NO: 31980
  Description of Artificial Sequence: Synthetic polypeptide
  VL of XENP021691

SEQ ID NO: 32031 - protein, 15 aa, Artificial Sequence
  Description of Artificial Sequence: Synthetic peptide
  XENP021691 vlCDR1
RASQSVDHDDDSYMN

SEQ ID NO: 32032 - protein, 7 aa, Artificial Sequence
  Description of Artificial Sequence: Synthetic peptide
  XENP021691 vlCDR2
AASELES

SEQ ID NO: 32033 - protein, 9 aa, Artificial Sequence
  Description of Artificial Sequence: Synthetic peptide
  XENP021691 vlCDR3
QQSNEDPFT

SEQ ID NO: 32034 - protein, 226 aa, Artificial Sequence; identical to SEQ ID NO: 31794
  Description of Artificial Sequence: Synthetic polypeptide
  XENP021692 7G8_H3.22_L1.15_Fab Heavy Chain

SEQ ID NO: 32035 - protein, 121 aa, Artificial Sequence; identical to SEQ ID NO: 31795
  Description of Artificial Sequence: Synthetic polypeptide
  VH of XENP021692

SEQ ID NO: 32036 - protein, 5 aa, Artificial Sequence
  Description of Artificial Sequence: Synthetic peptide
  XENP021692 vhCDR1
DAWMD

SEQ ID NO: 32037 - protein, 19 aa, Artificial Sequence
  Description of Artificial Sequence: Synthetic peptide
  XENP021692 vhCDR2
EISTKAYNHATDYAESVKG

SEQ ID NO: 32038 - protein, 10 aa, Artificial Sequence
  Description of Artificial Sequence: Synthetic peptide
  XENP021692 vhCDR3
LATWDWYFDV

SEQ ID NO: 32039 - protein, 218 aa, Artificial Sequence; identical to SEQ ID NO: 31979
  Description of Artificial Sequence: Synthetic polypeptide
  XENP021692 7G8_H3.22_L1.15_Fab Light Chain

SEQ ID NO: 32040 - protein, 111 aa, Artificial Sequence; identical to SEQ ID NO: 31980
  Description of Artificial Sequence: Synthetic polypeptide
  VL of XENP021692

SEQ ID NO: 32041 - protein, 15 aa, Artificial Sequence
  Description of Artificial Sequence: Synthetic peptide
  XENP021692 vlCDR1
RASQSVDHDDDSYMN

SEQ ID NO: 32042 - protein, 7 aa, Artificial Sequence
  Description of Artificial Sequence: Synthetic peptide
  XENP021692 vlCDR2
AASELES

SEQ ID NO: 32043 - protein, 9 aa, Artificial Sequence
  Description of Artificial Sequence: Synthetic peptide
  XENP021692 vlCDR3
QQSNEDPFT

SEQ ID NO: 32044 - protein, 226 aa, Artificial Sequence; identical to SEQ ID NO: 31804
  Description of Artificial Sequence: Synthetic polypeptide
  XENP021693 7G8_H3.23_L1.15_Fab Heavy Chain

SEQ ID NO: 32045 - protein, 121 aa, Artificial Sequence; identical to SEQ ID NO: 22385
  Description of Artificial Sequence: Synthetic polypeptide
  VH of XENP021693

SEQ ID NO: 32046 - protein, 5 aa, Artificial Sequence
  Description of Artificial Sequence: Synthetic peptide
  XENP021693 vhCDR1
DAWMD

SEQ ID NO: 32047 - protein, 19 aa, Artificial Sequence
  Description of Artificial Sequence: Synthetic peptide
  XENP021693 vhCDR2
EISTKANNHATYYAESVKG

SEQ ID NO: 32048 - protein, 10 aa, Artificial Sequence
  Description of Artificial Sequence: Synthetic peptide
  XENP021693 vhCDR3
LATWDWYFDV

SEQ ID NO: 32049 - protein, 218 aa, Artificial Sequence; identical to SEQ ID NO: 31979
  Description of Artificial Sequence: Synthetic polypeptide
  XENP021693 7G8_H3.23_L1.15_Fab Light Chain

SEQ ID NO: 32050 - protein, 111 aa, Artificial Sequence; identical to SEQ ID NO: 31980
  Description of Artificial Sequence: Synthetic polypeptide
  VL of XENP021693

SEQ ID NO: 32051 - protein, 15 aa, Artificial Sequence
  Description of Artificial Sequence: Synthetic peptide
  XENP021693 vlCDR1
RASQSVDHDDDSYMN

SEQ ID NO: 32052 - protein, 7 aa, Artificial Sequence
  Description of Artificial Sequence: Synthetic peptide
  XENP021693 vlCDR2
AASELES

SEQ ID NO: 32053 - protein, 9 aa, Artificial Sequence
  Description of Artificial Sequence: Synthetic peptide
  XENP021693 vlCDR3
QQSNEDPFT

SEQ ID NO: 32054 - protein, 226 aa, Artificial Sequence; identical to SEQ ID NO: 28934
  Description of Artificial Sequence: Synthetic polypeptide
  XENP021694 7G8_H3_L1.9_Fab Heavy Chain

SEQ ID NO: 32055 - protein, 121 aa, Artificial Sequence; identical to SEQ ID NO: 17806
  Description of Artificial Sequence: Synthetic polypeptide
  VH of XENP021694

SEQ ID NO: 32056 - protein, 5 aa, Artificial Sequence
  Description of Artificial Sequence: Synthetic peptide
  XENP021694 vhCDR1
DAWMD

SEQ ID NO: 32057 - protein, 19 aa, Artificial Sequence
  Description of Artificial Sequence: Synthetic peptide
  XENP021694 vhCDR2
EIRTKANNHATYYAESVKG

SEQ ID NO: 32058 - protein, 10 aa, Artificial Sequence
  Description of Artificial Sequence: Synthetic peptide
  XENP021694 vhCDR3
LANWDWYFDV

SEQ ID NO: 32059 - protein, 218 aa, Artificial Sequence
  Description of Artificial Sequence: Synthetic polypeptide
  XENP021694 7G8_H3_L1.9_Fab Light Chain
DTVLTQSPSSLSASVGDRVTITCRASQSVDHDGDSYMNWYQQKPGKPPKLLIYAASNLESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32060 - protein, 111 aa, Artificial Sequence
  Description of Artificial Sequence: Synthetic polypeptide
  VL of XENP021694
DTVLTQSPSSLSASVGDRVTITCRASQSVDHDGDSYMNWYQQKPGKPPKLLIYAASNLESGIPARLSGSGSGTDFTLTISSLQPEDFATYYCQQSNEDPFTFGSGTKLEIK

SEQ ID NO: 32061 - protein, 15 aa, Artificial Sequence
  Description of Artificial Sequence: Synthetic peptide
  XENP021694 vlCDR1
RASQSVDHDGDSYMN

SEQ ID NO: 32062 - protein, 7 aa, Artificial Sequence
  Description of Artificial Sequence: Synthetic peptide
  XENP021694 vlCDR2
AASNLES

SEQ ID NO: 32063 - protein, 9 aa, Artificial Sequence
  Description of Artificial Sequence: Synthetic peptide
  XENP021694 vlCDR3
QQSNEDPFT

SEQ ID NO: 32064 - protein, 226 aa, Artificial Sequence; identical to SEQ ID NO: 28934
  Description of Artificial Sequence: Synthetic polypeptide
  XENP021695 7G8_H3_L1.10_Fab Heavy Chain

SEQ ID NO: 32065 - protein, 121 aa, Artificial Sequence; identical to SEQ ID NO: 17806
  Description of Artificial Sequence: Synthetic polypeptide
  VH of XENP021695

SEQ ID NO: 32066 - protein, 5 aa, Artificial Sequence
  Description of Artificial Sequence: Synthetic peptide
  XENP021695 vhCDR1
DAWMD

SEQ ID NO: 32067 - protein, 19 aa, Artificial Sequence
  Description of Artificial Sequence: Synthetic peptide
  XENP021695 vhCDR2
EIRTKANNHATYYAESVKG

SEQ ID NO: 32068 - protein, 10 aa, Artificial Sequence
  Description of Artificial Sequence: Synthetic peptide
  XENP021695 vhCDR3
LANWDWYFDV

SEQ ID NO: 32069 - protein, 218 aa, Artificial Sequence
  Description of Artificial Sequence: Synthetic polypeptide
  XENP021695 7G8_H3_L1.10_Fab Light Chain
DTVLTQSPSSLSASVGDRVTITCRASQSVDYDDDSYMNWYQQKPGKPPKLLIYAASNLESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32070 - protein, 111 aa, Artificial Sequence
  Description of Artificial Sequence: Synthetic polypeptide
  VL of XENP021695
DTVLTQSPSSLSASVGDRVTITCRASQSVDYDDDSYMNWYQQKPGKPPKLLIYAASNLESGIPARLSGSGSGTDFTLTISSLQPEDFATYYCQQSNEDPFTFGSGTKLEIK

SEQ ID NO: 32071 - protein, 15 aa, Artificial Sequence
  Description of Artificial Sequence: Synthetic peptide
  XENP021695 vlCDR1
RASQSVDYDDDSYMN

SEQ ID NO: 32072 - protein, 7 aa, Artificial Sequence
  Description of Artificial Sequence: Synthetic peptide
  XENP021695 vlCDR2
AASNLES

SEQ ID NO: 32073 - protein, 9 aa, Artificial Sequence
  Description of Artificial Sequence: Synthetic peptide
  XENP021695 vlCDR3
QQSNEDPFT

SEQ ID NO: 32074 - protein, 226 aa, Artificial Sequence; identical to SEQ ID NO: 28934
  Description of Artificial Sequence: Synthetic polypeptide
  XENP021696 7G8_H3_L1.11_Fab Heavy Chain

SEQ ID NO: 32075 - protein, 121 aa, Artificial Sequence; identical to SEQ ID NO: 17806
  Description of Artificial Sequence: Synthetic polypeptide
  VH of XENP021696

SEQ ID NO: 32076 - protein, 5 aa, Artificial Sequence
  Description of Artificial Sequence: Synthetic peptide
  XENP021696 vhCDR1
DAWMD

SEQ ID NO: 32077 - protein, 19 aa, Artificial Sequence
  Description of Artificial Sequence: Synthetic peptide
  XENP021696 vhCDR2
EIRTKANNHATYYAESVKG

SEQ ID NO: 32078 - protein, 10 aa, Artificial Sequence
  Description of Artificial Sequence: Synthetic peptide
  XENP021696 vhCDR3
LANWDWYFDV

SEQ ID NO: 32079 - protein, 218 aa, Artificial Sequence; identical to SEQ ID NO: 22359
  Description of Artificial Sequence: Synthetic polypeptide
  XENP021696 7G8_H3_L1.11_Fab Light Chain

SEQ ID NO: 32080 - protein, 111 aa, Artificial Sequence; identical to SEQ ID NO: 22360
  Description of Artificial Sequence: Synthetic polypeptide
  VL of XENP021696

SEQ ID NO: 32081 - protein, 15 aa, Artificial Sequence
  Description of Artificial Sequence: Synthetic peptide
  XENP021696 vlCDR1
RASQSVDYDGDSYMN

SEQ ID NO: 32082 - protein, 7 aa, Artificial Sequence
  Description of Artificial Sequence: Synthetic peptide
  XENP021696 vlCDR2
AASELES

SEQ ID NO: 32083 - protein, 9 aa, Artificial Sequence
  Description of Artificial Sequence: Synthetic peptide
  XENP021696 vlCDR3
QQSNEDPFT

SEQ ID NO: 32084 - protein, 226 aa, Artificial Sequence; identical to SEQ ID NO: 28934
  Description of Artificial Sequence: Synthetic polypeptide
  XENP021701 7G8_H3_L1.12_Fab Heavy Chain

SEQ ID NO: 32085 - protein, 121 aa, Artificial Sequence; identical to SEQ ID NO: 17806
  Description of Artificial Sequence: Synthetic polypeptide
  VH of XENP021701

SEQ ID NO: 32086 - protein, 5 aa, Artificial Sequence
  Description of Artificial Sequence: Synthetic peptide
  XENP021701 vhCDR1
DAWMD

SEQ ID NO: 32087 - protein, 19 aa, Artificial Sequence
  Description of Artificial Sequence: Synthetic peptide
  XENP021701 vhCDR2
EIRTKANNHATYYAESVKG

SEQ ID NO: 32088 - protein, 10 aa, Artificial Sequence
  Description of Artificial Sequence: Synthetic peptide
  XENP021701 vhCDR3
LANWDWYFDV

SEQ ID NO: 32089 - protein, 218 aa, Artificial Sequence
  Description of Artificial Sequence: Synthetic polypeptide
  XENP021701 7G8_H3_L1.12_Fab Light Chain
DTVLTQSPSSLSASVGDRVTITCRASQSVDHDDDSYMNWYQQKPGKPPKLLIYAASNLESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32090 - protein, 111 aa, Artificial Sequence
  Description of Artificial Sequence: Synthetic polypeptide
  VL of XENP021701
DTVLTQSPSSLSASVGDRVTITCRASQSVDHDDDSYMNWYQQKPGKPPKLLIYAASNLESGIPARLSGSGSGTDFTLTISSLQPEDFATYYCQQSNEDPFTFGSGTKLEIK

SEQ ID NO: 32091 - protein, 15 aa, Artificial Sequence
  Description of Artificial Sequence: Synthetic peptide
  XENP021701 vlCDR1
RASQSVDHDDDSYMN

SEQ ID NO: 32092 - protein, 7 aa, Artificial Sequence
  Description of Artificial Sequence: Synthetic peptide
  XENP021701 vlCDR2
AASNLES

SEQ ID NO: 32093 - protein, 9 aa, Artificial Sequence
  Description of Artificial Sequence: Synthetic peptide
  XENP021701 vlCDR3
QQSNEDPFT

SEQ ID NO: 32094 - protein, 226 aa, Artificial Sequence; identical to SEQ ID NO: 28934
  Description of Artificial Sequence: Synthetic polypeptide
  XENP021702 7G8_H3_L1.13_Fab Heavy Chain

SEQ ID NO: 32095 - protein, 121 aa, Artificial Sequence; identical to SEQ ID NO: 17806
  Description of Artificial Sequence: Synthetic polypeptide
  VH of XENP021702

SEQ ID NO: 32096 - protein, 5 aa, Artificial Sequence
  Description of Artificial Sequence: Synthetic peptide
  XENP021702 vhCDR1
DAWMD

SEQ ID NO: 32097 - protein, 19 aa, Artificial Sequence
  Description of Artificial Sequence: Synthetic peptide
  XENP021702 vhCDR2
EIRTKANNHATYYAESVKG

SEQ ID NO: 32098 - protein, 10 aa, Artificial Sequence
  Description of Artificial Sequence: Synthetic peptide
  XENP021702 vhCDR3
LANWDWYFDV

SEQ ID NO: 32099 - protein, 218 aa, Artificial Sequence; identical to SEQ ID NO: 22419
  Description of Artificial Sequence: Synthetic polypeptide
  XENP021702 7G8_H3_L1.13_Fab Light Chain

SEQ ID NO: 32100 - protein, 111 aa, Artificial Sequence; identical to SEQ ID NO: 22420
  Description of Artificial Sequence: Synthetic polypeptide
  VL of XENP021702

SEQ ID NO: 32101 - protein, 15 aa, Artificial Sequence
  Description of Artificial Sequence: Synthetic peptide
  XENP021702 vlCDR1
RASQSVDHDGDSYMN

SEQ ID NO: 32102 - protein, 7 aa, Artificial Sequence
  Description of Artificial Sequence: Synthetic peptide
  XENP021702 vlCDR2
AASELES

SEQ ID NO: 32103 - protein, 9 aa, Artificial Sequence
  Description of Artificial Sequence: Synthetic peptide
  XENP021702 vlCDR3
QQSNEDPFT

SEQ ID NO: 32104 - protein, 226 aa, Artificial Sequence; identical to SEQ ID NO: 28934
  Description of Artificial Sequence: Synthetic polypeptide
  XENP021703 7G8_H3_L1.14_Fab Heavy Chain

SEQ ID NO: 32105 - protein, 121 aa, Artificial Sequence; identical to SEQ ID NO: 17806
  Description of Artificial Sequence: Synthetic polypeptide
  VH of XENP021703

SEQ ID NO: 32106 - protein, 5 aa, Artificial Sequence
  Description of Artificial Sequence: Synthetic peptide
  XENP021703 vhCDR1
DAWMD

SEQ ID NO: 32107 - protein, 19 aa, Artificial Sequence
  Description of Artificial Sequence: Synthetic peptide
  XENP021703 vhCDR2
EIRTKANNHATYYAESVKG

SEQ ID NO: 32108 - protein, 10 aa, Artificial Sequence
  Description of Artificial Sequence: Synthetic peptide
  XENP021703 vhCDR3
LANWDWYFDV

SEQ ID NO: 32109 - protein, 218 aa, Artificial Sequence; identical to SEQ ID NO: 29039
  Description of Artificial Sequence: Synthetic polypeptide
  XENP021703 7G8_H3_L1.14_Fab Light Chain

SEQ ID NO: 32110 - protein, 111 aa, Artificial Sequence; identical to SEQ ID NO: 29040
  Description of Artificial Sequence: Synthetic polypeptide
  VL of XENP021703

SEQ ID NO: 32111 - protein, 15 aa, Artificial Sequence
  Description of Artificial Sequence: Synthetic peptide
  XENP021703 vlCDR1
RASQSVDYDDDSYMN

SEQ ID NO: 32112 - protein, 7 aa, Artificial Sequence
  Description of Artificial Sequence: Synthetic peptide
  XENP021703 vlCDR2
AASELES

SEQ ID NO: 32113 - protein, 9 aa, Artificial Sequence
  Description of Artificial Sequence: Synthetic peptide
  XENP021703 vlCDR3
QQSNEDPFT

SEQ ID NO: 32114 - protein, 226 aa, Artificial Sequence; identical to SEQ ID NO: 28934
  Description of Artificial Sequence: Synthetic polypeptide
  XENP021704 7G8_H3_L1.15_Fab Heavy Chain

SEQ ID NO: 32115 - protein, 121 aa, Artificial Sequence; identical to SEQ ID NO: 17806
  Description of Artificial Sequence: Synthetic polypeptide
  VH of XENP021704

SEQ ID NO: 32116 - protein, 5 aa, Artificial Sequence
  Description of Artificial Sequence: Synthetic peptide
  XENP021704 vhCDR1
DAWMD

SEQ ID NO: 32117 - protein, 19 aa, Artificial Sequence
  Description of Artificial Sequence: Synthetic peptide
  XENP021704 vhCDR2
EIRTKANNHATYYAESVKG

SEQ ID NO: 32118 - protein, 10 aa, Artificial Sequence
  Description of Artificial Sequence: Synthetic peptide
  XENP021704 vhCDR3
LANWDWYFDV

SEQ ID NO: 32119 - protein, 218 aa, Artificial Sequence; identical to SEQ ID NO: 31979
  Description of Artificial Sequence: Synthetic polypeptide
  XENP021704 7G8_H3_L1.15_Fab Light Chain

SEQ ID NO: 32120 - protein, 111 aa, Artificial Sequence; identical to SEQ ID NO: 31980
  Description of Artificial Sequence: Synthetic polypeptide
  VL of XENP021704

SEQ ID NO: 32121 - protein, 15 aa, Artificial Sequence
  Description of Artificial Sequence: Synthetic peptide
  XENP021704 vlCDR1
RASQSVDHDDDSYMN

SEQ ID NO: 32122 - protein, 7 aa, Artificial Sequence
  Description of Artificial Sequence: Synthetic peptide
  XENP021704 vlCDR2
AASELES

SEQ ID NO: 32123 - protein, 9 aa, Artificial Sequence
  Description of Artificial Sequence: Synthetic peptide
  XENP021704 vlCDR3
QQSNEDPFT

SEQ ID NO: 32124 - protein, 226 aa, Artificial Sequence
  Description of Artificial Sequence: Synthetic polypeptide
  XENP021742 7G8_H3.11_L1.13_Fab Heavy Chain
EVQLVESGGGLVQPGGSLRLSCAASGFTFSDAWMDWVRQAPGKGLEWVAEISTKANNHATYYAESVKGRFTISRDDSKSSVYLQMNSLRAEDTAVYYCTRLANWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32125 - protein, 121 aa, Artificial Sequence
  Description of Artificial Sequence: Synthetic polypeptide
  VH of XENP021742
EVQLVESGGGLVQPGGSLRLSCAASGFTFSDAWMDWVRQAPGKGLEWVAEISTKANNHATYYAESVKGRFTISRDDSKSSVYLQMNSLRAEDTAVYYCTRLANWDWYFDVWGQGTTVTVSS

SEQ ID NO: 32126 - protein, 5 aa, Artificial Sequence
  Description of Artificial Sequence: Synthetic peptide
  XENP021742 vhCDR1
DAWMD

SEQ ID NO: 32127 - protein, 19 aa, Artificial Sequence
  Description of Artificial Sequence: Synthetic peptide
  XENP021742 vhCDR2
EISTKANNHATYYAESVKG

SEQ ID NO: 32128 - protein, 10 aa, Artificial Sequence
  Description of Artificial Sequence: Synthetic peptide
  XENP021742 vhCDR3
LANWDWYFDV

SEQ ID NO: 32129 - protein, 218 aa, Artificial Sequence; identical to SEQ ID NO: 22419
  Description of Artificial Sequence: Synthetic polypeptide
  XENP021742 7G8_H3.11_L1.13_Fab Light Chain

SEQ ID NO: 32130 - protein, 111 aa, Artificial Sequence; identical to SEQ ID NO: 22420
  Description of Artificial Sequence: Synthetic polypeptide
  VL of XENP021742

SEQ ID NO: 32131 - protein, 15 aa, Artificial Sequence
  Description of Artificial Sequence: Synthetic peptide
  XENP021742 vlCDR1
RASQSVDHDGDSYMN

SEQ ID NO: 32132 - protein, 7 aa, Artificial Sequence
  Description of Artificial Sequence: Synthetic peptide
  XENP021742 vlCDR2
AASELES

SEQ ID NO: 32133 - protein, 9 aa, Artificial Sequence
  Description of Artificial Sequence: Synthetic peptide
  XENP021742 vlCDR3
QQSNEDPFT

SEQ ID NO: 32134 - protein, 226 aa, Artificial Sequence; identical to SEQ ID NO: 28974
  Description of Artificial Sequence: Synthetic polypeptide
  XENP021743 7G8_H3.4_L1.13_Fab Heavy Chain

SEQ ID NO: 32135 - protein, 121 aa, Artificial Sequence; identical to SEQ ID NO: 28975
  Description of Artificial Sequence: Synthetic polypeptide
  VH of XENP021743

SEQ ID NO: 32136 - protein, 5 aa, Artificial Sequence
  Description of Artificial Sequence: Synthetic peptide
  XENP021743 vhCDR1
DAWMD

SEQ ID NO: 32137 - protein, 19 aa, Artificial Sequence
  Description of Artificial Sequence: Synthetic peptide
  XENP021743 vhCDR2
EIRTKANNHATYYAESVKG

SEQ ID NO: 32138 - protein, 10 aa, Artificial Sequence
  Description of Artificial Sequence: Synthetic peptide
  XENP021743 vhCDR3
LATWDWYFDV

SEQ ID NO: 32139 - protein, 218 aa, Artificial Sequence; identical to SEQ ID NO: 22419
  Description of Artificial Sequence: Synthetic polypeptide
  XENP021743 7G8_H3.4_L1.13_Fab Light Chain

SEQ ID NO: 32140 - protein, 111 aa, Artificial Sequence; identical to SEQ ID NO: 22420
  Description of Artificial Sequence: Synthetic polypeptide
  VL of XENP021743

SEQ ID NO: 32141 - protein, 15 aa, Artificial Sequence
  Description of Artificial Sequence: Synthetic peptide
  XENP021743 vlCDR1
RASQSVDHDGDSYMN

SEQ ID NO: 32142 - protein, 7 aa, Artificial Sequence
  Description of Artificial Sequence: Synthetic peptide
  XENP021743 vlCDR2
AASELES

SEQ ID NO: 32143 - protein, 9 aa, Artificial Sequence
  Description of Artificial Sequence: Synthetic peptide
  XENP021743 vlCDR3
QQSNEDPFT

SEQ ID NO: 32144 - protein, 226 aa, Artificial Sequence; identical to SEQ ID NO: 28944
  Description of Artificial Sequence: Synthetic polypeptide
  XENP021744 7G8_H3.1_L1.13_Fab Heavy Chain

SEQ ID NO: 32145 - protein, 121 aa, Artificial Sequence; identical to SEQ ID NO: 28945
  Description of Artificial Sequence: Synthetic polypeptide
  VH of XENP021744

SEQ ID NO: 32146 - protein, 5 aa, Artificial Sequence
  Description of Artificial Sequence: Synthetic peptide
  XENP021744 vhCDR1
DAWMD

SEQ ID NO: 32147 - protein, 19 aa, Artificial Sequence
  Description of Artificial Sequence: Synthetic peptide
  XENP021744 vhCDR2
EIRTKANNHATYYAESVKG

SEQ ID NO: 32148 - protein, 10 aa, Artificial Sequence
  Description of Artificial Sequence: Synthetic peptide
  XENP021744 vhCDR3
LATWDWYFDV

SEQ ID NO: 32149 - protein, 218 aa, Artificial Sequence; identical to SEQ ID NO: 22419
  Description of Artificial Sequence: Synthetic polypeptide
  XENP021744 7G8_H3.1_L1.13_Fab Light Chain

SEQ ID NO: 32150 - protein, 111 aa, Artificial Sequence; identical to SEQ ID NO: 22420
  Description of Artificial Sequence: Synthetic polypeptide
  VL of XENP021744

SEQ ID NO: 32151 - protein, 15 aa, Artificial Sequence
  Description of Artificial Sequence: Synthetic peptide
  XENP021744 vlCDR1
RASQSVDHDGDSYMN

SEQ ID NO: 32152 - protein, 7 aa, Artificial Sequence
  Description of Artificial Sequence: Synthetic peptide
  XENP021744 vlCDR2
AASELES

SEQ ID NO: 32153 - protein, 9 aa, Artificial Sequence
  Description of Artificial Sequence: Synthetic peptide
  XENP021744 vlCDR3
QQSNEDPFT

SEQ ID NO: 32154 - protein, 226 aa, Artificial Sequence; identical to SEQ ID NO: 32124
  Description of Artificial Sequence: Synthetic polypeptide
  XENP021745 7G8_H3.11_L1.15_Fab Heavy Chain

SEQ ID NO: 32155 - protein, 121 aa, Artificial Sequence; identical to SEQ ID NO: 32125
  Description of Artificial Sequence: Synthetic polypeptide
  VH of XENP021745

SEQ ID NO: 32156 - protein, 5 aa, Artificial Sequence
  Description of Artificial Sequence: Synthetic peptide
  XENP021745 vhCDR1
DAWMD

SEQ ID NO: 32157 - protein, 19 aa, Artificial Sequence
  Description of Artificial Sequence: Synthetic peptide
  XENP021745 vhCDR2
EISTKANNHATYYAESVKG

SEQ ID NO: 32158 - protein, 10 aa, Artificial Sequence
  Description of Artificial Sequence: Synthetic peptide
  XENP021745 vhCDR3
LANWDWYFDV

SEQ ID NO: 32159 - protein, 218 aa, Artificial Sequence; identical to SEQ ID NO: 31979
  Description of Artificial Sequence: Synthetic polypeptide
  XENP021745 7G8_H3.11_L1.15_Fab Light Chain

SEQ ID NO: 32160 - protein, 111 aa, Artificial Sequence; identical to SEQ ID NO: 31980
  Description of Artificial Sequence: Synthetic polypeptide
  VL of XENP021745

SEQ ID NO: 32161 - protein, 15 aa, Artificial Sequence
  Description of Artificial Sequence: Synthetic peptide
  XENP021745 vlCDR1
RASQSVDHDDDSYMN

SEQ ID NO: 32162 - protein, 7 aa, Artificial Sequence
  Description of Artificial Sequence: Synthetic peptide
  XENP021745 vlCDR2
AASELES

SEQ ID NO: 32163 - protein, 9 aa, Artificial Sequence
  Description of Artificial Sequence: Synthetic peptide
  XENP021745 vlCDR3
QQSNEDPFT

SEQ ID NO: 32164 - protein, 226 aa, Artificial Sequence; identical to SEQ ID NO: 28974
  Description of Artificial Sequence: Synthetic polypeptide
  XENP021746 7G8_H3.4_L1.15_Fab Heavy Chain

SEQ ID NO: 32165 - protein, 121 aa, Artificial Sequence; identical to SEQ ID NO: 28975
  Description of Artificial Sequence: Synthetic polypeptide
  VH of XENP021746

SEQ ID NO: 32166 - protein, 5 aa, Artificial Sequence
  Description of Artificial Sequence: Synthetic peptide
  XENP021746 vhCDR1
DAWMD

SEQ ID NO: 32167 - protein, 19 aa, Artificial Sequence
  Description of Artificial Sequence: Synthetic peptide
  XENP021746 vhCDR2
EIRTKANNHATYYAESVKG

SEQ ID NO: 32168 - protein, 10 aa, Artificial Sequence
  Description of Artificial Sequence: Synthetic peptide
  XENP021746 vhCDR3
LATWDWYFDV

SEQ ID NO: 32169 - protein, 218 aa, Artificial Sequence; identical to SEQ ID NO: 31979
  Description of Artificial Sequence: Synthetic polypeptide
  XENP021746 7G8_H3.4_L1.15_Fab Light Chain

SEQ ID NO: 32170 - protein, 111 aa, Artificial Sequence; identical to SEQ ID NO: 31980
  Description of Artificial Sequence: Synthetic polypeptide
  VL of XENP021746

SEQ ID NO: 32171 - protein, 15 aa, Artificial Sequence
  Description of Artificial Sequence: Synthetic peptide
  XENP021746 vlCDR1
RASQSVDHDDDSYMN

SEQ ID NO: 32172 - protein, 7 aa, Artificial Sequence
  Description of Artificial Sequence: Synthetic peptide
  XENP021746 vlCDR2
AASELES

SEQ ID NO: 32173 - protein, 9 aa, Artificial Sequence
  Description of Artificial Sequence: Synthetic peptide
  XENP021746 vlCDR3
QQSNEDPFT

SEQ ID NO: 32174 - protein, 226 aa, Artificial Sequence; identical to SEQ ID NO: 28944
  Description of Artificial Sequence: Synthetic polypeptide
  XENP021747 7G8_H3.1_L1.15_Fab Heavy Chain

SEQ ID NO: 32175 - protein, 121 aa, Artificial Sequence; identical to SEQ ID NO: 28945
  Description of Artificial Sequence: Synthetic polypeptide
  VH of XENP021747

SEQ ID NO: 32176 - protein, 5 aa, Artificial Sequence
  Description of Artificial Sequence: Synthetic peptide
  XENP021747 vhCDR1
DAWMD

SEQ ID NO: 32177 - protein, 19 aa, Artificial Sequence
  Description of Artificial Sequence: Synthetic peptide
  XENP021747 vhCDR2
EIRTKANNHATYYAESVKG

SEQ ID NO: 32178 - protein, 10 aa, Artificial Sequence
  Description of Artificial Sequence: Synthetic peptide
  XENP021747 vhCDR3
LATWDWYFDV

SEQ ID NO: 32179 - protein, 218 aa, Artificial Sequence; identical to SEQ ID NO: 31979
  Description of Artificial Sequence: Synthetic polypeptide
  XENP021747 7G8_H3.1_L1.15_Fab Light Chain

SEQ ID NO: 32180 - protein, 111 aa, Artificial Sequence; identical to SEQ ID NO: 31980
  Description of Artificial Sequence: Synthetic polypeptide
  VL of XENP021747

SEQ ID NO: 32181 - protein, 15 aa, Artificial Sequence
  Description of Artificial Sequence: Synthetic peptide
  XENP021747 vlCDR1
RASQSVDHDDDSYMN

SEQ ID NO: 32182 - protein, 7 aa, Artificial Sequence
  Description of Artificial Sequence: Synthetic peptide
  XENP021747 vlCDR2
AASELES

SEQ ID NO: 32183 - protein, 9 aa, Artificial Sequence
  Description of Artificial Sequence: Synthetic peptide
  XENP021747 vlCDR3
QQSNEDPFT

SEQ ID NO: 32184 - protein, 226 aa, Artificial Sequence
  Description of Artificial Sequence: Synthetic polypeptide
  XENP021889 7G8_H3.27_L1_Fab Heavy Chain
EVQLVESGGGLVQPGGSLRLSCAASGDTFDDAWMDWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCGS

SEQ ID NO: 32185 - protein, 121 aa, Artificial Sequence
  Description of Artificial Sequence: Synthetic polypeptide
  VH of XENP021889
EVQLVESGGGLVQPGGSLRLSCAASGDTFDDAWMDWVRQAPGKGLEWVAEISTKAYNHATYYAESVKGRFTISRDDSKSSVYLQMNSLRAEDTAVYYCTRLATWDWYFDVWGQGTTVTVSS

SEQ ID NO: 32186 - protein, 5 aa, Artificial Sequence
  Description of Artificial Sequence: Synthetic peptide
  XENP021889 vhCDR1
DAWMD

SEQ ID NO: 32187 - protein, 19 aa, Artificial Sequence
  Description of Artificial Sequence: Synthetic peptide
  XENP021889 vhCDR2
EISTKAYNHATYYAESVKG

SEQ ID NO: 32188 - protein, 10 aa, Artificial Sequence
  Description of Artificial Sequence: Synthetic peptide
  XENP021889 vhCDR3
LATWDWYFDV

SEQ ID NO: 32189 - protein, 218 aa, Artificial Sequence; identical to SEQ ID NO: 17600
  Description of Artificial Sequence: Synthetic polypeptide
  XENP021889 7G8_H3.27_L1_Fab Light Chain

SEQ ID NO: 32190 - protein, 111 aa, Artificial Sequence; identical to SEQ ID NO: 17601
  Description of Artificial Sequence: Synthetic polypeptide
  VL of XENP021889

SEQ ID NO: 32191 - protein, 15 aa, Artificial Sequence
  Description of Artificial Sequence: Synthetic peptide
  XENP021889 vlCDR1
RASQSVDYDGDSYMN

SEQ ID NO: 32192 - protein, 7 aa, Artificial Sequence
  Description of Artificial Sequence: Synthetic peptide
  XENP021889 vlCDR2
AASNLES

SEQ ID NO: 32193 - protein, 9 aa, Artificial Sequence
  Description of Artificial Sequence: Synthetic peptide
  XENP021889 vlCDR3
QQSNEDPFT

SEQ ID NO: 32194 - protein, 226 aa, Artificial Sequence; identical to SEQ ID NO: 32184
  Description of Artificial Sequence: Synthetic polypeptide
  XENP021890 7G8_H3.27_L1.11_Fab Heavy Chain

SEQ ID NO: 32195 - protein, 121 aa, Artificial Sequence; identical to SEQ ID NO: 32185
  Description of Artificial Sequence: Synthetic polypeptide
  VH of XENP021890

SEQ ID NO: 32196 - protein, 5 aa, Artificial Sequence
  Description of Artificial Sequence: Synthetic peptide
  XENP021890 vhCDR1
DAWMD

SEQ ID NO: 32197 - protein, 19 aa, Artificial Sequence
  Description of Artificial Sequence: Synthetic peptide
  XENP021890 vhCDR2
EISTKAYNHATYYAESVKG

SEQ ID NO: 32198 - protein, 10 aa, Artificial Sequence
  Description of Artificial Sequence: Synthetic peptide
  XENP021890 vhCDR3
LATWDWYFDV

SEQ ID NO: 32199 - protein, 218 aa, Artificial Sequence; identical to SEQ ID NO: 22359
  Description of Artificial Sequence: Synthetic polypeptide
  XENP021890 7G8_H3.27_L1.11_Fab Light Chain

SEQ ID NO: 32200 - protein, 111 aa, Artificial Sequence; identical to SEQ ID NO: 22360
  Description of Artificial Sequence: Synthetic polypeptide
  VL of XENP021890

SEQ ID NO: 32201 - protein, 15 aa, Artificial Sequence
  Description of Artificial Sequence: Synthetic peptide
  XENP021890 vlCDR1
RASQSVDYDGDSYMN

SEQ ID NO: 32202 - protein, 7 aa, Artificial Sequence
  Description of Artificial Sequence: Synthetic peptide
  XENP021890 vlCDR2
AASELES

SEQ ID NO: 32203 - protein, 9 aa, Artificial Sequence
  Description of Artificial Sequence: Synthetic peptide
  XENP021890 vlCDR3
QQSNEDPFT

SEQ ID NO: 32204 - protein, 226 aa, Artificial Sequence; identical to SEQ ID NO: 32184
  Description of Artificial Sequence: Synthetic polypeptide
  XENP021891 7G8_H3.27_L1.13_Fab Heavy Chain

SEQ ID NO: 32205 - protein, 121 aa, Artificial Sequence; identical to SEQ ID NO: 32185
  Description of Artificial Sequence: Synthetic polypeptide
  VH of XENP021891

SEQ ID NO: 32206 - protein, 5 aa, Artificial Sequence
  Description of Artificial Sequence: Synthetic peptide
  XENP021891 vhCDR1
DAWMD

SEQ ID NO: 32207 - protein, 19 aa, Artificial Sequence
  Description of Artificial Sequence: Synthetic peptide
  XENP021891 vhCDR2
EISTKAYNHATYYAESVKG

SEQ ID NO: 32208 - protein, 10 aa, Artificial Sequence
  Description of Artificial Sequence: Synthetic peptide
  XENP021891 vhCDR3
LATWDWYFDV

SEQ ID NO: 32209 - protein, 218 aa, Artificial Sequence; identical to SEQ ID NO: 22419
  Description of Artificial Sequence: Synthetic polypeptide
  XENP021891 7G8_H3.27_L1.13_Fab Light Chain

SEQ ID NO: 32210 - protein, 111 aa, Artificial Sequence; identical to SEQ ID NO: 22420
  Description of Artificial Sequence: Synthetic polypeptide
  VL of XENP021891

SEQ ID NO: 32211 - protein, 15 aa, Artificial Sequence
  Description of Artificial Sequence: Synthetic peptide
  XENP021891 vlCDR1
RASQSVDHDGDSYMN

SEQ ID NO: 32212 - protein, 7 aa, Artificial Sequence
  Description of Artificial Sequence: Synthetic peptide
  XENP021891 vlCDR2
AASELES

SEQ ID NO: 32213 - protein, 9 aa, Artificial Sequence
  Description of Artificial Sequence: Synthetic peptide
  XENP021891 vlCDR3
QQSNEDPFT

SEQ ID NO: 32214 - protein, 226 aa, Artificial Sequence
  Description of Artificial Sequence: Synthetic polypeptide
  XENP021892 7G8_H3.28_L1_Fab Heavy Chain
EVQLVESGGGLVQPGGSLRLSCAASGFTFDDAWMDWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCGS

SEQ ID NO: 32215 - protein, 121 aa, Artificial Sequence; identical to SEQ ID NO: 22425
  Description of Artificial Sequence: Synthetic polypeptide
  VH of XENP021892

SEQ ID NO: 32216 - protein, 5 aa, Artificial Sequence
  Description of Artificial Sequence: Synthetic peptide
  XENP021892 vhCDR1
DAWMD

SEQ ID NO: 32217 - protein, 19 aa, Artificial Sequence
  Description of Artificial Sequence: Synthetic peptide
  XENP021892 vhCDR2
EISTKAYNHATYYAESVKG

SEQ ID NO: 32218 - protein, 10 aa, Artificial Sequence
  Description of Artificial Sequence: Synthetic peptide
  XENP021892 vhCDR3
LATWDWYFDV

SEQ ID NO: 32219 - protein, 218 aa, Artificial Sequence; identical to SEQ ID NO: 17600
  Description of Artificial Sequence: Synthetic polypeptide
  XENP021892 7G8_H3.28_L1_Fab Light Chain

SEQ ID NO: 32220 - protein, 111 aa, Artificial Sequence; identical to SEQ ID NO: 17601
  Description of Artificial Sequence: Synthetic polypeptide
  VL of XENP021892

SEQ ID NO: 32221 - protein, 15 aa, Artificial Sequence
  Description of Artificial Sequence: Synthetic peptide
  XENP021892 vlCDR1
RASQSVDYDGDSYMN

SEQ ID NO: 32222 - protein, 7 aa, Artificial Sequence
  Description of Artificial Sequence: Synthetic peptide
  XENP021892 vlCDR2
AASNLES

SEQ ID NO: 32223 - protein, 9 aa, Artificial Sequence
  Description of Artificial Sequence: Synthetic peptide
  XENP021892 vlCDR3
QQSNEDPFT

SEQ ID NO: 32224 - protein, 226 aa, Artificial Sequence; identical to SEQ ID NO: 32214
  Description of Artificial Sequence: Synthetic polypeptide
  XENP021893 7G8_H3.28_L1.11_Fab Heavy Chain

SEQ ID NO: 32225 - protein, 121 aa, Artificial Sequence; identical to SEQ ID NO: 22425
  Description of Artificial Sequence: Synthetic polypeptide
  VH of XENP021893

SEQ ID NO: 32226 - protein, 5 aa, Artificial Sequence
  Description of Artificial Sequence: Synthetic peptide
  XENP021893 vhCDR1
DAWMD

SEQ ID NO: 32227 - protein, 19 aa, Artificial Sequence
  Description of Artificial Sequence: Synthetic peptide
  XENP021893 vhCDR2
EISTKAYNHATYYAESVKG

SEQ ID NO: 32228 - protein, 10 aa, Artificial Sequence
  Description of Artificial Sequence: Synthetic peptide
  XENP021893 vhCDR3
LATWDWYFDV

SEQ ID NO: 32229 - protein, 218 aa, Artificial Sequence; identical to SEQ ID NO: 22359
  Description of Artificial Sequence: Synthetic polypeptide
  XENP021893 7G8_H3.28_L1.11_Fab Light Chain

SEQ ID NO: 32230 - protein, 111 aa, Artificial Sequence; identical to SEQ ID NO: 22360
  Description of Artificial Sequence: Synthetic polypeptide
  VL of XENP021893

SEQ ID NO: 32231 - protein, 15 aa, Artificial Sequence
  Description of Artificial Sequence: Synthetic peptide
  XENP021893 vlCDR1
RASQSVDYDGDSYMN

SEQ ID NO: 32232 - protein, 7 aa, Artificial Sequence
  Description of Artificial Sequence: Synthetic peptide
  XENP021893 vlCDR2
AASELES

SEQ ID NO: 32233 - protein, 9 aa, Artificial Sequence
  Description of Artificial Sequence: Synthetic peptide
  XENP021893 vlCDR3
QQSNEDPFT

SEQ ID NO: 32234 - protein, 226 aa, Artificial Sequence; identical to SEQ ID NO: 32214
  Description of Artificial Sequence: Synthetic polypeptide
  XENP021894 7G8_H3.28_L1.13_Fab Heavy Chain

SEQ ID NO: 32235 - protein, 121 aa, Artificial Sequence; identical to SEQ ID NO: 22425
  Description of Artificial Sequence: Synthetic polypeptide
  VH of XENP021894

SEQ ID NO: 32236 - protein, 5 aa, Artificial Sequence
  Description of Artificial Sequence: Synthetic peptide
  XENP021894 vhCDR1
DAWMD

SEQ ID NO: 32237 - protein, 19 aa, Artificial Sequence
  Description of Artificial Sequence: Synthetic peptide
  XENP021894 vhCDR2
EISTKAYNHATYYAESVKG

SEQ ID NO: 32238 - protein, 10 aa, Artificial Sequence
  Description of Artificial Sequence: Synthetic peptide
  XENP021894 vhCDR3
LATWDWYFDV

SEQ ID NO: 32239 - protein, 218 aa, Artificial Sequence; identical to SEQ ID NO: 22419
  Description of Artificial Sequence: Synthetic polypeptide
  XENP021894 7G8_H3.28_L1.13_Fab Light Chain

SEQ ID NO: 32240 - protein, 111 aa, Artificial Sequence; identical to SEQ ID NO: 22420
  Description of Artificial Sequence: Synthetic polypeptide
  VL of XENP021894

SEQ ID NO: 32241 - protein, 15 aa, Artificial Sequence
  Description of Artificial Sequence: Synthetic peptide
  XENP021894 vlCDR1
RASQSVDHDGDSYMN

SEQ ID NO: 32242 - protein, 7 aa, Artificial Sequence
  Description of Artificial Sequence: Synthetic peptide
  XENP021894 vlCDR2
AASELES

SEQ ID NO: 32243 - protein, 9 aa, Artificial Sequence
  Description of Artificial Sequence: Synthetic peptide
  XENP021894 vlCDR3
QQSNEDPFT

SEQ ID NO: 32244 - protein, 226 aa, Artificial Sequence
  Description of Artificial Sequence: Synthetic polypeptide
  XENP022379 7G8_H3.29_L1.11_Fab Heavy Chain
EVQLVESGGGLVQPGGSLRLSCAASGFTFDDAWMHWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32245 - protein, 121 aa, Artificial Sequence
  Description of Artificial Sequence: Synthetic polypeptide
  VH of XENP022379
EVQLVESGGGLVQPGGSLRLSCAASGFTFDDAWMHWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 32246 - protein, 5 aa, Artificial Sequence
  Description of Artificial Sequence: Synthetic peptide
  XENP022379 vhCDR1
DAWMH

SEQ ID NO: 32247 - protein, 19 aa, Artificial Sequence
  Description of Artificial Sequence: Synthetic peptide
  XENP022379 vhCDR2
EISTKANNHATYYAESVKG

SEQ ID NO: 32248 - protein, 10 aa, Artificial Sequence
  Description of Artificial Sequence: Synthetic peptide
  XENP022379 vhCDR3
LATWDWYFDV

SEQ ID NO: 32249 - protein, 218 aa, Artificial Sequence; identical to SEQ ID NO: 22359
  Description of Artificial Sequence: Synthetic polypeptide
  XENP022379 7G8_H3.29_L1.11_Fab Light Chain

SEQ ID NO: 32250 - protein, 111 aa, Artificial Sequence; identical to SEQ ID NO: 22360
  Description of Artificial Sequence: Synthetic polypeptide
  VL of XENP022379

SEQ ID NO: 32251 - protein, 15 aa, Artificial Sequence
  Description of Artificial Sequence: Synthetic peptide
  XENP022379 vlCDR1
RASQSVDYDGDSYMN

SEQ ID NO: 32252 - protein, 7 aa, Artificial Sequence
  Description of Artificial Sequence: Synthetic peptide
  XENP022379 vlCDR2
AASELES

SEQ ID NO: 32253 - protein, 9 aa, Artificial Sequence
  Description of Artificial Sequence: Synthetic peptide
  XENP022379 vlCDR3
QQSNEDPFT

SEQ ID NO: 32254 - protein, 226 aa, Artificial Sequence
  Description of Artificial Sequence: Synthetic polypeptide
  XENP022380 7G8_H3.30_L1.11_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32255 - protein, 121 aa, Artificial Sequence; identical to SEQ ID NO: 22485
  Description of Artificial Sequence: Synthetic polypeptide
  VH of XENP022380

SEQ ID NO: 32256 - protein, 5 aa, Artificial Sequence
  Description of Artificial Sequence: Synthetic peptide
  XENP022380 vhCDR1
DAWMS

SEQ ID NO: 32257 - protein, 19 aa, Artificial Sequence
  Description of Artificial Sequence: Synthetic peptide
  XENP022380 vhCDR2
EISTKANNHATYYAESVKG

SEQ ID NO: 32258 - protein, 10 aa, Artificial Sequence
  Description of Artificial Sequence: Synthetic peptide
  XENP022380 vhCDR3
LATWDWYFDV

SEQ ID NO: 32259 - protein, 218 aa, Artificial Sequence; identical to SEQ ID NO: 22359
  Description of Artificial Sequence: Synthetic polypeptide
  XENP022380 7G8_H3.30_L1.11_Fab Light Chain

SEQ ID NO: 32260 - protein, 111 aa, Artificial Sequence; identical to SEQ ID NO: 22360
  Description of Artificial Sequence: Synthetic polypeptide
  VL of XENP022380

SEQ ID NO: 32261 - protein, 15 aa, Artificial Sequence
  Description of Artificial Sequence: Synthetic peptide
  XENP022380 vlCDR1
RASQSVDYDGDSYMN

SEQ ID NO: 32262 - protein, 7 aa, Artificial Sequence
  Description of Artificial Sequence: Synthetic peptide
  XENP022380 vlCDR2
AASELES

SEQ ID NO: 32263 - protein, 9 aa, Artificial Sequence
  Description of Artificial Sequence: Synthetic peptide
  XENP022380 vlCDR3
QQSNEDPFT

SEQ ID NO: 32264 - protein, 226 aa, Artificial Sequence
  Description of Artificial Sequence: Synthetic polypeptide
  XENP022381 7G8_H3.31_L1.11_Fab Heavy Chain
EVQLVESGGGLVQPGGSLRLSCAASGFTFDDAWMNWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32265 - protein, 121 aa, Artificial Sequence
  Description of Artificial Sequence: Synthetic polypeptide
  VH of XENP022381
EVQLVESGGGLVQPGGSLRLSCAASGFTFDDAWMNWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 32266 - protein, 5 aa, Artificial Sequence
  Description of Artificial Sequence: Synthetic peptide
  XENP022381 vhCDR1
DAWMN

SEQ ID NO: 32267 - protein, 19 aa, Artificial Sequence
  Description of Artificial Sequence: Synthetic peptide
  XENP022381 vhCDR2
EISTKANNHATYYAESVKG

SEQ ID NO: 32268 - protein, 10 aa, Artificial Sequence
  Description of Artificial Sequence: Synthetic peptide
  XENP022381 vhCDR3
LATWDWYFDV

SEQ ID NO: 32269 - protein, 218 aa, Artificial Sequence; identical to SEQ ID NO: 22359
  Description of Artificial Sequence: Synthetic polypeptide
  XENP022381 7G8_H3.31_L1.11_Fab Light Chain

SEQ ID NO: 32270 - protein, 111 aa, Artificial Sequence; identical to SEQ ID NO: 22360
  Description of Artificial Sequence: Synthetic polypeptide
  VL of XENP022381

SEQ ID NO: 32271 - protein, 15 aa, Artificial Sequence
  Description of Artificial Sequence: Synthetic peptide
  XENP022381 vlCDR1
RASQSVDYDGDSYMN

SEQ ID NO: 32272 - protein, 7 aa, Artificial Sequence
  Description of Artificial Sequence: Synthetic peptide
  XENP022381 vlCDR2
AASELES

SEQ ID NO: 32273 - protein, 9 aa, Artificial Sequence
  Description of Artificial Sequence: Synthetic peptide
  XENP022381 vlCDR3
QQSNEDPFT

SEQ ID NO: 32274 - protein, 226 aa, Artificial Sequence
  Description of Artificial Sequence: Synthetic polypeptide
  XENP022382 7G8_H3.32_L1.11_Fab Heavy Chain
EVQLVESGGGLVQPGGSLRLSCAASGFTFDDAWMQWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32275 - protein, 121 aa, Artificial Sequence
  Description of Artificial Sequence: Synthetic polypeptide
  VH of XENP022382
EVQLVESGGGLVQPGGSLRLSCAASGFTFDDAWMQWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 32276 - protein, 5 aa, Artificial Sequence
  Description of Artificial Sequence: Synthetic peptide
  XENP022382 vhCDR1
DAWMQ

SEQ ID NO: 32277 - protein, 19 aa, Artificial Sequence
  Description of Artificial Sequence: Synthetic peptide
  XENP022382 vhCDR2
EISTKANNHATYYAESVKG

SEQ ID NO: 32278 - protein, 10 aa, Artificial Sequence
  Description of Artificial Sequence: Synthetic peptide
  XENP022382 vhCDR3
LATWDWYFDV

SEQ ID NO: 32279 - protein, 218 aa, Artificial Sequence; identical to SEQ ID NO: 22359
  Description of Artificial Sequence: Synthetic polypeptide
  XENP022382 7G8_H3.32_L1.11_Fab Light Chain

SEQ ID NO: 32280 - protein, 111 aa, Artificial Sequence; identical to SEQ ID NO: 22360
  Description of Artificial Sequence: Synthetic polypeptide
  VL of XENP022382

SEQ ID NO: 32281 - protein, 15 aa, Artificial Sequence
  Description of Artificial Sequence: Synthetic peptide
  XENP022382 vlCDR1
RASQSVDYDGDSYMN

SEQ ID NO: 32282 - protein, 7 aa, Artificial Sequence
  Description of Artificial Sequence: Synthetic peptide
  XENP022382 vlCDR2
AASELES

SEQ ID NO: 32283 - protein, 9 aa, Artificial Sequence
  Description of Artificial Sequence: Synthetic peptide
  XENP022382 vlCDR3
QQSNEDPFT

SEQ ID NO: 32284 - protein, 226 aa, Artificial Sequence
  Description of Artificial Sequence: Synthetic polypeptide
  XENP022383 7G8_H3.33_L1.11_Fab Heavy Chain
EVQLVESGGGLVQPGGSLRLSCAASGFTFDDAWMGWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32285 - protein, 121 aa, Artificial Sequence; identical to SEQ ID NO: 22505
  Description of Artificial Sequence: Synthetic polypeptide
  VH of XENP022383

SEQ ID NO: 32286 - protein, 5 aa, Artificial Sequence
  Description of Artificial Sequence: Synthetic peptide
  XENP022383 vhCDR1
DAWMG

SEQ ID NO: 32287 - protein, 19 aa, Artificial Sequence
  Description of Artificial Sequence: Synthetic peptide
  XENP022383 vhCDR2
EISTKANNHATYYAESVKG

SEQ ID NO: 32288 - protein, 10 aa, Artificial Sequence
  Description of Artificial Sequence: Synthetic peptide
  XENP022383 vhCDR3
LATWDWYFDV

SEQ ID NO: 32289 - protein, 218 aa, Artificial Sequence; identical to SEQ ID NO: 22359
  Description of Artificial Sequence: Synthetic polypeptide
  XENP022383 7G8_H3.33_L1.11_Fab Light Chain

SEQ ID NO: 32290 - protein, 111 aa, Artificial Sequence; identical to SEQ ID NO: 22360
  Description of Artificial Sequence: Synthetic polypeptide
  VL of XENP022383

SEQ ID NO: 32291 - protein, 15 aa, Artificial Sequence
  Description of Artificial Sequence: Synthetic peptide
  XENP022383 vlCDR1
RASQSVDYDGDSYMN

SEQ ID NO: 32292 - protein, 7 aa, Artificial Sequence
  Description of Artificial Sequence: Synthetic peptide
  XENP022383 vlCDR2
AASELES

SEQ ID NO: 32293 - protein, 9 aa, Artificial Sequence
  Description of Artificial Sequence: Synthetic peptide
  XENP022383 vlCDR3
QQSNEDPFT

SEQ ID NO: 32294 - protein, 226 aa, Artificial Sequence
  Description of Artificial Sequence: Synthetic polypeptide
  XENP022384 7G8_H3.34_L1.11_Fab Heavy Chain
EVQLVESGGGLVQPGGSLRLSCAASGFTFDDAWMDWVRQAPGKGLEWVAEISTKANNHATYYAQSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32295 - protein, 121 aa, Artificial Sequence
  Description of Artificial Sequence: Synthetic polypeptide
  VH of XENP022384
EVQLVESGGGLVQPGGSLRLSCAASGFTFDDAWMDWVRQAPGKGLEWVAEISTKANNHATYYAQSVKGRFTISRDDSKSSVYLQMNSLRAEDTAVYYCTRLATWDWYFDVWGQGTTVTVSS

SEQ ID NO: 32296 - protein, 5 aa, Artificial Sequence
  Description of Artificial Sequence: Synthetic peptide
  XENP022384 vhCDR1
DAWMD

SEQ ID NO: 32297 - protein, 19 aa, Artificial Sequence
  Description of Artificial Sequence: Synthetic peptide
  XENP022384 vhCDR2
EISTKANNHATYYAQSVKG

SEQ ID NO: 32298 - protein, 10 aa, Artificial Sequence
  Description of Artificial Sequence: Synthetic peptide
  XENP022384 vhCDR3
LATWDWYFDV

SEQ ID NO: 32299 - protein, 218 aa, Artificial Sequence; identical to SEQ ID NO: 22359
  Description of Artificial Sequence: Synthetic polypeptide
  XENP022384 7G8_H3.34_L1.11_Fab Light Chain

SEQ ID NO: 32300 - protein, 111 aa, Artificial Sequence; identical to SEQ ID NO: 22360
  Description of Artificial Sequence: Synthetic polypeptide
  VL of XENP022384

SEQ ID NO: 32301 - protein, 15 aa, Artificial Sequence
  Description of Artificial Sequence: Synthetic peptide
  XENP022384 vlCDR1
RASQSVDYDGDSYMN

SEQ ID NO: 32302 - protein, 7 aa, Artificial Sequence
  Description of Artificial Sequence: Synthetic peptide
  XENP022384 vlCDR2
AASELES

SEQ ID NO: 32303 - protein, 9 aa, Artificial Sequence
  Description of Artificial Sequence: Synthetic peptide
  XENP022384 vlCDR3
QQSNEDPFT

SEQ ID NO: 32304 - protein, 226 aa, Artificial Sequence
  Description of Artificial Sequence: Synthetic polypeptide
  XENP022385 7G8_H3.35_L1.11_Fab Heavy Chain
EVQLVESGGGLVQPGGSLRLSCAASGFTFDDAWMDWVRQAPGKGLEWVAEISTKANNHATYYAPSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32305 - protein, 121 aa, Artificial Sequence
  Description of Artificial Sequence: Synthetic polypeptide
  VH of XENP022385
EVQLVESGGGLVQPGGSLRLSCAASGFTFDDAWMDWVRQAPGKGLEWVAEISTKANNHATYYAPSVKGRFTISRDDSKSSVYLQMNSLRAEDTAVYYCTRLATWDWYFDVWGQGTTVTVSS

SEQ ID NO: 32306 - protein, 5 aa, Artificial Sequence
  Description of Artificial Sequence: Synthetic peptide
  XENP022385 vhCDR1
DAWMD

SEQ ID NO: 32307 - protein, 19 aa, Artificial Sequence
  Description of Artificial Sequence: Synthetic peptide
  XENP022385 vhCDR2
EISTKANNHATYYAPSVKG

SEQ ID NO: 32308 - protein, 10 aa, Artificial Sequence
  Description of Artificial Sequence: Synthetic peptide
  XENP022385 vhCDR3
LATWDWYFDV

SEQ ID NO: 32309 - protein, 218 aa, Artificial Sequence; identical to SEQ ID NO: 22359
  Description of Artificial Sequence: Synthetic polypeptide
  XENP022385 7G8_H3.35_L1.11_Fab Light Chain

SEQ ID NO: 32310 - protein, 111 aa, Artificial Sequence; identical to SEQ ID NO: 22360
  Description of Artificial Sequence: Synthetic polypeptide
  VL of XENP022385

SEQ ID NO: 32311 - protein, 15 aa, Artificial Sequence
  Description of Artificial Sequence: Synthetic peptide
  XENP022385 vlCDR1
RASQSVDYDGDSYMN

SEQ ID NO: 32312 - protein, 7 aa, Artificial Sequence
  Description of Artificial Sequence: Synthetic peptide
  XENP022385 vlCDR2
AASELES

SEQ ID NO: 32313 - protein, 9 aa, Artificial Sequence
  Description of Artificial Sequence: Synthetic peptide
  XENP022385 vlCDR3
QQSNEDPFT

SEQ ID NO: 32314 - protein, 226 aa, Artificial Sequence
  Description of Artificial Sequence: Synthetic polypeptide
  XENP022386 7G8_H3.36_L1.11_Fab Heavy Chain
EVQLVESGGGLVQPGGSLRLSCAASGFTFDDAWMDWVRQAPGKGLEWVAEISTKANNHATYYATSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32315 - protein, 121 aa, Artificial Sequence
  Description of Artificial Sequence: Synthetic polypeptide
  VH of XENP022386
EVQLVESGGGLVQPGGSLRLSCAASGFTFDDAWMDWVRQAPGKGLEWVAEISTKANNHATYYATSVKGRFTISRDDSKSSVYLQMNSLRAEDTAVYYCTRLATWDWYFDVWGQGTTVTVSS

SEQ ID NO: 32316 - protein, 5 aa, Artificial Sequence
  Description of Artificial Sequence: Synthetic peptide
  XENP022386 vhCDR1
DAWMD

SEQ ID NO: 32317 - protein, 19 aa, Artificial Sequence
  Description of Artificial Sequence: Synthetic peptide
  XENP022386 vhCDR2
EISTKANNHATYYATSVKG

SEQ ID NO: 32318 - protein, 10 aa, Artificial Sequence
  Description of Artificial Sequence: Synthetic peptide
  XENP022386 vhCDR3
LATWDWYFDV

SEQ ID NO: 32319 - protein, 218 aa, Artificial Sequence; identical to SEQ ID NO: 22359
  Description of Artificial Sequence: Synthetic polypeptide
  XENP022386 7G8_H3.36_L1.11_Fab Light Chain

SEQ ID NO: 32320 - protein, 111 aa, Artificial Sequence; identical to SEQ ID NO: 22360
  Description of Artificial Sequence: Synthetic polypeptide
  VL of XENP022386

SEQ ID NO: 32321 - protein, 15 aa, Artificial Sequence
  Description of Artificial Sequence: Synthetic peptide
  XENP022386 vlCDR1
RASQSVDYDGDSYMN

SEQ ID NO: 32322 - protein, 7 aa, Artificial Sequence
  Description of Artificial Sequence: Synthetic peptide
  XENP022386 vlCDR2
AASELES

SEQ ID NO: 32323 - protein, 9 aa, Artificial Sequence
  Description of Artificial Sequence: Synthetic peptide
  XENP022386 vlCDR3
QQSNEDPFT

SEQ ID NO: 32324 - protein, 226 aa, Artificial Sequence
  Description of Artificial Sequence: Synthetic polypeptide
  XENP022387 7G8_H3.37_L1.11_Fab Heavy Chain
EVQLVESGGGLVQPGGSLRLSCAASGFTFDDAWMDWVRQAPGKGLEWVAEISTKANNHATYYADSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32325 - protein, 121 aa, Artificial Sequence
  Description of Artificial Sequence: Synthetic polypeptide
  VH of XENP022387
EVQLVESGGGLVQPGGSLRLSCAASGFTFDDAWMDWVRQAPGKGLEWVAEISTKANNHATYYADSVKGRFTISRDDSKSSVYLQMNSLRAEDTAVYYCTRLATWDWYFDVWGQGTTVTVSS

SEQ ID NO: 32326 - protein, 5 aa, Artificial Sequence
  Description of Artificial Sequence: Synthetic peptide
  XENP022387 vhCDR1
DAWMD

SEQ ID NO: 32327 - protein, 19 aa, Artificial Sequence
  Description of Artificial Sequence: Synthetic peptide
  XENP022387 vhCDR2
EISTKANNHATYYADSVKG

SEQ ID NO: 32328 - protein, 10 aa, Artificial Sequence
  Description of Artificial Sequence: Synthetic peptide
  XENP022387 vhCDR3
LATWDWYFDV

SEQ ID NO: 32329 - protein, 218 aa, Artificial Sequence; identical to SEQ ID NO: 22359
  Description of Artificial Sequence: Synthetic polypeptide
  XENP022387 7G8_H3.37_L1.11_Fab Light Chain

SEQ ID NO: 32330 - protein, 111 aa, Artificial Sequence; identical to SEQ ID NO: 22360
  Description of Artificial Sequence: Synthetic polypeptide
  VL of XENP022387

SEQ ID NO: 32331 - protein, 15 aa, Artificial Sequence
  Description of Artificial Sequence: Synthetic peptide
  XENP022387 vlCDR1
RASQSVDYDGDSYMN

SEQ ID NO: 32332 - protein, 7 aa, Artificial Sequence
  Description of Artificial Sequence: Synthetic peptide
  XENP022387 vlCDR2
AASELES

SEQ ID NO: 32333 - protein, 9 aa, Artificial Sequence
  Description of Artificial Sequence: Synthetic peptide
  XENP022387 vlCDR3
QQSNEDPFT

SEQ ID NO: 32334 - protein, 226 aa, Artificial Sequence
  Description of Artificial Sequence: Synthetic polypeptide
  XENP022388 7G8_H3.38_L1.11_Fab Heavy Chain
EVQLVESGGGLVQPGGSLRLSCAASGFTFDDAWMDWVRQAPGKGLEWVAEISTKANNHATYYAGSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32335 - protein, 121 aa, Artificial Sequence
  Description of Artificial Sequence: Synthetic polypeptide
  VH of XENP022388
EVQLVESGGGLVQPGGSLRLSCAASGFTFDDAWMDWVRQAPGKGLEWVAEISTKANNHATYYAGSVKGRFTISRDDSKSSVYLQMNSLRAEDTAVYYCTRLATWDWYFDVWGQGTTVTVSS

SEQ ID NO: 32336 - protein, 5 aa, Artificial Sequence
  Description of Artificial Sequence: Synthetic peptide
  XENP022388 vhCDR1
DAWMD

SEQ ID NO: 32337 - protein, 19 aa, Artificial Sequence
  Description of Artificial Sequence: Synthetic peptide
  XENP022388 vhCDR2
EISTKANNHATYYAGSVKG

SEQ ID NO: 32338 - protein, 10 aa, Artificial Sequence
  Description of Artificial Sequence: Synthetic peptide
  XENP022388 vhCDR3
LATWDWYFDV

SEQ ID NO: 32339 - protein, 218 aa, Artificial Sequence; identical to SEQ ID NO: 22359
  Description of Artificial Sequence: Synthetic polypeptide
  XENP022388 7G8_H3.38_L1.11_Fab Light Chain

SEQ ID NO: 32340 - protein, 111 aa, Artificial Sequence; identical to SEQ ID NO: 22360
  Description of Artificial Sequence: Synthetic polypeptide
  VL of XENP022388

SEQ ID NO: 32341 - protein, 15 aa, Artificial Sequence
  Description of Artificial Sequence: Synthetic peptide
  XENP022388 vlCDR1
RASQSVDYDGDSYMN

SEQ ID NO: 32342 - protein, 7 aa, Artificial Sequence
  Description of Artificial Sequence: Synthetic peptide
  XENP022388 vlCDR2
AASELES

SEQ ID NO: 32343 - protein, 9 aa, Artificial Sequence
  Description of Artificial Sequence: Synthetic peptide
  XENP022388 vlCDR3
QQSNEDPFT

SEQ ID NO: 32344 - protein, 226 aa, Artificial Sequence
  Description of Artificial Sequence: Synthetic polypeptide
  XENP022389 7G8_H3.39_L1.11_Fab Heavy Chain
EVQLVESGGGLVQPGGSLRLSCAASGFTFDDAWMDWVRQAPGKGLEWVAEISTKANNHATYYAASVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32345 - protein, 121 aa, Artificial Sequence
  Description of Artificial Sequence: Synthetic polypeptide
  VH of XENP022389
EVQLVESGGGLVQPGGSLRLSCAASGFTFDDAWMDWVRQAPGKGLEWVAEISTKANNHATYYAASVKGRFTISRDDSKSSVYLQMNSLRAEDTAVYYCTRLATWDWYFDVWGQGTTVTVSS

SEQ ID NO: 32346 - protein, 5 aa, Artificial Sequence
  Description of Artificial Sequence: Synthetic peptide
  XENP022389 vhCDR1
DAWMD

SEQ ID NO: 32347 - protein, 19 aa, Artificial Sequence
  Description of Artificial Sequence: Synthetic peptide
  XENP022389 vhCDR2
EISTKANNHATYYAASVKG

SEQ ID NO: 32348 - protein, 10 aa, Artificial Sequence
  Description of Artificial Sequence: Synthetic peptide
  XENP022389 vhCDR3
LATWDWYFDV

SEQ ID NO: 32349 - protein, 218 aa, Artificial Sequence; identical to SEQ ID NO: 22359
  Description of Artificial Sequence: Synthetic polypeptide
  XENP022389 7G8_H3.39_L1.11_Fab Light Chain

SEQ ID NO: 32350 - protein, 111 aa, Artificial Sequence; identical to SEQ ID NO: 22360
  Description of Artificial Sequence: Synthetic polypeptide
  VL of XENP022389

SEQ ID NO: 32351 - protein, 15 aa, Artificial Sequence
  Description of Artificial Sequence: Synthetic peptide
  XENP022389 vlCDR1
RASQSVDYDGDSYMN

SEQ ID NO: 32352 - protein, 7 aa, Artificial Sequence
  Description of Artificial Sequence: Synthetic peptide
  XENP022389 vlCDR2
AASELES

SEQ ID NO: 32353 - protein, 9 aa, Artificial Sequence
  Description of Artificial Sequence: Synthetic peptide
  XENP022389 vlCDR3
QQSNEDPFT

SEQ ID NO: 32354 - protein, 226 aa, Artificial Sequence
  Description of Artificial Sequence: Synthetic polypeptide
  XENP022390 7G8_H3.40_L1.11_Fab Heavy Chain
EVQLVESGGGLVQPGGSLRLSCAASGFTFDDAWMDWVRQAPGKGLEWVAEISTKANNHATYYAVSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32355 - protein, 121 aa, Artificial Sequence
  Description of Artificial Sequence: Synthetic polypeptide
  VH of XENP022390
EVQLVESGGGLVQPGGSLRLSCAASGFTFDDAWMDWVRQAPGKGLEWVAEISTKANNHATYYAVSVKGRFTISRDDSKSSVYLQMNSLRAEDTAVYYCTRLATWDWYFDVWGQGTTVTVSS

SEQ ID NO: 32356 - protein, 5 aa, Artificial Sequence
  Description of Artificial Sequence: Synthetic peptide
  XENP022390 vhCDR1
DAWMD

SEQ ID NO: 32357 - protein, 19 aa, Artificial Sequence
  Description of Artificial Sequence: Synthetic peptide
  XENP022390 vhCDR2
EISTKANNHATYYAVSVKG

SEQ ID NO: 32358 - protein, 10 aa, Artificial Sequence
  Description of Artificial Sequence: Synthetic peptide
  XENP022390 vhCDR3
LATWDWYFDV

SEQ ID NO: 32359 - protein, 218 aa, Artificial Sequence; identical to SEQ ID NO: 22359
  Description of Artificial Sequence: Synthetic polypeptide
  XENP022390 7G8_H3.40_L1.11_Fab Light Chain

SEQ ID NO: 32360 - protein, 111 aa, Artificial Sequence; identical to SEQ ID NO: 22360
  Description of Artificial Sequence: Synthetic polypeptide
  VL of XENP022390

SEQ ID NO: 32361 - protein, 15 aa, Artificial Sequence
  Description of Artificial Sequence: Synthetic peptide
  XENP022390 vlCDR1
RASQSVDYDGDSYMN

SEQ ID NO: 32362 - protein, 7 aa, Artificial Sequence
  Description of Artificial Sequence: Synthetic peptide
  XENP022390 vlCDR2
AASELES

SEQ ID NO: 32363 - protein, 9 aa, Artificial Sequence
  Description of Artificial Sequence: Synthetic peptide
  XENP022390 vlCDR3
QQSNEDPFT

SEQ ID NO: 32364 - protein, 226 aa, Artificial Sequence
  Description of Artificial Sequence: Synthetic polypeptide
  XENP022391 7G8_H3.41_L1.11_Fab Heavy Chain
EVQLVESGGGLVQPGGSLRLSCAASGFTFDDAWMDWVRQAPGKGLEWVAEISTKANNHATYYAESVKGRFTISRDTSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32365 - protein, 121 aa, Artificial Sequence
  Description of Artificial Sequence: Synthetic polypeptide
  VH of XENP022391
EVQLVESGGGLVQPGGSLRLSCAASGFTFDDAWMDWVRQAPGKGLEWVAEISTKANNHATYYAESVKGRFTISRDTSKSSVYLQMNSLRAEDTAVYYCTRLATWDWYFDVWGQGTTVTVSS

SEQ ID NO: 32366 - protein, 5 aa, Artificial Sequence
  Description of Artificial Sequence: Synthetic peptide
  XENP022391 vhCDR1
DAWMD

SEQ ID NO: 32367 - protein, 19 aa, Artificial Sequence
  Description of Artificial Sequence: Synthetic peptide
  XENP022391 vhCDR2
EISTKANNHATYYAESVKG

SEQ ID NO: 32368 - protein, 10 aa, Artificial Sequence
  Description of Artificial Sequence: Synthetic peptide
  XENP022391 vhCDR3
LATWDWYFDV

SEQ ID NO: 32369 - protein, 218 aa, Artificial Sequence; identical to SEQ ID NO: 22359
  Description of Artificial Sequence: Synthetic polypeptide
  XENP022391 7G8_H3.41_L1.11_Fab Light Chain

SEQ ID NO: 32370 - protein, 111 aa, Artificial Sequence; identical to SEQ ID NO: 22360
  Description of Artificial Sequence: Synthetic polypeptide
  VL of XENP022391

SEQ ID NO: 32371 - protein, 15 aa, Artificial Sequence
  Description of Artificial Sequence: Synthetic peptide
  XENP022391 vlCDR1
RASQSVDYDGDSYMN

SEQ ID NO: 32372 - protein, 7 aa, Artificial Sequence
  Description of Artificial Sequence: Synthetic peptide
  XENP022391 vlCDR2
AASELES

SEQ ID NO: 32373 - protein, 9 aa, Artificial Sequence
  Description of Artificial Sequence: Synthetic peptide
  XENP022391 vlCDR3
QQSNEDPFT

SEQ ID NO: 32374 - protein, 226 aa, Artificial Sequence
  Description of Artificial Sequence: Synthetic polypeptide
  XENP022392 7G8_H3.42_L1.11_Fab Heavy Chain
EVQLVESGGGLVQPGGSLRLSCAASGFTFDDAWMDWVRQAPGKGLEWVAEISTKANNHATYYAESVKGRFTISRDRSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32375 - protein, 121 aa, Artificial Sequence
  Description of Artificial Sequence: Synthetic polypeptide
  VH of XENP022392
EVQLVESGGGLVQPGGSLRLSCAASGFTFDDAWMDWVRQAPGKGLEWVAEISTKANNHATYYAESVKGRFTISRDRSKSSVYLQMNSLRAEDTAVYYCTRLATWDWYFDVWGQGTTVTVSS

SEQ ID NO: 32376 - protein, 5 aa, Artificial Sequence
  Description of Artificial Sequence: Synthetic peptide
  XENP022392 vhCDR1
DAWMD

SEQ ID NO: 32377 - protein, 19 aa, Artificial Sequence
  Description of Artificial Sequence: Synthetic peptide
  XENP022392 vhCDR2
EISTKANNHATYYAESVKG

SEQ ID NO: 32378 - protein, 10 aa, Artificial Sequence
  Description of Artificial Sequence: Synthetic peptide
  XENP022392 vhCDR3
LATWDWYFDV

SEQ ID NO: 32379 - protein, 218 aa, Artificial Sequence; identical to SEQ ID NO: 22359
  Description of Artificial Sequence: Synthetic polypeptide
  XENP022392 7G8_H3.42_L1.11_Fab Light Chain

SEQ ID NO: 32380 - protein, 111 aa, Artificial Sequence; identical to SEQ ID NO: 22360
  Description of Artificial Sequence: Synthetic polypeptide
  VL of XENP022392

SEQ ID NO: 32381 - protein, 15 aa, Artificial Sequence
  Description of Artificial Sequence: Synthetic peptide
  XENP022392 vlCDR1
RASQSVDYDGDSYMN

SEQ ID NO: 32382 - protein, 7 aa, Artificial Sequence
  Description of Artificial Sequence: Synthetic peptide
  XENP022392 vlCDR2
AASELES

SEQ ID NO: 32383 - protein, 9 aa, Artificial Sequence
  Description of Artificial Sequence: Synthetic peptide
  XENP022392 vlCDR3
QQSNEDPFT

SEQ ID NO: 32384 - protein, 226 aa, Artificial Sequence
  Description of Artificial Sequence: Synthetic polypeptide
  XENP022393 7G8_H3.43_L1.11_Fab Heavy Chain
EVQLVESGGGLVQPGGSLRLSCAASGFTFDDAWMDWVRQAPGKGLEWVAEISTKANNHATYYAESVKGRFTISRDMSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32385 - protein, 121 aa, Artificial Sequence
  Description of Artificial Sequence: Synthetic polypeptide
  VH of XENP022393
EVQLVESGGGLVQPGGSLRLSCAASGFTFDDAWMDWVRQAPGKGLEWVAEISTKANNHATYYAESVKGRFTISRDMSKSSVYLQMNSLRAEDTAVYYCTRLATWDWYFDVWGQGTTVTVSS

SEQ ID NO: 32386 - protein, 5 aa, Artificial Sequence
  Description of Artificial Sequence: Synthetic peptide
  XENP022393 vhCDR1
DAWMD

SEQ ID NO: 32387 - protein, 19 aa, Artificial Sequence
  Description of Artificial Sequence: Synthetic peptide
  XENP022393 vhCDR2
EISTKANNHATYYAESVKG

SEQ ID NO: 32388 - protein, 10 aa, Artificial Sequence
  Description of Artificial Sequence: Synthetic peptide
  XENP022393 vhCDR3
LATWDWYFDV

SEQ ID NO: 32389 - protein, 218 aa, Artificial Sequence; identical to SEQ ID NO: 22359
  Description of Artificial Sequence: Synthetic polypeptide
  XENP022393 7G8_H3.43_L1.11_Fab Light Chain

SEQ ID NO: 32390 - protein, 111 aa, Artificial Sequence; identical to SEQ ID NO: 22360
  Description of Artificial Sequence: Synthetic polypeptide
  VL of XENP022393

SEQ ID NO: 32391 - protein, 15 aa, Artificial Sequence
  Description of Artificial Sequence: Synthetic peptide
  XENP022393 vlCDR1
RASQSVDYDGDSYMN

SEQ ID NO: 32392 - protein, 7 aa, Artificial Sequence
  Description of Artificial Sequence: Synthetic peptide
  XENP022393 vlCDR2
AASELES

SEQ ID NO: 32393 - protein, 9 aa, Artificial Sequence
  Description of Artificial Sequence: Synthetic peptide
  XENP022393 vlCDR3
QQSNEDPFT

SEQ ID NO: 32394 - protein, 226 aa, Artificial Sequence
  Description of Artificial Sequence: Synthetic polypeptide
  XENP022394 7G8_H3.44_L1.11_Fab Heavy Chain
EVQLVESGGGLVQPGGSLRLSCAASGFTFDDAWMDWVRQAPGKGLEWVAEISTKANNHATYYAESVKGRFTISRDESKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32395 - protein, 121 aa, Artificial Sequence
  Description of Artificial Sequence: Synthetic polypeptide
  VH of XENP022394
EVQLVESGGGLVQPGGSLRLSCAASGFTFDDAWMDWVRQAPGKGLEWVAEISTKANNHATYYAESVKGRFTISRDESKSSVYLQMNSLRAEDTAVYYCTRLATWDWYFDVWGQGTTVTVSS

SEQ ID NO: 32396 - protein, 5 aa, Artificial Sequence
  Description of Artificial Sequence: Synthetic peptide
  XENP022394 vhCDR1
DAWMD

SEQ ID NO: 32397 - protein, 19 aa, Artificial Sequence
  Description of Artificial Sequence: Synthetic peptide
  XENP022394 vhCDR2
EISTKANNHATYYAESVKG

SEQ ID NO: 32398 - protein, 10 aa, Artificial Sequence
  Description of Artificial Sequence: Synthetic peptide
  XENP022394 vhCDR3
LATWDWYFDV

SEQ ID NO: 32399 - protein, 218 aa, Artificial Sequence; identical to SEQ ID NO: 22359
  Description of Artificial Sequence: Synthetic polypeptide
  XENP022394 7G8_H3.44_L1.11_Fab Light Chain

SEQ ID NO: 32400 - protein, 111 aa, Artificial Sequence; identical to SEQ ID NO: 22360
  Description of Artificial Sequence: Synthetic polypeptide
  VL of XENP022394

SEQ ID NO: 32401 - protein, 15 aa, Artificial Sequence
  Description of Artificial Sequence: Synthetic peptide
  XENP022394 vlCDR1
RASQSVDYDGDSYMN

SEQ ID NO: 32402 - protein, 7 aa, Artificial Sequence
  Description of Artificial Sequence: Synthetic peptide
  XENP022394 vlCDR2
AASELES

SEQ ID NO: 32403 - protein, 9 aa, Artificial Sequence
  Description of Artificial Sequence: Synthetic peptide
  XENP022394 vlCDR3
QQSNEDPFT

SEQ ID NO: 32404 - protein, 226 aa, Artificial Sequence
  Description of Artificial Sequence: Synthetic polypeptide
  XENP022395 7G8_H3.45_L1.11_Fab Heavy Chain
EVQLVESGGGLVQPGGSLRLSCAASGFTFDDAWMDWVRQAPGKGLEWVAEISTKANNHATYYAESVKGRFTISRDNSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32405 - protein, 121 aa, Artificial Sequence
  Description of Artificial Sequence: Synthetic polypeptide
  VH of XENP022395
EVQLVESGGGLVQPGGSLRLSCAASGFTFDDAWMDWVRQAPGKGLEWVAEISTKANNHATYYAESVKGRFTISRDNSKSSVYLQMNSLRAEDTAVYYCTRLATWDWYFDVWGQGTTVTVSS

SEQ ID NO: 32406 - protein, 5 aa, Artificial Sequence
  Description of Artificial Sequence: Synthetic peptide
  XENP022395 vhCDR1
DAWMD

SEQ ID NO: 32407 - protein, 19 aa, Artificial Sequence
  Description of Artificial Sequence: Synthetic peptide
  XENP022395 vhCDR2
EISTKANNHATYYAESVKG

SEQ ID NO: 32408 - protein, 10 aa, Artificial Sequence
  Description of Artificial Sequence: Synthetic peptide
  XENP022395 vhCDR3
LATWDWYFDV

SEQ ID NO: 32409 - protein, 218 aa, Artificial Sequence; identical to SEQ ID NO: 22359
  Description of Artificial Sequence: Synthetic polypeptide
  XENP022395 7G8_H3.45_L1.11_Fab Light Chain

SEQ ID NO: 32410 - protein, 111 aa, Artificial Sequence; identical to SEQ ID NO: 22360
  Description of Artificial Sequence: Synthetic polypeptide
  VL of XENP022395

SEQ ID NO: 32411 - protein, 15 aa, Artificial Sequence
  Description of Artificial Sequence: Synthetic peptide
  XENP022395 vlCDR1
RASQSVDYDGDSYMN

SEQ ID NO: 32412 - protein, 7 aa, Artificial Sequence
  Description of Artificial Sequence: Synthetic peptide
  XENP022395 vlCDR2
AASELES

SEQ ID NO: 32413 - protein, 9 aa, Artificial Sequence
  Description of Artificial Sequence: Synthetic peptide
  XENP022395 vlCDR3
QQSNEDPFT

SEQ ID NO: 32414 - protein, 226 aa, Artificial Sequence
  Description of Artificial Sequence: Synthetic polypeptide
  XENP022396 7G8_H3.46_L1.11_Fab Heavy Chain
EVQLVESGGGLVQPGGSLRLSCAASGFTFDDAWMDWVRQAPGKGLEWVAEISTKANNHATYYAESVKGRFTISRDKSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32415 - protein, 121 aa, Artificial Sequence
  Description of Artificial Sequence: Synthetic polypeptide
  VH of XENP022396
EVQLVESGGGLVQPGGSLRLSCAASGFTFDDAWMDWVRQAPGKGLEWVAEISTKANNHATYYAESVKGRFTISRDKSKSSVYLQMNSLRAEDTAVYYCTRLATWDWYFDVWGQGTTVTVSS

SEQ ID NO: 32416 - protein, 5 aa, Artificial Sequence
  Description of Artificial Sequence: Synthetic peptide
  XENP022396 vhCDR1
DAWMD

SEQ ID NO: 32417 - protein, 19 aa, Artificial Sequence
  Description of Artificial Sequence: Synthetic peptide
  XENP022396 vhCDR2
EISTKANNHATYYAESVKG

SEQ ID NO: 32418 - protein, 10 aa, Artificial Sequence
  Description of Artificial Sequence: Synthetic peptide
  XENP022396 vhCDR3
LATWDWYFDV

SEQ ID NO: 32419 - protein, 218 aa, Artificial Sequence; identical to SEQ ID NO: 22359
  Description of Artificial Sequence: Synthetic polypeptide
  XENP022396 7G8_H3.46_L1.11_Fab Light Chain

SEQ ID NO: 32420 - protein, 111 aa, Artificial Sequence; identical to SEQ ID NO: 22360
  Description of Artificial Sequence: Synthetic polypeptide
  VL of XENP022396

SEQ ID NO: 32421 - protein, 15 aa, Artificial Sequence
  Description of Artificial Sequence: Synthetic peptide
  XENP022396 vlCDR1
RASQSVDYDGDSYMN

SEQ ID NO: 32422 - protein, 7 aa, Artificial Sequence
  Description of Artificial Sequence: Synthetic peptide
  XENP022396 vlCDR2
AASELES

SEQ ID NO: 32423 - protein, 9 aa, Artificial Sequence
  Description of Artificial Sequence: Synthetic peptide
  XENP022396 vlCDR3
QQSNEDPFT

SEQ ID NO: 32424 - protein, 226 aa, Artificial Sequence
  Description of Artificial Sequence: Synthetic polypeptide
  XENP022401 7G8_H3.47_L1.11_Fab Heavy Chain
EVQLVESGGGLVQPGGSLRLSCAASGFTFDDAWMDWVRQAPGKGLEWVAEISTKANNHATYYAESVKGRFTISRDDSKSTVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32425 - protein, 121 aa, Artificial Sequence
  Description of Artificial Sequence: Synthetic polypeptide
  VH of XENP022401
EVQLVESGGGLVQPGGSLRLSCAASGFTFDDAWMDWVRQAPGKGLEWVAEISTKANNHATYYAESVKGRFTISRDDSKSTVYLQMNSLRAEDTAVYYCTRLATWDWYFDVWGQGTTVTVSS

SEQ ID NO: 32426 - protein, 5 aa, Artificial Sequence
  Description of Artificial Sequence: Synthetic peptide
  XENP022401 vhCDR1
DAWMD

SEQ ID NO: 32427 - protein, 19 aa, Artificial Sequence
  Description of Artificial Sequence: Synthetic peptide
  XENP022401 vhCDR2
EISTKANNHATYYAESVKG

SEQ ID NO: 32428 - protein, 10 aa, Artificial Sequence
  Description of Artificial Sequence: Synthetic peptide
  XENP022401 vhCDR3
LATWDWYFDV

SEQ ID NO: 32429 - protein, 218 aa, Artificial Sequence; identical to SEQ ID NO: 22359
  Description of Artificial Sequence: Synthetic polypeptide
  XENP022401 7G8_H3.47_L1.11_Fab Light Chain

SEQ ID NO: 32430 - protein, 111 aa, Artificial Sequence; identical to SEQ ID NO: 22360
  Description of Artificial Sequence: Synthetic polypeptide
  VL of XENP022401

SEQ ID NO: 32431 - protein, 15 aa, Artificial Sequence
  Description of Artificial Sequence: Synthetic peptide
  XENP022401 vlCDR1
RASQSVDYDGDSYMN

SEQ ID NO: 32432 - protein, 7 aa, Artificial Sequence
  Description of Artificial Sequence: Synthetic peptide
  XENP022401 vlCDR2
AASELES

SEQ ID NO: 32433 - protein, 9 aa, Artificial Sequence
  Description of Artificial Sequence: Synthetic peptide
  XENP022401 vlCDR3
QQSNEDPFT

SEQ ID NO: 32434 - protein, 226 aa, Artificial Sequence
  Description of Artificial Sequence: Synthetic polypeptide
  XENP022402 7G8_H3.48_L1.11_Fab Heavy Chain
EVQLVESGGGLVQPGGSLRLSCAASGFTFDDAWMDWVRQAPGKGLEWVAEISTKANNHATYYAESVKGRFTISRDDSKSQVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32435 - protein, 121 aa, Artificial Sequence
  Description of Artificial Sequence: Synthetic polypeptide
  VH of XENP022402
EVQLVESGGGLVQPGGSLRLSCAASGFTFDDAWMDWVRQAPGKGLEWVAEISTKANNHATYYAESVKGRFTISRDDSKSQVYLQMNSLRAEDTAVYYCTRLATWDWYFDVWGQGTTVTVSS

SEQ ID NO: 32436 - protein, 5 aa, Artificial Sequence
  Description of Artificial Sequence: Synthetic peptide
  XENP022402 vhCDR1
DAWMD

SEQ ID NO: 32437 - protein, 19 aa, Artificial Sequence
  Description of Artificial Sequence: Synthetic peptide
  XENP022402 vhCDR2
EISTKANNHATYYAESVKG

SEQ ID NO: 32438 - protein, 10 aa, Artificial Sequence
  Description of Artificial Sequence: Synthetic peptide
  XENP022402 vhCDR3
LATWDWYFDV

SEQ ID NO: 32439 - protein, 218 aa, Artificial Sequence; identical to SEQ ID NO: 22359
  Description of Artificial Sequence: Synthetic polypeptide
  XENP022402 7G8_H3.48_L1.11_Fab Light Chain

SEQ ID NO: 32440 - protein, 111 aa, Artificial Sequence; identical to SEQ ID NO: 22360
  Description of Artificial Sequence: Synthetic polypeptide
  VL of XENP022402

SEQ ID NO: 32441 - protein, 15 aa, Artificial Sequence
  Description of Artificial Sequence: Synthetic peptide
  XENP022402 vlCDR1
RASQSVDYDGDSYMN

SEQ ID NO: 32442 - protein, 7 aa, Artificial Sequence
  Description of Artificial Sequence: Synthetic peptide
  XENP022402 vlCDR2
AASELES

SEQ ID NO: 32443 - protein, 9 aa, Artificial Sequence
  Description of Artificial Sequence: Synthetic peptide
  XENP022402 vlCDR3
QQSNEDPFT

SEQ ID NO: 32444 - protein, 226 aa, Artificial Sequence
  Description of Artificial Sequence: Synthetic polypeptide
  XENP022403 7G8_H3.49_L1.11_Fab Heavy Chain
EVQLVESGGGLVQPGGSLRLSCAASGFTFDDAWMDWVRQAPGKGLEWVAEISTKANNHATYYAESVKGRFTISRDDSKSIVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32445 - protein, 121 aa, Artificial Sequence
  Description of Artificial Sequence: Synthetic polypeptide
  VH of XENP022403
EVQLVESGGGLVQPGGSLRLSCAASGFTFDDAWMDWVRQAPGKGLEWVAEISTKANNHATYYAESVKGRFTISRDDSKSIVYLQMNSLRAEDTAVYYCTRLATWDWYFDVWGQGTTVTVSS

SEQ ID NO: 32446 - protein, 5 aa, Artificial Sequence
  Description of Artificial Sequence: Synthetic peptide
  XENP022403 vhCDR1
DAWMD

SEQ ID NO: 32447 - protein, 19 aa, Artificial Sequence
  Description of Artificial Sequence: Synthetic peptide
  XENP022403 vhCDR2
EISTKANNHATYYAESVKG

SEQ ID NO: 32448 - protein, 10 aa, Artificial Sequence
  Description of Artificial Sequence: Synthetic peptide
  XENP022403 vhCDR3
LATWDWYFDV

SEQ ID NO: 32449 - protein, 218 aa, Artificial Sequence; identical to SEQ ID NO: 22359
  Description of Artificial Sequence: Synthetic polypeptide
  XENP022403 7G8_H3.49_L1.11_Fab Light Chain

SEQ ID NO: 32450 - protein, 111 aa, Artificial Sequence; identical to SEQ ID NO: 22360
  Description of Artificial Sequence: Synthetic polypeptide
  VL of XENP022403

SEQ ID NO: 32451 - protein, 15 aa, Artificial Sequence
  Description of Artificial Sequence: Synthetic peptide
  XENP022403 vlCDR1
RASQSVDYDGDSYMN

SEQ ID NO: 32452 - protein, 7 aa, Artificial Sequence
  Description of Artificial Sequence: Synthetic peptide
  XENP022403 vlCDR2
AASELES

SEQ ID NO: 32453 - protein, 9 aa, Artificial Sequence
  Description of Artificial Sequence: Synthetic peptide
  XENP022403 vlCDR3
QQSNEDPFT

SEQ ID NO: 32454 - protein, 226 aa, Artificial Sequence
  Description of Artificial Sequence: Synthetic polypeptide
  XENP022404 7G8_H3.50_L1.11_Fab Heavy Chain
EVQLVESGGGLVQPGGSLRLSCAASGFTFDDAWMDWVRQAPGKGLEWVAEISTKANNHATYYAESVKGRFTISRDDSKSSAYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32455 - protein, 121 aa, Artificial Sequence
  Description of Artificial Sequence: Synthetic polypeptide
  VH of XENP022404
EVQLVESGGGLVQPGGSLRLSCAASGFTFDDAWMDWVRQAPGKGLEWVAEISTKANNHATYYAESVKGRFTISRDDSKSSAYLQMNSLRAEDTAVYYCTRLATWDWYFDVWGQGTTVTVSS

SEQ ID NO: 32456 - protein, 5 aa, Artificial Sequence
  Description of Artificial Sequence: Synthetic peptide
  XENP022404 vhCDR1
DAWMD

SEQ ID NO: 32457 - protein, 19 aa, Artificial Sequence
  Description of Artificial Sequence: Synthetic peptide
  XENP022404 vhCDR2
EISTKANNHATYYAESVKG

SEQ ID NO: 32458 - protein, 10 aa, Artificial Sequence
  Description of Artificial Sequence: Synthetic peptide
  XENP022404 vhCDR3
LATWDWYFDV

SEQ ID NO: 32459 - protein, 218 aa, Artificial Sequence; identical to SEQ ID NO: 22359
  Description of Artificial Sequence: Synthetic polypeptide
  XENP022404 7G8_H3.50_L1.11_Fab Light Chain

SEQ ID NO: 32460 - protein, 111 aa, Artificial Sequence; identical to SEQ ID NO: 22360
  Description of Artificial Sequence: Synthetic polypeptide
  VL of XENP022404

SEQ ID NO: 32461 - protein, 15 aa, Artificial Sequence
  Description of Artificial Sequence: Synthetic peptide
  XENP022404 vlCDR1
RASQSVDYDGDSYMN

SEQ ID NO: 32462 - protein, 7 aa, Artificial Sequence
  Description of Artificial Sequence: Synthetic peptide
  XENP022404 vlCDR2
AASELES

SEQ ID NO: 32463 - protein, 9 aa, Artificial Sequence
  Description of Artificial Sequence: Synthetic peptide
  XENP022404 vlCDR3
QQSNEDPFT

SEQ ID NO: 32464 - protein, 226 aa, Artificial Sequence
  Description of Artificial Sequence: Synthetic polypeptide
  XENP022405 7G8_H3.51_L1.11_Fab Heavy Chain
EVQLVESGGGLVQPGGSLRLSCAASGFTFDDAWMDWVRQAPGKGLEWVAEISTKANNHATYYAESVKGRFTISRDDSKSSLYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32465 - protein, 121 aa, Artificial Sequence
  Description of Artificial Sequence: Synthetic polypeptide
  VH of XENP022405
EVQLVESGGGLVQPGGSLRLSCAASGFTFDDAWMDWVRQAPGKGLEWVAEISTKANNHATYYAESVKGRFTISRDDSKSSLYLQMNSLRAEDTAVYYCTRLATWDWYFDVWGQGTTVTVSS

SEQ ID NO: 32466 - protein, 5 aa, Artificial Sequence
  Description of Artificial Sequence: Synthetic peptide
  XENP022405 vhCDR1
DAWMD

SEQ ID NO: 32467 - protein, 19 aa, Artificial Sequence
  Description of Artificial Sequence: Synthetic peptide
  XENP022405 vhCDR2
EISTKANNHATYYAESVKG

SEQ ID NO: 32468 - protein, 10 aa, Artificial Sequence
  Description of Artificial Sequence: Synthetic peptide
  XENP022405 vhCDR3
LATWDWYFDV

SEQ ID NO: 32469 - protein, 218 aa, Artificial Sequence; identical to SEQ ID NO: 22359
  Description of Artificial Sequence: Synthetic polypeptide
  XENP022405 7G8_H3.51_L1.11_Fab Light Chain

SEQ ID NO: 32470 - protein, 111 aa, Artificial Sequence; identical to SEQ ID NO: 22360
  Description of Artificial Sequence: Synthetic polypeptide
  VL of XENP022405

SEQ ID NO: 32471 - protein, 15 aa, Artificial Sequence
  Description of Artificial Sequence: Synthetic peptide
  XENP022405 vlCDR1
RASQSVDYDGDSYMN

SEQ ID NO: 32472 - protein, 7 aa, Artificial Sequence
  Description of Artificial Sequence: Synthetic peptide
  XENP022405 vlCDR2
AASELES

SEQ ID NO: 32473 - protein, 9 aa, Artificial Sequence
  Description of Artificial Sequence: Synthetic peptide
  XENP022405 vlCDR3
QQSNEDPFT

SEQ ID NO: 32474 - protein, 226 aa, Artificial Sequence
  Description of Artificial Sequence: Synthetic polypeptide
  XENP022406 7G8_H3.52_L1.11_Fab Heavy Chain
EVQLVESGGGLVQPGGSLRLSCAASGFTFDDAWMDWVRQAPGKGLEWVAEISTKANNHATYYAESVKGRFTISRDDSKSSFYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32475 - protein, 121 aa, Artificial Sequence
  Description of Artificial Sequence: Synthetic polypeptide
  VH of XENP022406
EVQLVESGGGLVQPGGSLRLSCAASGFTFDDAWMDWVRQAPGKGLEWVAEISTKANNHATYYAESVKGRFTISRDDSKSSFYLQMNSLRAEDTAVYYCTRLATWDWYFDVWGQGTTVTVSS

SEQ ID NO: 32476 - protein, 5 aa, Artificial Sequence
  Description of Artificial Sequence: Synthetic peptide
  XENP022406 vhCDR1
DAWMD

SEQ ID NO: 32477 - protein, 19 aa, Artificial Sequence
  Description of Artificial Sequence: Synthetic peptide
  XENP022406 vhCDR2
EISTKANNHATYYAESVKG

SEQ ID NO: 32478 - protein, 10 aa, Artificial Sequence
  Description of Artificial Sequence: Synthetic peptide
  XENP022406 vhCDR3
LATWDWYFDV

SEQ ID NO: 32479 - protein, 218 aa, Artificial Sequence; identical to SEQ ID NO: 22359
  Description of Artificial Sequence: Synthetic polypeptide
  XENP022406 7G8_H3.52_L1.11_Fab Light Chain

SEQ ID NO: 32480 - protein, 111 aa, Artificial Sequence; identical to SEQ ID NO: 22360
  Description of Artificial Sequence: Synthetic polypeptide
  VL of XENP022406

SEQ ID NO: 32481 - protein, 15 aa, Artificial Sequence
  Description of Artificial Sequence: Synthetic peptide
  XENP022406 vlCDR1
RASQSVDYDGDSYMN

SEQ ID NO: 32482 - protein, 7 aa, Artificial Sequence
  Description of Artificial Sequence: Synthetic peptide
  XENP022406 vlCDR2
AASELES

SEQ ID NO: 32483 - protein, 9 aa, Artificial Sequence
  Description of Artificial Sequence: Synthetic peptide
  XENP022406 vlCDR3
QQSNEDPFT

SEQ ID NO: 32484 - protein, 226 aa, Artificial Sequence
  Description of Artificial Sequence: Synthetic polypeptide
  XENP022407 7G8_H3.53_L1.11_Fab Heavy Chain
EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCARLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32485 - protein, 121 aa, Artificial Sequence
  Description of Artificial Sequence: Synthetic polypeptide
  VH of XENP022407
EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCARLATWDWYFDVWGQGTTVTVSS

SEQ ID NO: 32486 - protein, 5 aa, Artificial Sequence
  Description of Artificial Sequence: Synthetic peptide
  XENP022407 vhCDR1
DAWMD

SEQ ID NO: 32487 - protein, 19 aa, Artificial Sequence
  Description of Artificial Sequence: Synthetic peptide
  XENP022407 vhCDR2
EISTKANNHATYYAESVKG

SEQ ID NO: 32488 - protein, 10 aa, Artificial Sequence
  Description of Artificial Sequence: Synthetic peptide
  XENP022407 vhCDR3
LATWDWYFDV

SEQ ID NO: 32489 - protein, 218 aa, Artificial Sequence; identical to SEQ ID NO: 22359
  Description of Artificial Sequence: Synthetic polypeptide
  XENP022407 7G8_H3.53_L1.11_Fab Light Chain

SEQ ID NO: 32490 - protein, 111 aa, Artificial Sequence; identical to SEQ ID NO: 22360
  Description of Artificial Sequence: Synthetic polypeptide
  VL of XENP022407

SEQ ID NO: 32491 - protein, 15 aa, Artificial Sequence
  Description of Artificial Sequence: Synthetic peptide
  XENP022407 vlCDR1
RASQSVDYDGDSYMN

SEQ ID NO: 32492 - protein, 7 aa, Artificial Sequence
  Description of Artificial Sequence: Synthetic peptide
  XENP022407 vlCDR2
AASELES

SEQ ID NO: 32493 - protein, 9 aa, Artificial Sequence
  Description of Artificial Sequence: Synthetic peptide
  XENP022407 vlCDR3
QQSNEDPFT

SEQ ID NO: 32494 - protein, 226 aa, Artificial Sequence; identical to SEQ ID NO: 31734
  Description of Artificial Sequence: Synthetic polypeptide
  XENP022408 7G8_H3.18_L1.16_Fab Heavy Chain

SEQ ID NO: 32495 - protein, 121 aa, Artificial Sequence; identical to SEQ ID NO: 22325
  Description of Artificial Sequence: Synthetic polypeptide
  VH of XENP022408

SEQ ID NO: 32496 - protein, 5 aa, Artificial Sequence
  Description of Artificial Sequence: Synthetic peptide
  XENP022408 vhCDR1
DAWMD

SEQ ID NO: 32497 - protein, 19 aa, Artificial Sequence
  Description of Artificial Sequence: Synthetic peptide
  XENP022408 vhCDR2
EISTKANNHATYYAESVKG

SEQ ID NO: 32498 - protein, 10 aa, Artificial Sequence
  Description of Artificial Sequence: Synthetic peptide
  XENP022408 vhCDR3
LATWDWYFDV

SEQ ID NO: 32499 - protein, 218 aa, Artificial Sequence
  Description of Artificial Sequence: Synthetic polypeptide
  XENP022408 7G8_H3.18_L1.16_Fab Light Chain
DIVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32500 - protein, 111 aa, Artificial Sequence
  Description of Artificial Sequence: Synthetic polypeptide
  VL of XENP022408
DIVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK

SEQ ID NO: 32501 - protein, 15 aa, Artificial Sequence
  Description of Artificial Sequence: Synthetic peptide
  XENP022408 vlCDR1
RASQSVDYDGDSYMN

SEQ ID NO: 32502 - protein, 7 aa, Artificial Sequence
  Description of Artificial Sequence: Synthetic peptide
  XENP022408 vlCDR2
AASELES

SEQ ID NO: 32503 - protein, 9 aa, Artificial Sequence
  Description of Artificial Sequence: Synthetic peptide
  XENP022408 vlCDR3
QQSNEDPFT

SEQ ID NO: 32504 - protein, 226 aa, Artificial Sequence; identical to SEQ ID NO: 31734
  Description of Artificial Sequence: Synthetic polypeptide
  XENP022409 7G8_H3.18_L1.17_Fab Heavy Chain

SEQ ID NO: 32505 - protein, 121 aa, Artificial Sequence; identical to SEQ ID NO: 22325
  Description of Artificial Sequence: Synthetic polypeptide
  VH of XENP022409

SEQ ID NO: 32506 - protein, 5 aa, Artificial Sequence
  Description of Artificial Sequence: Synthetic peptide
  XENP022409 vhCDR1
DAWMD

SEQ ID NO: 32507 - protein, 19 aa, Artificial Sequence
  Description of Artificial Sequence: Synthetic peptide
  XENP022409 vhCDR2
EISTKANNHATYYAESVKG

SEQ ID NO: 32508 - protein, 10 aa, Artificial Sequence
  Description of Artificial Sequence: Synthetic peptide
  XENP022409 vhCDR3
LATWDWYFDV

SEQ ID NO: 32509 - protein, 218 aa, Artificial Sequence
  Description of Artificial Sequence: Synthetic polypeptide
  XENP022409 7G8_H3.18_L1.17_Fab Light Chain
DVVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32510 - protein, 111 aa, Artificial Sequence
  Description of Artificial Sequence: Synthetic polypeptide
  VL of XENP022409
DVVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK

SEQ ID NO: 32511 - protein, 15 aa, Artificial Sequence
  Description of Artificial Sequence: Synthetic peptide
  XENP022409 vlCDR1
RASQSVDYDGDSYMN

SEQ ID NO: 32512 - protein, 7 aa, Artificial Sequence
  Description of Artificial Sequence: Synthetic peptide
  XENP022409 vlCDR2
AASELES

SEQ ID NO: 32513 - protein, 9 aa, Artificial Sequence
  Description of Artificial Sequence: Synthetic peptide
  XENP022409 vlCDR3
QQSNEDPFT

SEQ ID NO: 32514 - protein, 226 aa, Artificial Sequence; identical to SEQ ID NO: 31734
  Description of Artificial Sequence: Synthetic polypeptide
  XENP022410 7G8_H3.18_L1.18_Fab Heavy Chain

SEQ ID NO: 32515 - protein, 121 aa, Artificial Sequence; identical to SEQ ID NO: 22325
  Description of Artificial Sequence: Synthetic polypeptide
  VH of XENP022410

SEQ ID NO: 32516 - protein, 5 aa, Artificial Sequence
  Description of Artificial Sequence: Synthetic peptide
  XENP022410 vhCDR1
DAWMD

SEQ ID NO: 32517 - protein, 19 aa, Artificial Sequence
  Description of Artificial Sequence: Synthetic peptide
  XENP022410 vhCDR2
EISTKANNHATYYAESVKG

SEQ ID NO: 32518 - protein, 10 aa, Artificial Sequence
  Description of Artificial Sequence: Synthetic peptide
  XENP022410 vhCDR3
LATWDWYFDV

SEQ ID NO: 32519 - protein, 218 aa, Artificial Sequence
  Description of Artificial Sequence: Synthetic polypeptide
  XENP022410 7G8_H3.18_L1.18_Fab Light Chain
DTVMTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32520 - protein, 111 aa, Artificial Sequence
  Description of Artificial Sequence: Synthetic polypeptide
  VL of XENP022410
DTVMTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK

SEQ ID NO: 32521 - protein, 15 aa, Artificial Sequence
  Description of Artificial Sequence: Synthetic peptide
  XENP022410 vlCDR1
RASQSVDYDGDSYMN

SEQ ID NO: 32522 - protein, 7 aa, Artificial Sequence
  Description of Artificial Sequence: Synthetic peptide
  XENP022410 vlCDR2
AASELES

SEQ ID NO: 32523 - protein, 9 aa, Artificial Sequence
  Description of Artificial Sequence: Synthetic peptide
  XENP022410 vlCDR3
QQSNEDPFT

SEQ ID NO: 32524 - protein, 226 aa, Artificial Sequence; identical to SEQ ID NO: 31734
  Description of Artificial Sequence: Synthetic polypeptide
  XENP022411 7G8_H3.18_L1.19_Fab Heavy Chain

SEQ ID NO: 32525 - protein, 121 aa, Artificial Sequence; identical to SEQ ID NO: 22325
  Description of Artificial Sequence: Synthetic polypeptide
  VH of XENP022411

SEQ ID NO: 32526 - protein, 5 aa, Artificial Sequence
  Description of Artificial Sequence: Synthetic peptide
  XENP022411 vhCDR1
DAWMD

SEQ ID NO: 32527 - protein, 19 aa, Artificial Sequence
  Description of Artificial Sequence: Synthetic peptide
  XENP022411 vhCDR2
EISTKANNHATYYAESVKG

SEQ ID NO: 32528 - protein, 10 aa, Artificial Sequence
  Description of Artificial Sequence: Synthetic peptide
  XENP022411 vhCDR3
LATWDWYFDV

SEQ ID NO: 32529 - protein, 218 aa, Artificial Sequence
  Description of Artificial Sequence: Synthetic polypeptide
  XENP022411 7G8_H3.18_L1.19_Fab Light Chain
DTVLTQSPSSLSASVGDRVTITCRASQSVDYDGDSYLNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32530 - protein, 111 aa, Artificial Sequence
  Description of Artificial Sequence: Synthetic polypeptide
  VL of XENP022411
DTVLTQSPSSLSASVGDRVTITCRASQSVDYDGDSYLNWYQQKPGKPPKLLIYAASELESGIPARLSGSGSGTDFTLTISSLQPEDFATYYCQQSNEDPFTFGSGTKLEIK

SEQ ID NO: 32531 - protein, 15 aa, Artificial Sequence
  Description of Artificial Sequence: Synthetic peptide
  XENP022411 vlCDR1
RASQSVDYDGDSYLN

SEQ ID NO: 32532 - protein, 7 aa, Artificial Sequence
  Description of Artificial Sequence: Synthetic peptide
  XENP022411 vlCDR2
AASELES

SEQ ID NO: 32533 - protein, 9 aa, Artificial Sequence
  Description of Artificial Sequence: Synthetic peptide
  XENP022411 vlCDR3
QQSNEDPFT

SEQ ID NO: 32534 - protein, 226 aa, Artificial Sequence; identical to SEQ ID NO: 31734
  Description of Artificial Sequence: Synthetic polypeptide
  XENP022412 7G8_H3.18_L1.20_Fab Heavy Chain

SEQ ID NO: 32535 - protein, 121 aa, Artificial Sequence; identical to SEQ ID NO: 22325
  Description of Artificial Sequence: Synthetic polypeptide
  VH of XENP022412

SEQ ID NO: 32536 - protein, 5 aa, Artificial Sequence
  Description of Artificial Sequence: Synthetic peptide
  XENP022412 vhCDR1
DAWMD

SEQ ID NO: 32537 - protein, 19 aa, Artificial Sequence
  Description of Artificial Sequence: Synthetic peptide
  XENP022412 vhCDR2
EISTKANNHATYYAESVKG

SEQ ID NO: 32538 - protein, 10 aa, Artificial Sequence
  Description of Artificial Sequence: Synthetic peptide
  XENP022412 vhCDR3
LATWDWYFDV

SEQ ID NO: 32539 - protein, 218 aa, Artificial Sequence
  Description of Artificial Sequence: Synthetic polypeptide
  XENP022412 7G8_H3.18_L1.20_Fab Light Chain
DTVLTQSPSSLSASVGDRVTITCRASQSVDYDGDSYMNWYQQKPGQPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32540 - protein, 111 aa, Artificial Sequence
  Description of Artificial Sequence: Synthetic polypeptide
  VL of XENP022412
DTVLTQSPSSLSASVGDRVTITCRASQSVDYDGDSYMNWYQQKPGQPPKLLIYAASELESGIPARLSGSGSGTDFTLTISSLQPEDFATYYCQQSNEDPFTFGSGTKLEIK

SEQ ID NO: 32541 - protein, 15 aa, Artificial Sequence
  Description of Artificial Sequence: Synthetic peptide
  XENP022412 vlCDR1
RASQSVDYDGDSYMN

SEQ ID NO: 32542 - protein, 7 aa, Artificial Sequence
  Description of Artificial Sequence: Synthetic peptide
  XENP022412 vlCDR2
AASELES

SEQ ID NO: 32543 - protein, 9 aa, Artificial Sequence
  Description of Artificial Sequence: Synthetic peptide
  XENP022412 vlCDR3
QQSNEDPFT

SEQ ID NO: 32544 - protein, 226 aa, Artificial Sequence; identical to SEQ ID NO: 31734
  Description of Artificial Sequence: Synthetic polypeptide
  XENP022413 7G8_H3.18_L1.21_Fab Heavy Chain

SEQ ID NO: 32545 - protein, 121 aa, Artificial Sequence; identical to SEQ ID NO: 22325
  Description of Artificial Sequence: Synthetic polypeptide
  VH of XENP022413

SEQ ID NO: 32546 - protein, 5 aa, Artificial Sequence
  Description of Artificial Sequence: Synthetic peptide
  XENP022413 vhCDR1
DAWMD

SEQ ID NO: 32547 - protein, 19 aa, Artificial Sequence
  Description of Artificial Sequence: Synthetic peptide
  XENP022413 vhCDR2
EISTKANNHATYYAESVKG

SEQ ID NO: 32548 - protein, 10 aa, Artificial Sequence
  Description of Artificial Sequence: Synthetic peptide
  XENP022413 vhCDR3
LATWDWYFDV

SEQ ID NO: 32549 - protein, 218 aa, Artificial Sequence
  Description of Artificial Sequence: Synthetic polypeptide
  XENP022413 7G8_H3.18_L1.21_Fab Light Chain
DTVLTQSPSSLSASVGDRVTITCRASQSVDYDGDSYMNWYQQKPGLPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32550 - protein, 111 aa, Artificial Sequence
  Description of Artificial Sequence: Synthetic polypeptide
  VL of XENP022413
DTVLTQSPSSLSASVGDRVTITCRASQSVDYDGDSYMNWYQQKPGLPPKLLIYAASELESGIPARLSGSGSGTDFTLTISSLQPEDFATYYCQQSNEDPFTFGSGTKLEIK

SEQ ID NO: 32551 - protein, 15 aa, Artificial Sequence
  Description of Artificial Sequence: Synthetic peptide
  XENP022413 vlCDR1
RASQSVDYDGDSYMN

SEQ ID NO: 32552 - protein, 7 aa, Artificial Sequence
  Description of Artificial Sequence: Synthetic peptide
  XENP022413 vlCDR2
AASELES

SEQ ID NO: 32553 - protein, 9 aa, Artificial Sequence
  Description of Artificial Sequence: Synthetic peptide
  XENP022413 vlCDR3
QQSNEDPFT

SEQ ID NO: 32554 - protein, 226 aa, Artificial Sequence; identical to SEQ ID NO: 31734
  Description of Artificial Sequence: Synthetic polypeptide
  XENP022414 7G8_H3.18_L1.22_Fab Heavy Chain

SEQ ID NO: 32555 - protein, 121 aa, Artificial Sequence; identical to SEQ ID NO: 22325
  Description of Artificial Sequence: Synthetic polypeptide
  VH of XENP022414

SEQ ID NO: 32556 - protein, 5 aa, Artificial Sequence
  Description of Artificial Sequence: Synthetic peptide
  XENP022414 vhCDR1
DAWMD

SEQ ID NO: 32557 - protein, 19 aa, Artificial Sequence
  Description of Artificial Sequence: Synthetic peptide
  XENP022414 vhCDR2
EISTKANNHATYYAESVKG

SEQ ID NO: 32558 - protein, 10 aa, Artificial Sequence
  Description of Artificial Sequence: Synthetic peptide
  XENP022414 vhCDR3
LATWDWYFDV

SEQ ID NO: 32559 - protein, 218 aa, Artificial Sequence
  Description of Artificial Sequence: Synthetic polypeptide
  XENP022414 7G8_H3.18_L1.22_Fab Light Chain
DTVLTQSPSSLSASVGDRVTITCRASQSVDYDGDSYMNWYQQKPGEPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32560 - protein, 111 aa, Artificial Sequence
  Description of Artificial Sequence: Synthetic polypeptide
  VL of XENP022414
DTVLTQSPSSLSASVGDRVTITCRASQSVDYDGDSYMNWYQQKPGEPPKLLIYAASELESGIPARLSGSGSGTDFTLTISSLQPEDFATYYCQQSNEDPFTFGSGTKLEIK

SEQ ID NO: 32561 - protein, 15 aa, Artificial Sequence
  Description of Artificial Sequence: Synthetic peptide
  XENP022414 vlCDR1
RASQSVDYDGDSYMN

SEQ ID NO: 32562 - protein, 7 aa, Artificial Sequence
  Description of Artificial Sequence: Synthetic peptide
  XENP022414 vlCDR2
AASELES

SEQ ID NO: 32563 - protein, 9 aa, Artificial Sequence
  Description of Artificial Sequence: Synthetic peptide
  XENP022414 vlCDR3
QQSNEDPFT

SEQ ID NO: 32564 - protein, 226 aa, Artificial Sequence; identical to SEQ ID NO: 31734
  Description of Artificial Sequence: Synthetic polypeptide
  XENP022415 7G8_H3.18_L1.23_Fab Heavy Chain

SEQ ID NO: 32565 - protein, 121 aa, Artificial Sequence; identical to SEQ ID NO: 22325
  Description of Artificial Sequence: Synthetic polypeptide
  VH of XENP022415

SEQ ID NO: 32566 - protein, 5 aa, Artificial Sequence
  Description of Artificial Sequence: Synthetic peptide
  XENP022415 vhCDR1
DAWMD

SEQ ID NO: 32567 - protein, 19 aa, Artificial Sequence
  Description of Artificial Sequence: Synthetic peptide
  XENP022415 vhCDR2
EISTKANNHATYYAESVKG

SEQ ID NO: 32568 - protein, 10 aa, Artificial Sequence
  Description of Artificial Sequence: Synthetic peptide
  XENP022415 vhCDR3
LATWDWYFDV

SEQ ID NO: 32569 - protein, 218 aa, Artificial Sequence
  Description of Artificial Sequence: Synthetic polypeptide
  XENP022415 7G8_H3.18_L1.23_Fab Light Chain
DTVLTQSPSSLSASVGDRVTITCRASQSVDYDGDSYMNWYQQKPGKVPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32570 - protein, 111 aa, Artificial Sequence
  Description of Artificial Sequence: Synthetic polypeptide
  VL of XENP022415
DTVLTQSPSSLSASVGDRVTITCRASQSVDYDGDSYMNWYQQKPGKVPKLLIYAASELESGIPARLSGSGSGTDFTLTISSLQPEDFATYYCQQSNEDPFTFGSGTKLEIK

SEQ ID NO: 32571 - protein, 15 aa, Artificial Sequence
  Description of Artificial Sequence: Synthetic peptide
  XENP022415 vlCDR1
RASQSVDYDGDSYMN

SEQ ID NO: 32572 - protein, 7 aa, Artificial Sequence
  Description of Artificial Sequence: Synthetic peptide
  XENP022415 vlCDR2
AASELES

SEQ ID NO: 32573 - protein, 9 aa, Artificial Sequence
  Description of Artificial Sequence: Synthetic peptide
  XENP022415 vlCDR3
QQSNEDPFT

SEQ ID NO: 32574 - protein, 226 aa, Artificial Sequence; identical to SEQ ID NO: 31734
  Description of Artificial Sequence: Synthetic polypeptide
  XENP022416 7G8_H3.18_L1.24_Fab Heavy Chain

SEQ ID NO: 32575 - protein, 121 aa, Artificial Sequence; identical to SEQ ID NO: 22325
  Description of Artificial Sequence: Synthetic polypeptide
  VH of XENP022416

SEQ ID NO: 32576 - protein, 5 aa, Artificial Sequence
  Description of Artificial Sequence: Synthetic peptide
  XENP022416 vhCDR1
DAWMD

SEQ ID NO: 32577 - protein, 19 aa, Artificial Sequence
  Description of Artificial Sequence: Synthetic peptide
  XENP022416 vhCDR2
EISTKANNHATYYAESVKG

SEQ ID NO: 32578 - protein, 10 aa, Artificial Sequence
  Description of Artificial Sequence: Synthetic peptide
  XENP022416 vhCDR3
LATWDWYFDV

SEQ ID NO: 32579 - protein, 218 aa, Artificial Sequence
  Description of Artificial Sequence: Synthetic polypeptide
  XENP022416 7G8_H3.18_L1.24_Fab Light Chain
DTVLTQSPSSLSASVGDRVTITCRASQSVDYDGDSYMNWYQQKPGKAPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32580 - protein, 111 aa, Artificial Sequence
  Description of Artificial Sequence: Synthetic polypeptide
  VL of XENP022416
DTVLTQSPSSLSASVGDRVTITCRASQSVDYDGDSYMNWYQQKPGKAPKLLIYAASELESGIPARLSGSGSGTDFTLTISSLQPEDFATYYCQQSNEDPFTFGSGTKLEIK

SEQ ID NO: 32581 - protein, 15 aa, Artificial Sequence
  Description of Artificial Sequence: Synthetic peptide
  XENP022416 vlCDR1
RASQSVDYDGDSYMN

SEQ ID NO: 32582 - protein, 7 aa, Artificial Sequence
  Description of Artificial Sequence: Synthetic peptide
  XENP022416 vlCDR2
AASELES

SEQ ID NO: 32583 - protein, 9 aa, Artificial Sequence
  Description of Artificial Sequence: Synthetic peptide
  XENP022416 vlCDR3
QQSNEDPFT

SEQ ID NO: 32584 - protein, 226 aa, Artificial Sequence; identical to SEQ ID NO: 31734
  Description of Artificial Sequence: Synthetic polypeptide
  XENP022417 7G8_H3.18_L1.25_Fab Heavy Chain

SEQ ID NO: 32585 - protein, 121 aa, Artificial Sequence; identical to SEQ ID NO: 22325
  Description of Artificial Sequence: Synthetic polypeptide
  VH of XENP022417

SEQ ID NO: 32586 - protein, 5 aa, Artificial Sequence
  Description of Artificial Sequence: Synthetic peptide
  XENP022417 vhCDR1
DAWMD

SEQ ID NO: 32587 - protein, 19 aa, Artificial Sequence
  Description of Artificial Sequence: Synthetic peptide
  XENP022417 vhCDR2
EISTKANNHATYYAESVKG

SEQ ID NO: 32588 - protein, 10 aa, Artificial Sequence
  Description of Artificial Sequence: Synthetic peptide
  XENP022417 vhCDR3
LATWDWYFDV

SEQ ID NO: 32589 - protein, 218 aa, Artificial Sequence
  Description of Artificial Sequence: Synthetic polypeptide
  XENP022417 7G8_H3.18_L1.25_Fab Light Chain
DTVLTQSPSSLSASVGDRVTITCRASQSVDYDGDSYMNWYQQKPGKSPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32590 - protein, 111 aa, Artificial Sequence
  Description of Artificial Sequence: Synthetic polypeptide
  VL of XENP022417
DTVLTQSPSSLSASVGDRVTITCRASQSVDYDGDSYMNWYQQKPGKSPKLLIYAASELESGIPARLSGSGSGTDFTLTISSLQPEDFATYYCQQSNEDPFTFGSGTKLEIK

SEQ ID NO: 32591 - protein, 15 aa, Artificial Sequence
  Description of Artificial Sequence: Synthetic peptide
  XENP022417 vlCDR1
RASQSVDYDGDSYMN

SEQ ID NO: 32592 - protein, 7 aa, Artificial Sequence
  Description of Artificial Sequence: Synthetic peptide
  XENP022417 vlCDR2
AASELES

SEQ ID NO: 32593 - protein, 9 aa, Artificial Sequence
  Description of Artificial Sequence: Synthetic peptide
  XENP022417 vlCDR3
QQSNEDPFT

SEQ ID NO: 32594 - protein, 226 aa, Artificial Sequence; identical to SEQ ID NO: 31734
  Description of Artificial Sequence: Synthetic polypeptide
  XENP022418 7G8_H3.18_L1.26_Fab Heavy Chain

SEQ ID NO: 32595 - protein, 121 aa, Artificial Sequence; identical to SEQ ID NO: 22325
  Description of Artificial Sequence: Synthetic polypeptide
  VH of XENP022418

SEQ ID NO: 32596 - protein, 5 aa, Artificial Sequence
  Description of Artificial Sequence: Synthetic peptide
  XENP022418 vhCDR1
DAWMD

SEQ ID NO: 32597 - protein, 19 aa, Artificial Sequence
  Description of Artificial Sequence: Synthetic peptide
  XENP022418 vhCDR2
EISTKANNHATYYAESVKG

SEQ ID NO: 32598 - protein, 10 aa, Artificial Sequence
  Description of Artificial Sequence: Synthetic peptide
  XENP022418 vhCDR3
LATWDWYFDV

SEQ ID NO: 32599 - protein, 218 aa, Artificial Sequence
  Description of Artificial Sequence: Synthetic polypeptide
  XENP022418 7G8_H3.18_L1.26_Fab Light Chain
DTVLTQSPSSLSASVGDRVTITCRASQSVDYDGDSYMNWYQQKPGKPPKLLIYAASELESGVPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32600 - protein, 111 aa, Artificial Sequence
  Description of Artificial Sequence: Synthetic polypeptide
  VL of XENP022418
DTVLTQSPSSLSASVGDRVTITCRASQSVDYDGDSYMNWYQQKPGKPPKLLIYAASELESGVPARLSGSGSGTDFTLTISSLQPEDFATYYCQQSNEDPFTFGSGTKLEIK

SEQ ID NO: 32601 - protein, 15 aa, Artificial Sequence
  Description of Artificial Sequence: Synthetic peptide
  XENP022418 vlCDR1
RASQSVDYDGDSYMN

SEQ ID NO: 32602 - protein, 7 aa, Artificial Sequence
  Description of Artificial Sequence: Synthetic peptide
  XENP022418 vlCDR2
AASELES

SEQ ID NO: 32603 - protein, 9 aa, Artificial Sequence
  Description of Artificial Sequence: Synthetic peptide
  XENP022418 vlCDR3
QQSNEDPFT

SEQ ID NO: 32604 - protein, 226 aa, Artificial Sequence; identical to SEQ ID NO: 31734
  Description of Artificial Sequence: Synthetic polypeptide
  XENP022419 7G8_H3.18_L1.27_Fab Heavy Chain

SEQ ID NO: 32605 - protein, 121 aa, Artificial Sequence; identical to SEQ ID NO: 22325
  Description of Artificial Sequence: Synthetic polypeptide
  VH of XENP022419

SEQ ID NO: 32606 - protein, 5 aa, Artificial Sequence
  Description of Artificial Sequence: Synthetic peptide
  XENP022419 vhCDR1
DAWMD

SEQ ID NO: 32607 - protein, 19 aa, Artificial Sequence
  Description of Artificial Sequence: Synthetic peptide
  XENP022419 vhCDR2
EISTKANNHATYYAESVKG

SEQ ID NO: 32608 - protein, 10 aa, Artificial Sequence
  Description of Artificial Sequence: Synthetic peptide
  XENP022419 vhCDR3
LATWDWYFDV

SEQ ID NO: 32609 - protein, 218 aa, Artificial Sequence
  Description of Artificial Sequence: Synthetic polypeptide
  XENP022419 7G8_H3.18_L1.27_Fab Light Chain
DTVLTQSPSSLSASVGDRVTITCRASQSVDYDGDSYMNWYQQKPGKPPKLLIYAASELESGIPSRLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32610 - protein, 111 aa, Artificial Sequence
  Description of Artificial Sequence: Synthetic polypeptide
  VL of XENP022419
DTVLTQSPSSLSASVGDRVTITCRASQSVDYDGDSYMNWYQQKPGKPPKLLIYAASELESGIPSRLSGSGSGTDFTLTISSLQPEDFATYYCQQSNEDPFTFGSGTKLEIK

SEQ ID NO: 32611 - protein, 15 aa, Artificial Sequence
  Description of Artificial Sequence: Synthetic peptide
  XENP022419 vlCDR1
RASQSVDYDGDSYMN

SEQ ID NO: 32612 - protein, 7 aa, Artificial Sequence
  Description of Artificial Sequence: Synthetic peptide
  XENP022419 vlCDR2
AASELES

SEQ ID NO: 32613 - protein, 9 aa, Artificial Sequence
  Description of Artificial Sequence: Synthetic peptide
  XENP022419 vlCDR3
QQSNEDPFT

SEQ ID NO: 32614 - protein, 226 aa, Artificial Sequence; identical to SEQ ID NO: 31734
  Description of Artificial Sequence: Synthetic polypeptide
  XENP022420 7G8_H3.18_L1.28_Fab Heavy Chain

SEQ ID NO: 32615 - protein, 121 aa, Artificial Sequence; identical to SEQ ID NO: 22325
  Description of Artificial Sequence: Synthetic polypeptide
  VH of XENP022420

SEQ ID NO: 32616 - protein, 5 aa, Artificial Sequence
  Description of Artificial Sequence: Synthetic peptide
  XENP022420 vhCDR1
DAWMD

SEQ ID NO: 32617 - protein, 19 aa, Artificial Sequence
  Description of Artificial Sequence: Synthetic peptide
  XENP022420 vhCDR2
EISTKANNHATYYAESVKG

SEQ ID NO: 32618 - protein, 10 aa, Artificial Sequence
  Description of Artificial Sequence: Synthetic peptide
  XENP022420 vhCDR3
LATWDWYFDV

SEQ ID NO: 32619 - protein, 218 aa, Artificial Sequence
  Description of Artificial Sequence: Synthetic polypeptide
  XENP022420 7G8_H3.18_L1.28_Fab Light Chain
DTVLTQSPSSLSASVGDRVTITCRASQSVDYDGDSYMNWYQQKPGKPPKLLIYAASELESGIPDRLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32620 - protein, 111 aa, Artificial Sequence
  Description of Artificial Sequence: Synthetic polypeptide
  VL of XENP022420
DTVLTQSPSSLSASVGDRVTITCRASQSVDYDGDSYMNWYQQKPGKPPKLLIYAASELESGIPDRLSGSGSGTDFTLTISSLQPEDFATYYCQQSNEDPFTFGSGTKLEIK

SEQ ID NO: 32621 - protein, 15 aa, Artificial Sequence
  Description of Artificial Sequence: Synthetic peptide
  XENP022420 vlCDR1
RASQSVDYDGDSYMN

SEQ ID NO: 32622 - protein, 7 aa, Artificial Sequence
  Description of Artificial Sequence: Synthetic peptide
  XENP022420 vlCDR2
AASELES

SEQ ID NO: 32623 - protein, 9 aa, Artificial Sequence
  Description of Artificial Sequence: Synthetic peptide
  XENP022420 vlCDR3
QQSNEDPFT

SEQ ID NO: 32624 - protein, 226 aa, Artificial Sequence; identical to SEQ ID NO: 31734
  Description of Artificial Sequence: Synthetic polypeptide
  XENP022421 7G8_H3.18_L1.29_Fab Heavy Chain

SEQ ID NO: 32625 - protein, 121 aa, Artificial Sequence; identical to SEQ ID NO: 22325
  Description of Artificial Sequence: Synthetic polypeptide
  VH of XENP022421

SEQ ID NO: 32626 - protein, 5 aa, Artificial Sequence
  Description of Artificial Sequence: Synthetic peptide
  XENP022421 vhCDR1
DAWMD

SEQ ID NO: 32627 - protein, 19 aa, Artificial Sequence
  Description of Artificial Sequence: Synthetic peptide
  XENP022421 vhCDR2
EISTKANNHATYYAESVKG

SEQ ID NO: 32628 - protein, 10 aa, Artificial Sequence
  Description of Artificial Sequence: Synthetic peptide
  XENP022421 vhCDR3
LATWDWYFDV

SEQ ID NO: 32629 - protein, 218 aa, Artificial Sequence
  Description of Artificial Sequence: Synthetic polypeptide
  XENP022421 7G8_H3.18_L1.29_Fab Light Chain
DTVLTQSPSSLSASVGDRVTITCRASQSVDYDGDSYMNWYQQKPGKPPKLLIYAASELESGIPPRLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32630 - protein, 111 aa, Artificial Sequence
  Description of Artificial Sequence: Synthetic polypeptide
  VL of XENP022421
DTVLTQSPSSLSASVGDRVTITCRASQSVDYDGDSYMNWYQQKPGKPPKLLIYAASELESGIPPRLSGSGSGTDFTLTISSLQPEDFATYYCQQSNEDPFTFGSGTKLEIK

SEQ ID NO: 32631 - protein, 15 aa, Artificial Sequence
  Description of Artificial Sequence: Synthetic peptide
  XENP022421 vlCDR1
RASQSVDYDGDSYMN

SEQ ID NO: 32632 - protein, 7 aa, Artificial Sequence
  Description of Artificial Sequence: Synthetic peptide
  XENP022421 vlCDR2
AASELES

SEQ ID NO: 32633 - protein, 9 aa, Artificial Sequence
  Description of Artificial Sequence: Synthetic peptide
  XENP022421 vlCDR3
QQSNEDPFT

SEQ ID NO: 32634 - protein, 226 aa, Artificial Sequence; identical to SEQ ID NO: 31734
  Description of Artificial Sequence: Synthetic polypeptide
  XENP022422 7G8_H3.18_L1.30_Fab Heavy Chain

SEQ ID NO: 32635 - protein, 121 aa, Artificial Sequence; identical to SEQ ID NO: 22325
  Description of Artificial Sequence: Synthetic polypeptide
  VH of XENP022422

SEQ ID NO: 32636 - protein, 5 aa, Artificial Sequence
  Description of Artificial Sequence: Synthetic peptide
  XENP022422 vhCDR1
DAWMD

SEQ ID NO: 32637 - protein, 19 aa, Artificial Sequence
  Description of Artificial Sequence: Synthetic peptide
  XENP022422 vhCDR2
EISTKANNHATYYAESVKG

SEQ ID NO: 32638 - protein, 10 aa, Artificial Sequence
  Description of Artificial Sequence: Synthetic peptide
  XENP022422 vhCDR3
LATWDWYFDV

SEQ ID NO: 32639 - protein, 218 aa, Artificial Sequence; identical to SEQ ID NO: 22539
  Description of Artificial Sequence: Synthetic polypeptide
  XENP022422 7G8_H3.18_L1.30_Fab Light Chain

SEQ ID NO: 32640 - protein, 111 aa, Artificial Sequence; identical to SEQ ID NO: 22540
  Description of Artificial Sequence: Synthetic polypeptide
  VL of XENP022422

SEQ ID NO: 32641 - protein, 15 aa, Artificial Sequence
  Description of Artificial Sequence: Synthetic peptide
  XENP022422 vlCDR1
RASQSVDYDGDSYMN

SEQ ID NO: 32642 - protein, 7 aa, Artificial Sequence
  Description of Artificial Sequence: Synthetic peptide
  XENP022422 vlCDR2
AASELES

SEQ ID NO: 32643 - protein, 9 aa, Artificial Sequence
  Description of Artificial Sequence: Synthetic peptide
  XENP022422 vlCDR3
QQSNEDPFT

SEQ ID NO: 32644 - protein, 226 aa, Artificial Sequence; identical to SEQ ID NO: 31734
  Description of Artificial Sequence: Synthetic polypeptide
  XENP022423 7G8_H3.18_L1.31_Fab Heavy Chain

SEQ ID NO: 32645 - protein, 121 aa, Artificial Sequence; identical to SEQ ID NO: 22325
  Description of Artificial Sequence: Synthetic polypeptide
  VH of XENP022423

SEQ ID NO: 32646 - protein, 5 aa, Artificial Sequence
  Description of Artificial Sequence: Synthetic peptide
  XENP022423 vhCDR1
DAWMD

SEQ ID NO: 32647 - protein, 19 aa, Artificial Sequence
  Description of Artificial Sequence: Synthetic peptide
  XENP022423 vhCDR2
EISTKANNHATYYAESVKG

SEQ ID NO: 32648 - protein, 10 aa, Artificial Sequence
  Description of Artificial Sequence: Synthetic peptide
  XENP022423 vhCDR3
LATWDWYFDV

SEQ ID NO: 32649 - protein, 218 aa, Artificial Sequence
  Description of Artificial Sequence: Synthetic polypeptide
  XENP022423 7G8_H3.18_L1.31_Fab Light Chain
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32650 - protein, 111 aa, Artificial Sequence
  Description of Artificial Sequence: Synthetic polypeptide
  VL of XENP022423
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGQGTKLEIK

SEQ ID NO: 32651 - protein, 15 aa, Artificial Sequence
  Description of Artificial Sequence: Synthetic peptide
  XENP022423 vlCDR1
RASQSVDYDGDSYMN

SEQ ID NO: 32652 - protein, 7 aa, Artificial Sequence
  Description of Artificial Sequence: Synthetic peptide
  XENP022423 vlCDR2
AASELES

SEQ ID NO: 32653 - protein, 9 aa, Artificial Sequence
  Description of Artificial Sequence: Synthetic peptide
  XENP022423 vlCDR3
QQSNEDPFT

SEQ ID NO: 32654 - protein, 226 aa, Artificial Sequence; identical to SEQ ID NO: 31734
  Description of Artificial Sequence: Synthetic polypeptide
  XENP022424 7G8_H3.18_L1.32_Fab Heavy Chain

SEQ ID NO: 32655 - protein, 121 aa, Artificial Sequence; identical to SEQ ID NO: 22325
  Description of Artificial Sequence: Synthetic polypeptide
  VH of XENP022424

SEQ ID NO: 32656 - protein, 5 aa, Artificial Sequence
  Description of Artificial Sequence: Synthetic peptide
  XENP022424 vhCDR1
DAWMD

SEQ ID NO: 32657 - protein, 19 aa, Artificial Sequence
  Description of Artificial Sequence: Synthetic peptide
  XENP022424 vhCDR2
EISTKANNHATYYAESVKG

SEQ ID NO: 32658 - protein, 10 aa, Artificial Sequence
  Description of Artificial Sequence: Synthetic peptide
  XENP022424 vhCDR3
LATWDWYFDV

SEQ ID NO: 32659 - protein, 218 aa, Artificial Sequence
  Description of Artificial Sequence: Synthetic polypeptide
  XENP022424 7G8_H3.18_L1.32_Fab Light Chain
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGPGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32660 - protein, 111 aa, Artificial Sequence
  Description of Artificial Sequence: Synthetic polypeptide
  VL of XENP022424
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGPGTKLEIK

SEQ ID NO: 32661 - protein, 15 aa, Artificial Sequence
  Description of Artificial Sequence: Synthetic peptide
  XENP022424 vlCDR1
RASQSVDYDGDSYMN

SEQ ID NO: 32662 - protein, 7 aa, Artificial Sequence
  Description of Artificial Sequence: Synthetic peptide
  XENP022424 vlCDR2
AASELES

SEQ ID NO: 32663 - protein, 9 aa, Artificial Sequence
  Description of Artificial Sequence: Synthetic peptide
  XENP022424 vlCDR3
QQSNEDPFT

SEQ ID NO: 32664 - protein, 226 aa, Artificial Sequence; identical to SEQ ID NO: 31734
  Description of Artificial Sequence: Synthetic polypeptide
  XENP022425 7G8_H3.18_L1.33_Fab Heavy Chain

SEQ ID NO: 32665 - protein, 121 aa, Artificial Sequence; identical to SEQ ID NO: 22325
  Description of Artificial Sequence: Synthetic polypeptide
  VH of XENP022425

SEQ ID NO: 32666 - protein, 5 aa, Artificial Sequence
  Description of Artificial Sequence: Synthetic peptide
  XENP022425 vhCDR1
DAWMD

SEQ ID NO: 32667 - protein, 19 aa, Artificial Sequence
  Description of Artificial Sequence: Synthetic peptide
  XENP022425 vhCDR2
EISTKANNHATYYAESVKG

SEQ ID NO: 32668 - protein, 10 aa, Artificial Sequence
  Description of Artificial Sequence: Synthetic peptide
  XENP022425 vhCDR3
LATWDWYFDV

SEQ ID NO: 32669 - protein, 218 aa, Artificial Sequence
  Description of Artificial Sequence: Synthetic polypeptide
  XENP022425 7G8_H3.18_L1.33_Fab Light Chain
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32670 - protein, 111 aa, Artificial Sequence
  Description of Artificial Sequence: Synthetic polypeptide
  VL of XENP022425
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGGGTKLEIK

SEQ ID NO: 32671 - protein, 15 aa, Artificial Sequence
  Description of Artificial Sequence: Synthetic peptide
  XENP022425 vlCDR1
RASQSVDYDGDSYMN

SEQ ID NO: 32672 - protein, 7 aa, Artificial Sequence
  Description of Artificial Sequence: Synthetic peptide
  XENP022425 vlCDR2
AASELES

SEQ ID NO: 32673 - protein, 9 aa, Artificial Sequence
  Description of Artificial Sequence: Synthetic peptide
  XENP022425 vlCDR3
QQSNEDPFT

SEQ ID NO: 32674 - protein, 226 aa, Artificial Sequence; identical to SEQ ID NO: 32254
  Description of Artificial Sequence: Synthetic polypeptide
  XENP022582 7G8_H3.30_L1.30_Fab Heavy Chain

SEQ ID NO: 32675 - protein, 121 aa, Artificial Sequence; identical to SEQ ID NO: 22485
  Description of Artificial Sequence: Synthetic polypeptide
  VH of XENP022582

SEQ ID NO: 32676 - protein, 5 aa, Artificial Sequence
  Description of Artificial Sequence: Synthetic peptide
  XENP022582 vhCDR1
DAWMS

SEQ ID NO: 32677 - protein, 19 aa, Artificial Sequence
  Description of Artificial Sequence: Synthetic peptide
  XENP022582 vhCDR2
EISTKANNHATYYAESVKG

SEQ ID NO: 32678 - protein, 10 aa, Artificial Sequence
  Description of Artificial Sequence: Synthetic peptide
  XENP022582 vhCDR3
LATWDWYFDV

SEQ ID NO: 32679 - protein, 218 aa, Artificial Sequence; identical to SEQ ID NO: 22539
  Description of Artificial Sequence: Synthetic polypeptide
  XENP022582 7G8_H3.30_L1.30_Fab Light Chain

SEQ ID NO: 32680 - protein, 111 aa, Artificial Sequence; identical to SEQ ID NO: 22540
  Description of Artificial Sequence: Synthetic polypeptide
  VL of XENP022582

SEQ ID NO: 32681 - protein, 15 aa, Artificial Sequence
  Description of Artificial Sequence: Synthetic peptide
  XENP022582 vlCDR1
RASQSVDYDGDSYMN

SEQ ID NO: 32682 - protein, 7 aa, Artificial Sequence
  Description of Artificial Sequence: Synthetic peptide
  XENP022582 vlCDR2
AASELES

SEQ ID NO: 32683 - protein, 9 aa, Artificial Sequence
  Description of Artificial Sequence: Synthetic peptide
  XENP022582 vlCDR3
QQSNEDPFT

SEQ ID NO: 32684 - protein, 226 aa, Artificial Sequence; identical to SEQ ID NO: 32284
  Description of Artificial Sequence: Synthetic polypeptide
  XENP022583 7G8_H3.33_L1.30_Fab Heavy Chain

SEQ ID NO: 32685 - protein, 121 aa, Artificial Sequence; identical to SEQ ID NO: 22505
  Description of Artificial Sequence: Synthetic polypeptide
  VH of XENP022583

SEQ ID NO: 32686 - protein, 5 aa, Artificial Sequence
  Description of Artificial Sequence: Synthetic peptide
  XENP022583 vhCDR1
DAWMG

SEQ ID NO: 32687 - protein, 19 aa, Artificial Sequence
  Description of Artificial Sequence: Synthetic peptide
  XENP022583 vhCDR2
EISTKANNHATYYAESVKG

SEQ ID NO: 32688 - protein, 10 aa, Artificial Sequence
  Description of Artificial Sequence: Synthetic peptide
  XENP022583 vhCDR3
LATWDWYFDV

SEQ ID NO: 32689 - protein, 218 aa, Artificial Sequence; identical to SEQ ID NO: 22539
  Description of Artificial Sequence: Synthetic polypeptide
  XENP022583 7G8_H3.33_L1.30_Fab Light Chain

SEQ ID NO: 32690 - protein, 111 aa, Artificial Sequence; identical to SEQ ID NO: 22540
  Description of Artificial Sequence: Synthetic polypeptide
  VL of XENP022583

SEQ ID NO: 32691 - protein, 15 aa, Artificial Sequence
  Description of Artificial Sequence: Synthetic peptide
  XENP022583 vlCDR1
RASQSVDYDGDSYMN

SEQ ID NO: 32692 - protein, 7 aa, Artificial Sequence
  Description of Artificial Sequence: Synthetic peptide
  XENP022583 vlCDR2
AASELES

SEQ ID NO: 32693 - protein, 9 aa, Artificial Sequence
  Description of Artificial Sequence: Synthetic peptide
  XENP022583 vlCDR3
QQSNEDPFT

SEQ ID NO: 32694 - protein, 226 aa, Artificial Sequence
  Description of Artificial Sequence: Synthetic polypeptide
  XENP022588 7G8_H3.54_L1.30_Fab Heavy Chain
EVQLVESGGGLVQPGGSLRLSCAASGFTFDDAWMSWVRQAPGKGLEWVAEISTKANNHATYYAPSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32695 - protein, 121 aa, Artificial Sequence
  Description of Artificial Sequence: Synthetic polypeptide
  VH of XENP022588
EVQLVESGGGLVQPGGSLRLSCAASGFTFDDAWMSWVRQAPGKGLEWVAEISTKANNHATYYAPSVKGRFTISRDDSKSSVYLQMNSLRAEDTAVYYCTRLATWDWYFDVWGQGTTVTVSS

SEQ ID NO: 32696 - protein, 5 aa, Artificial Sequence
  Description of Artificial Sequence: Synthetic peptide
  XENP022588 vhCDR1
DAWMS

SEQ ID NO: 32697 - protein, 19 aa, Artificial Sequence
  Description of Artificial Sequence: Synthetic peptide
  XENP022588 vhCDR2
EISTKANNHATYYAPSVKG

SEQ ID NO: 32698 - protein, 10 aa, Artificial Sequence
  Description of Artificial Sequence: Synthetic peptide
  XENP022588 vhCDR3
LATWDWYFDV

SEQ ID NO: 32699 - protein, 218 aa, Artificial Sequence; identical to SEQ ID NO: 22539
  Description of Artificial Sequence: Synthetic polypeptide
  XENP022588 7G8_H3.54_L1.30_Fab Light Chain

SEQ ID NO: 32700 - protein, 111 aa, Artificial Sequence; identical to SEQ ID NO: 22540
  Description of Artificial Sequence: Synthetic polypeptide
  VL of XENP022588

SEQ ID NO: 32701 - protein, 15 aa, Artificial Sequence
  Description of Artificial Sequence: Synthetic peptide
  XENP022588 vlCDR1
RASQSVDYDGDSYMN

SEQ ID NO: 32702 - protein, 7 aa, Artificial Sequence
  Description of Artificial Sequence: Synthetic peptide
  XENP022588 vlCDR2
AASELES

SEQ ID NO: 32703 - protein, 9 aa, Artificial Sequence
  Description of Artificial Sequence: Synthetic peptide
  XENP022588 vlCDR3
QQSNEDPFT

SEQ ID NO: 32704 - protein, 226 aa, Artificial Sequence
  Description of Artificial Sequence: Synthetic polypeptide
  XENP022589 7G8_H3.55_L1.30_Fab Heavy Chain
EVQLVESGGGLVQPGGSLRLSCAASGFTFDDAWMGWVRQAPGKGLEWVAEISTKANNHATYYAPSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32705 - protein, 121 aa, Artificial Sequence
  Description of Artificial Sequence: Synthetic polypeptide
  VH of XENP022589
EVQLVESGGGLVQPGGSLRLSCAASGFTFDDAWMGWVRQAPGKGLEWVAEISTKANNHATYYAPSVKGRFTISRDDSKSSVYLQMNSLRAEDTAVYYCTRLATWDWYFDVWGQGTTVTVSS

SEQ ID NO: 32706 - protein, 5 aa, Artificial Sequence
  Description of Artificial Sequence: Synthetic peptide
  XENP022589 vhCDR1
DAWMG

SEQ ID NO: 32707 - protein, 19 aa, Artificial Sequence
  Description of Artificial Sequence: Synthetic peptide
  XENP022589 vhCDR2
EISTKANNHATYYAPSVKG

SEQ ID NO: 32708 - protein, 10 aa, Artificial Sequence
  Description of Artificial Sequence: Synthetic peptide
  XENP022589 vhCDR3
LATWDWYFDV

SEQ ID NO: 32709 - protein, 218 aa, Artificial Sequence; identical to SEQ ID NO: 22539
  Description of Artificial Sequence: Synthetic polypeptide
  XENP022589 7G8_H3.55_L1.30_Fab Light Chain

SEQ ID NO: 32710 - protein, 111 aa, Artificial Sequence; identical to SEQ ID NO: 22540
  Description of Artificial Sequence: Synthetic polypeptide
  VL of XENP022589

SEQ ID NO: 32711 - protein, 15 aa, Artificial Sequence
  Description of Artificial Sequence: Synthetic peptide
  XENP022589 vlCDR1
RASQSVDYDGDSYMN

SEQ ID NO: 32712 - protein, 7 aa, Artificial Sequence
  Description of Artificial Sequence: Synthetic peptide
  XENP022589 vlCDR2
AASELES

SEQ ID NO: 32713 - protein, 9 aa, Artificial Sequence
  Description of Artificial Sequence: Synthetic peptide
  XENP022589 vlCDR3
QQSNEDPFT

SEQ ID NO: 32714 - protein, 226 aa, Artificial Sequence
  Description of Artificial Sequence: Synthetic polypeptide
  XENP022590 7G8_H3.56_L1.30_Fab Heavy Chain
EVQLVESGGGLVQPGGSLRLSCAASGFTFDDAWMSWVRQAPGKGLEWVAEISTKANNHATYYAESVKGRFTISRDDSKSTVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32715 - protein, 121 aa, Artificial Sequence
  Description of Artificial Sequence: Synthetic polypeptide
  VH of XENP022590
EVQLVESGGGLVQPGGSLRLSCAASGFTFDDAWMSWVRQAPGKGLEWVAEISTKANNHATYYAESVKGRFTISRDDSKSTVYLQMNSLRAEDTAVYYCTRLATWDWYFDVWGQGTTVTVSS

SEQ ID NO: 32716 - protein, 5 aa, Artificial Sequence
  Description of Artificial Sequence: Synthetic peptide
  XENP022590 vhCDR1
DAWMS

SEQ ID NO: 32717 - protein, 19 aa, Artificial Sequence
  Description of Artificial Sequence: Synthetic peptide
  XENP022590 vhCDR2
EISTKANNHATYYAESVKG

SEQ ID NO: 32718 - protein, 10 aa, Artificial Sequence
  Description of Artificial Sequence: Synthetic peptide
  XENP022590 vhCDR3
LATWDWYFDV

SEQ ID NO: 32719 - protein, 218 aa, Artificial Sequence; identical to SEQ ID NO: 22539
  Description of Artificial Sequence: Synthetic polypeptide
  XENP022590 7G8_H3.56_L1.30_Fab Light Chain

SEQ ID NO: 32720 - protein, 111 aa, Artificial Sequence; identical to SEQ ID NO: 22540
  Description of Artificial Sequence: Synthetic polypeptide
  VL of XENP022590

SEQ ID NO: 32721 - protein, 15 aa, Artificial Sequence
  Description of Artificial Sequence: Synthetic peptide
  XENP022590 vlCDR1
RASQSVDYDGDSYMN

SEQ ID NO: 32722 - protein, 7 aa, Artificial Sequence
  Description of Artificial Sequence: Synthetic peptide
  XENP022590 vlCDR2
AASELES

SEQ ID NO: 32723 - protein, 9 aa, Artificial Sequence
  Description of Artificial Sequence: Synthetic peptide
  XENP022590 vlCDR3
QQSNEDPFT

SEQ ID NO: 32724 - protein, 226 aa, Artificial Sequence
  Description of Artificial Sequence: Synthetic polypeptide
  XENP022591 7G8_H3.57_L1.30_Fab Heavy Chain
EVQLVESGGGLVQPGGSLRLSCAASGFTFDDAWMGWVRQAPGKGLEWVAEISTKANNHATYYAESVKGRFTISRDDSKSTVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32725 - protein, 121 aa, Artificial Sequence
  Description of Artificial Sequence: Synthetic polypeptide
  VH of XENP022591
EVQLVESGGGLVQPGGSLRLSCAASGFTFDDAWMGWVRQAPGKGLEWVAEISTKANNHATYYAESVKGRFTISRDDSKSTVYLQMNSLRAEDTAVYYCTRLATWDWYFDVWGQGTTVTVSS

SEQ ID NO: 32726 - protein, 5 aa, Artificial Sequence
  Description of Artificial Sequence: Synthetic peptide
  XENP022591 vhCDR1
DAWMG

SEQ ID NO: 32727 - protein, 19 aa, Artificial Sequence
  Description of Artificial Sequence: Synthetic peptide
  XENP022591 vhCDR2
EISTKANNHATYYAESVKG

SEQ ID NO: 32728 - protein, 10 aa, Artificial Sequence
  Description of Artificial Sequence: Synthetic peptide
  XENP022591 vhCDR3
LATWDWYFDV

SEQ ID NO: 32729 - protein, 218 aa, Artificial Sequence; identical to SEQ ID NO: 22539
  Description of Artificial Sequence: Synthetic polypeptide
  XENP022591 7G8_H3.57_L1.30_Fab Light Chain

SEQ ID NO: 32730 - protein, 111 aa, Artificial Sequence; identical to SEQ ID NO: 22540
  Description of Artificial Sequence: Synthetic polypeptide
  VL of XENP022591

SEQ ID NO: 32731 - protein, 15 aa, Artificial Sequence
  Description of Artificial Sequence: Synthetic peptide
  XENP022591 vlCDR1
RASQSVDYDGDSYMN

SEQ ID NO: 32732 - protein, 7 aa, Artificial Sequence
  Description of Artificial Sequence: Synthetic peptide
  XENP022591 vlCDR2
AASELES

SEQ ID NO: 32733 - protein, 9 aa, Artificial Sequence
  Description of Artificial Sequence: Synthetic peptide
  XENP022591 vlCDR3
QQSNEDPFT

SEQ ID NO: 32734 - protein, 226 aa, Artificial Sequence
  Description of Artificial Sequence: Synthetic polypeptide
  XENP022592 7G8_H3.58_L1.30_Fab Heavy Chain
EVQLVESGGGLVQPGGSLRLSCAASGFTFDDAWMSWVRQAPGKGLEWVAEISTKANNHATYYAPSVKGRFTISRDDSKSTVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32735 - protein, 121 aa, Artificial Sequence
  Description of Artificial Sequence: Synthetic polypeptide
  VH of XENP022592
EVQLVESGGGLVQPGGSLRLSCAASGFTFDDAWMSWVRQAPGKGLEWVAEISTKANNHATYYAPSVKGRFTISRDDSKSTVYLQMNSLRAEDTAVYYCTRLATWDWYFDVWGQGTTVTVSS

SEQ ID NO: 32736 - protein, 5 aa, Artificial Sequence
  Description of Artificial Sequence: Synthetic peptide
  XENP022592 vhCDR1
DAWMS

SEQ ID NO: 32737 - protein, 19 aa, Artificial Sequence
  Description of Artificial Sequence: Synthetic peptide
  XENP022592 vhCDR2
EISTKANNHATYYAPSVKG

SEQ ID NO: 32738 - protein, 10 aa, Artificial Sequence
  Description of Artificial Sequence: Synthetic peptide
  XENP022592 vhCDR3
LATWDWYFDV

SEQ ID NO: 32739 - protein, 218 aa, Artificial Sequence; identical to SEQ ID NO: 22539
  Description of Artificial Sequence: Synthetic polypeptide
  XENP022592 7G8_H3.58_L1.30_Fab Light Chain

SEQ ID NO: 32740 - protein, 111 aa, Artificial Sequence; identical to SEQ ID NO: 22540
  Description of Artificial Sequence: Synthetic polypeptide
  VL of XENP022592

SEQ ID NO: 32741 - protein, 15 aa, Artificial Sequence
  Description of Artificial Sequence: Synthetic peptide
  XENP022592 vlCDR1
RASQSVDYDGDSYMN

SEQ ID NO: 32742 - protein, 7 aa, Artificial Sequence
  Description of Artificial Sequence: Synthetic peptide
  XENP022592 vlCDR2
AASELES

SEQ ID NO: 32743 - protein, 9 aa, Artificial Sequence
  Description of Artificial Sequence: Synthetic peptide
  XENP022592 vlCDR3
QQSNEDPFT

SEQ ID NO: 32744 - protein, 226 aa, Artificial Sequence
  Description of Artificial Sequence: Synthetic polypeptide
  XENP022593 7G8_H3.59_L1.30_Fab Heavy Chain
EVQLVESGGGLVQPGGSLRLSCAASGFTFDDAWMGWVRQAPGKGLEWVAEISTKANNHATYYAPSVKGRFTISRDDSKSTVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32745 - protein, 121 aa, Artificial Sequence
  Description of Artificial Sequence: Synthetic polypeptide
  VH of XENP022593
EVQLVESGGGLVQPGGSLRLSCAASGFTFDDAWMGWVRQAPGKGLEWVAEISTKANNHATYYAPSVKGRFTISRDDSKSTVYLQMNSLRAEDTAVYYCTRLATWDWYFDVWGQGTTVTVSS

SEQ ID NO: 32746 - protein, 5 aa, Artificial Sequence
  Description of Artificial Sequence: Synthetic peptide
  XENP022593 vhCDR1
DAWMG

SEQ ID NO: 32747 - protein, 19 aa, Artificial Sequence
  Description of Artificial Sequence: Synthetic peptide
  XENP022593 vhCDR2
EISTKANNHATYYAPSVKG

SEQ ID NO: 32748 - protein, 10 aa, Artificial Sequence
  Description of Artificial Sequence: Synthetic peptide
  XENP022593 vhCDR3
LATWDWYFDV

SEQ ID NO: 32749 - protein, 218 aa, Artificial Sequence; identical to SEQ ID NO: 22539
  Description of Artificial Sequence: Synthetic polypeptide
  XENP022593 7G8_H3.59_L1.30_Fab Light Chain

SEQ ID NO: 32750 - protein, 111 aa, Artificial Sequence; identical to SEQ ID NO: 22540
  Description of Artificial Sequence: Synthetic polypeptide
  VL of XENP022593

SEQ ID NO: 32751 - protein, 15 aa, Artificial Sequence
  Description of Artificial Sequence: Synthetic peptide
  XENP022593 vlCDR1
RASQSVDYDGDSYMN

SEQ ID NO: 32752 - protein, 7 aa, Artificial Sequence
  Description of Artificial Sequence: Synthetic peptide
  XENP022593 vlCDR2
AASELES

SEQ ID NO: 32753 - protein, 9 aa, Artificial Sequence
  Description of Artificial Sequence: Synthetic peptide
  XENP022593 vlCDR3
QQSNEDPFT

SEQ ID NO: 32754 - protein, 226 aa, Artificial Sequence; identical to SEQ ID NO: 32254
  Description of Artificial Sequence: Synthetic polypeptide
  XENP022594 7G8_H3.30_L1.34_Fab Heavy Chain

SEQ ID NO: 32755 - protein, 121 aa, Artificial Sequence; identical to SEQ ID NO: 22485
  Description of Artificial Sequence: Synthetic polypeptide
  VH of XENP022594

SEQ ID NO: 32756 - protein, 5 aa, Artificial Sequence
  Description of Artificial Sequence: Synthetic peptide
  XENP022594 vhCDR1
DAWMS

SEQ ID NO: 32757 - protein, 19 aa, Artificial Sequence
  Description of Artificial Sequence: Synthetic peptide
  XENP022594 vhCDR2
EISTKANNHATYYAESVKG

SEQ ID NO: 32758 - protein, 10 aa, Artificial Sequence
  Description of Artificial Sequence: Synthetic peptide
  XENP022594 vhCDR3
LATWDWYFDV

SEQ ID NO: 32759 - protein, 218 aa, Artificial Sequence; identical to SEQ ID NO: 22599
  Description of Artificial Sequence: Synthetic polypeptide
  XENP022594 7G8_H3.30_L1.34_Fab Light Chain

SEQ ID NO: 32760 - protein, 111 aa, Artificial Sequence; identical to SEQ ID NO: 22600
  Description of Artificial Sequence: Synthetic polypeptide
  VL of XENP022594

SEQ ID NO: 32761 - protein, 15 aa, Artificial Sequence
  Description of Artificial Sequence: Synthetic peptide
  XENP022594 vlCDR1
RASQSVDYDGDSYMN

SEQ ID NO: 32762 - protein, 7 aa, Artificial Sequence
  Description of Artificial Sequence: Synthetic peptide
  XENP022594 vlCDR2
AASELES

SEQ ID NO: 32763 - protein, 9 aa, Artificial Sequence
  Description of Artificial Sequence: Synthetic peptide
  XENP022594 vlCDR3
QQSNEDPFT

SEQ ID NO: 32764 - protein, 226 aa, Artificial Sequence; identical to SEQ ID NO: 32254
  Description of Artificial Sequence: Synthetic polypeptide
  XENP022595 7G8_H3.30_L1.36_Fab Heavy Chain

SEQ ID NO: 32765 - protein, 121 aa, Artificial Sequence; identical to SEQ ID NO: 22485
  Description of Artificial Sequence: Synthetic polypeptide
  VH of XENP022595

SEQ ID NO: 32766 - protein, 5 aa, Artificial Sequence
  Description of Artificial Sequence: Synthetic peptide
  XENP022595 vhCDR1
DAWMS

SEQ ID NO: 32767 - protein, 19 aa, Artificial Sequence
  Description of Artificial Sequence: Synthetic peptide
  XENP022595 vhCDR2
EISTKANNHATYYAESVKG

SEQ ID NO: 32768 - protein, 10 aa, Artificial Sequence
  Description of Artificial Sequence: Synthetic peptide
  XENP022595 vhCDR3
LATWDWYFDV

SEQ ID NO: 32769 - protein, 218 aa, Artificial Sequence; identical to SEQ ID NO: 22619
  Description of Artificial Sequence: Synthetic polypeptide
  XENP022595 7G8_H3.30_L1.36_Fab Light Chain

SEQ ID NO: 32770 - protein, 111 aa, Artificial Sequence; identical to SEQ ID NO: 22620
  Description of Artificial Sequence: Synthetic polypeptide
  VL of XENP022595

SEQ ID NO: 32771 - protein, 15 aa, Artificial Sequence
  Description of Artificial Sequence: Synthetic peptide
  XENP022595 vlCDR1
RASQSVDHDGDSYMN

SEQ ID NO: 32772 - protein, 7 aa, Artificial Sequence
  Description of Artificial Sequence: Synthetic peptide
  XENP022595 vlCDR2
AASELES

SEQ ID NO: 32773 - protein, 9 aa, Artificial Sequence
  Description of Artificial Sequence: Synthetic peptide
  XENP022595 vlCDR3
QQSNEDPFT

SEQ ID NO: 32774 - protein, 226 aa, Artificial Sequence; identical to SEQ ID NO: 32284
  Description of Artificial Sequence: Synthetic polypeptide
  XENP022596 7G8_H3.33_L1.34_Fab Heavy Chain

SEQ ID NO: 32775 - protein, 121 aa, Artificial Sequence; identical to SEQ ID NO: 22505
  Description of Artificial Sequence: Synthetic polypeptide
  VH of XENP022596

SEQ ID NO: 32776 - protein, 5 aa, Artificial Sequence
  Description of Artificial Sequence: Synthetic peptide
  XENP022596 vhCDR1
DAWMG

SEQ ID NO: 32777 - protein, 19 aa, Artificial Sequence
  Description of Artificial Sequence: Synthetic peptide
  XENP022596 vhCDR2
EISTKANNHATYYAESVKG

SEQ ID NO: 32778 - protein, 10 aa, Artificial Sequence
  Description of Artificial Sequence: Synthetic peptide
  XENP022596 vhCDR3
LATWDWYFDV

SEQ ID NO: 32779 - protein, 218 aa, Artificial Sequence; identical to SEQ ID NO: 22599
  Description of Artificial Sequence: Synthetic polypeptide
  XENP022596 7G8_H3.33_L1.34_Fab Light Chain

SEQ ID NO: 32780 - protein, 111 aa, Artificial Sequence; identical to SEQ ID NO: 22600
  Description of Artificial Sequence: Synthetic polypeptide
  VL of XENP022596

SEQ ID NO: 32781 - protein, 15 aa, Artificial Sequence
  Description of Artificial Sequence: Synthetic peptide
  XENP022596 vlCDR1
RASQSVDYDGDSYMN

SEQ ID NO: 32782 - protein, 7 aa, Artificial Sequence
  Description of Artificial Sequence: Synthetic peptide
  XENP022596 vlCDR2
AASELES

SEQ ID NO: 32783 - protein, 9 aa, Artificial Sequence
  Description of Artificial Sequence: Synthetic peptide
  XENP022596 vlCDR3
QQSNEDPFT

SEQ ID NO: 32784 - protein, 226 aa, Artificial Sequence; identical to SEQ ID NO: 32284
  Description of Artificial Sequence: Synthetic polypeptide
  XENP022601 7G8_H3.33_L1.36_Fab Heavy Chain

SEQ ID NO: 32785 - protein, 121 aa, Artificial Sequence; identical to SEQ ID NO: 22505
  Description of Artificial Sequence: Synthetic polypeptide
  VH of XENP022601

SEQ ID NO: 32786 - protein, 5 aa, Artificial Sequence
  Description of Artificial Sequence: Synthetic peptide
  XENP022601 vhCDR1
DAWMG

SEQ ID NO: 32787 - protein, 19 aa, Artificial Sequence
  Description of Artificial Sequence: Synthetic peptide
  XENP022601 vhCDR2
EISTKANNHATYYAESVKG

SEQ ID NO: 32788 - protein, 10 aa, Artificial Sequence
  Description of Artificial Sequence: Synthetic peptide
  XENP022601 vhCDR3
LATWDWYFDV

SEQ ID NO: 32789 - protein, 218 aa, Artificial Sequence; identical to SEQ ID NO: 22619
  Description of Artificial Sequence: Synthetic polypeptide
  XENP022601 7G8_H3.33_L1.36_Fab Light Chain

SEQ ID NO: 32790 - protein, 111 aa, Artificial Sequence; identical to SEQ ID NO: 22620
  Description of Artificial Sequence: Synthetic polypeptide
  VL of XENP022601

SEQ ID NO: 32791 - protein, 15 aa, Artificial Sequence
  Description of Artificial Sequence: Synthetic peptide
  XENP022601 vlCDR1
RASQSVDHDGDSYMN

SEQ ID NO: 32792 - protein, 7 aa, Artificial Sequence
  Description of Artificial Sequence: Synthetic peptide
  XENP022601 vlCDR2
AASELES

SEQ ID NO: 32793 - protein, 9 aa, Artificial Sequence
  Description of Artificial Sequence: Synthetic peptide
  XENP022601 vlCDR3
QQSNEDPFT

SEQ ID NO: 32794 - protein, 447 aa, Artificial Sequence; identical to SEQ ID NO: 22064
  Description of Artificial Sequence: Synthetic polypeptide
  XENP022511 2A11_H1.125_L2.113-one-arm Fab-Fc Heavy Chain

SEQ ID NO: 32795 - protein, 118 aa, Artificial Sequence; identical to SEQ ID NO: 22065
  Description of Artificial Sequence: Synthetic polypeptide
  VH of XENP022511

SEQ ID NO: 32796 - protein, 5 aa, Artificial Sequence
  Description of Artificial Sequence: Synthetic peptide
  XENP022511 vhCDR1
HYFMH

SEQ ID NO: 32797 - protein, 17 aa, Artificial Sequence
  Description of Artificial Sequence: Synthetic peptide
  XENP022511 vhCDR2
WIDPYLGDTEYAPKFQG

SEQ ID NO: 32798 - protein, 9 aa, Artificial Sequence
  Description of Artificial Sequence: Synthetic peptide
  XENP022511 vhCDR3
RGVYQALDY

SEQ ID NO: 32799 - protein, 231 aa, Artificial Sequence
  Description of Artificial Sequence: Synthetic polypeptide
  XENP022511 2A11_H1.125_L2.113-one-arm Fc only Heavy Chain
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32800 - protein, 214 aa, Artificial Sequence; identical to SEQ ID NO: 22079
  Description of Artificial Sequence: Synthetic polypeptide
  XENP022511 2A11_H1.125_L2.113-one-arm Light Chain

SEQ ID NO: 32801 - protein, 107 aa, Artificial Sequence; identical to SEQ ID NO: 22080
  Description of Artificial Sequence: Synthetic polypeptide
  VL of XENP022511

SEQ ID NO: 32802 - protein, 11 aa, Artificial Sequence
  Description of Artificial Sequence: Synthetic peptide
  XENP022511 vlCDR1
QASQDIGNYLN

SEQ ID NO: 32803 - protein, 7 aa, Artificial Sequence
  Description of Artificial Sequence: Synthetic peptide
  XENP022511 vlCDR2
FTSYLHS

SEQ ID NO: 32804 - protein, 9 aa, Artificial Sequence
  Description of Artificial Sequence: Synthetic peptide
  XENP022511 vlCDR3
QQGNTLPYT

SEQ ID NO: 32805 - protein, 447 aa, Artificial Sequence; identical to SEQ ID NO: 22084
  Description of Artificial Sequence: Synthetic polypeptide
  XENP022512 2A11_H1.144_L2.113-one-arm Fab-Fc Heavy Chain

SEQ ID NO: 32806 - protein, 118 aa, Artificial Sequence; identical to SEQ ID NO: 22085
  Description of Artificial Sequence: Synthetic polypeptide
  VH of XENP022512

SEQ ID NO: 32807 - protein, 5 aa, Artificial Sequence
  Description of Artificial Sequence: Synthetic peptide
  XENP022512 vhCDR1
DYFMH

SEQ ID NO: 32808 - protein, 17 aa, Artificial Sequence
  Description of Artificial Sequence: Synthetic peptide
  XENP022512 vhCDR2
WIDPELGDTEYAPKFQG

SEQ ID NO: 32809 - protein, 9 aa, Artificial Sequence
  Description of Artificial Sequence: Synthetic peptide
  XENP022512 vhCDR3
RGVYQALDY

SEQ ID NO: 32810 - protein, 231 aa, Artificial Sequence; identical to SEQ ID NO: 32799
  Description of Artificial Sequence: Synthetic polypeptide
  XENP022512 2A11_H1.144_L2.113-one-arm Fc only Heavy Chain

SEQ ID NO: 32811 - protein, 214 aa, Artificial Sequence; identical to SEQ ID NO: 22079
  Description of Artificial Sequence: Synthetic polypeptide
  XENP022512 2A11_H1.144_L2.113-one-arm Light Chain

SEQ ID NO: 32812 - protein, 107 aa, Artificial Sequence; identical to SEQ ID NO: 22080
  Description of Artificial Sequence: Synthetic polypeptide
  VL of XENP022512

SEQ ID NO: 32813 - protein, 11 aa, Artificial Sequence
  Description of Artificial Sequence: Synthetic peptide
  XENP022512 vlCDR1
QASQDIGNYLN

SEQ ID NO: 32814 - protein, 7 aa, Artificial Sequence
  Description of Artificial Sequence: Synthetic peptide
  XENP022512 vlCDR2
FTSYLHS

SEQ ID NO: 32815 - protein, 9 aa, Artificial Sequence
  Description of Artificial Sequence: Synthetic peptide
  XENP022512 vlCDR3
QQGNTLPYT

SEQ ID NO: 32816 - protein, 447 aa, Artificial Sequence; identical to SEQ ID NO: 22104
  Description of Artificial Sequence: Synthetic polypeptide
  XENP022513 2A11_H1.117_L2.116-one-arm Fab-Fc Heavy Chain

SEQ ID NO: 32817 - protein, 118 aa, Artificial Sequence; identical to SEQ ID NO: 22105
  Description of Artificial Sequence: Synthetic polypeptide
  VH of XENP022513

SEQ ID NO: 32818 - protein, 5 aa, Artificial Sequence
  Description of Artificial Sequence: Synthetic peptide
  XENP022513 vhCDR1
HYFMH

SEQ ID NO: 32819 - protein, 17 aa, Artificial Sequence
  Description of Artificial Sequence: Synthetic peptide
  XENP022513 vhCDR2
WIDPYLGDTEYAPKFQG

SEQ ID NO: 32820 - protein, 9 aa, Artificial Sequence
  Description of Artificial Sequence: Synthetic peptide
  XENP022513 vhCDR3
RGVRQALDY

SEQ ID NO: 32821 - protein, 231 aa, Artificial Sequence; identical to SEQ ID NO: 32799
  Description of Artificial Sequence: Synthetic polypeptide
  XENP022513 2A11_H1.117_L2.116-one-arm Fc only Heavy Chain

SEQ ID NO: 32822 - protein, 214 aa, Artificial Sequence; identical to SEQ ID NO: 22119
  Description of Artificial Sequence: Synthetic polypeptide
  XENP022513 2A11_H1.117_L2.116-one-arm Light Chain

SEQ ID NO: 32823 - protein, 107 aa, Artificial Sequence; identical to SEQ ID NO: 22120
  Description of Artificial Sequence: Synthetic polypeptide
  VL of XENP022513

SEQ ID NO: 32824 - protein, 11 aa, Artificial Sequence
  Description of Artificial Sequence: Synthetic peptide
  XENP022513 vlCDR1
QASQDIGNYLN

SEQ ID NO: 32825 - protein, 7 aa, Artificial Sequence
  Description of Artificial Sequence: Synthetic peptide
  XENP022513 vlCDR2
FTSHLHS

SEQ ID NO: 32826 - protein, 9 aa, Artificial Sequence
  Description of Artificial Sequence: Synthetic peptide
  XENP022513 vlCDR3
QQGHQLPYT

SEQ ID NO: 32827 - protein, 447 aa, Artificial Sequence; identical to SEQ ID NO: 22084
  Description of Artificial Sequence: Synthetic polypeptide
  XENP022514 2A11_H1.144_L2-one-arm Fab-Fc Heavy Chain

SEQ ID NO: 32828 - protein, 118 aa, Artificial Sequence; identical to SEQ ID NO: 22085
  Description of Artificial Sequence: Synthetic polypeptide
  VH of XENP022514

SEQ ID NO: 32829 - protein, 5 aa, Artificial Sequence
  Description of Artificial Sequence: Synthetic peptide
  XENP022514 vhCDR1
DYFMH

SEQ ID NO: 32830 - protein, 17 aa, Artificial Sequence
  Description of Artificial Sequence: Synthetic peptide
  XENP022514 vhCDR2
WIDPELGDTEYAPKFQG

SEQ ID NO: 32831 - protein, 9 aa, Artificial Sequence
  Description of Artificial Sequence: Synthetic peptide
  XENP022514 vhCDR3
RGVYQALDY

SEQ ID NO: 32832 - protein, 231 aa, Artificial Sequence; identical to SEQ ID NO: 32799
  Description of Artificial Sequence: Synthetic polypeptide
  XENP022514 2A11_H1.144_L2-one-arm Fc only Heavy Chain

SEQ ID NO: 32833 - protein, 214 aa, Artificial Sequence; identical to SEQ ID NO: 17250
  Description of Artificial Sequence: Synthetic polypeptide
  XENP022514 2A11_H1.144_L2-one-arm Light Chain

SEQ ID NO: 32834 - protein, 107 aa, Artificial Sequence; identical to SEQ ID NO: 17251
  Description of Artificial Sequence: Synthetic polypeptide
  VL of XENP022514

SEQ ID NO: 32835 - protein, 11 aa, Artificial Sequence
  Description of Artificial Sequence: Synthetic peptide
  XENP022514 vlCDR1
QASQDIGNYLN

SEQ ID NO: 32836 - protein, 7 aa, Artificial Sequence
  Description of Artificial Sequence: Synthetic peptide
  XENP022514 vlCDR2
YTSRLHS

SEQ ID NO: 32837 - protein, 9 aa, Artificial Sequence
  Description of Artificial Sequence: Synthetic peptide
  XENP022514 vlCDR3
QQGNTLPYT

SEQ ID NO: 32838 - protein, 447 aa, Artificial Sequence; identical to SEQ ID NO: 17235
  Description of Artificial Sequence: Synthetic polypeptide
  XENP022515 2A11_H1_L2.113-one-arm Fab-Fc Heavy Chain

SEQ ID NO: 32839 - protein, 118 aa, Artificial Sequence; identical to SEQ ID NO: 17236
  Description of Artificial Sequence: Synthetic polypeptide
  VH of XENP022515

SEQ ID NO: 32840 - protein, 5 aa, Artificial Sequence
  Description of Artificial Sequence: Synthetic peptide
  XENP022515 vhCDR1
DYYMH

SEQ ID NO: 32841 - protein, 17 aa, Artificial Sequence
  Description of Artificial Sequence: Synthetic peptide
  XENP022515 vhCDR2
WIDPENGDTEYAPKFQG

SEQ ID NO: 32842 - protein, 9 aa, Artificial Sequence
  Description of Artificial Sequence: Synthetic peptide
  XENP022515 vhCDR3
RGVRQALDY

SEQ ID NO: 32843 - protein, 231 aa, Artificial Sequence; identical to SEQ ID NO: 32799
  Description of Artificial Sequence: Synthetic polypeptide
  XENP022515 2A11_H1_L2.113-one-arm Fc only Heavy Chain

SEQ ID NO: 32844 - protein, 214 aa, Artificial Sequence; identical to SEQ ID NO: 22079
  Description of Artificial Sequence: Synthetic polypeptide
  XENP022515 2A11_H1_L2.113-one-arm Light Chain

SEQ ID NO: 32845 - protein, 107 aa, Artificial Sequence; identical to SEQ ID NO: 22080
  Description of Artificial Sequence: Synthetic polypeptide
  VL of XENP022515

SEQ ID NO: 32846 - protein, 11 aa, Artificial Sequence
  Description of Artificial Sequence: Synthetic peptide
  XENP022515 vlCDR1
QASQDIGNYLN

SEQ ID NO: 32847 - protein, 7 aa, Artificial Sequence
  Description of Artificial Sequence: Synthetic peptide
  XENP022515 vlCDR2
FTSYLHS

SEQ ID NO: 32848 - protein, 9 aa, Artificial Sequence
  Description of Artificial Sequence: Synthetic peptide
  XENP022515 vlCDR3
QQGNTLPYT

SEQ ID NO: 32849 - protein, 447 aa, Artificial Sequence; identical to SEQ ID NO: 17235
  Description of Artificial Sequence: Synthetic polypeptide
  XENP022516 2A11_H1L2-one-arm Fab-Fc Heavy Chain

SEQ ID NO: 32850 - protein, 118 aa, Artificial Sequence; identical to SEQ ID NO: 17236
  Description of Artificial Sequence: Synthetic polypeptide
  VH of XENP022516

SEQ ID NO: 32851 - protein, 5 aa, Artificial Sequence
  Description of Artificial Sequence: Synthetic peptide
  XENP022516 vhCDR1
DYYMH

SEQ ID NO: 32852 - protein, 17 aa, Artificial Sequence
  Description of Artificial Sequence: Synthetic peptide
  XENP022516 vhCDR2
WIDPENGDTEYAPKFQG

SEQ ID NO: 32853 - protein, 9 aa, Artificial Sequence
  Description of Artificial Sequence: Synthetic peptide
  XENP022516 vhCDR3
RGVRQALDY

SEQ ID NO: 32854 - protein, 231 aa, Artificial Sequence; identical to SEQ ID NO: 32799
  Description of Artificial Sequence: Synthetic polypeptide
  XENP022516 2A11_H1L2-one-arm Fc only Heavy Chain

SEQ ID NO: 32855 - protein, 214 aa, Artificial Sequence; identical to SEQ ID NO: 17250
  Description of Artificial Sequence: Synthetic polypeptide
  XENP022516 2A11_H1L2-one-arm Light Chain

SEQ ID NO: 32856 - protein, 107 aa, Artificial Sequence; identical to SEQ ID NO: 17251
  Description of Artificial Sequence: Synthetic polypeptide
  VL of XENP022516

SEQ ID NO: 32857 - protein, 11 aa, Artificial Sequence
  Description of Artificial Sequence: Synthetic peptide
  XENP022516 vlCDR1
QASQDIGNYLN

SEQ ID NO: 32858 - protein, 7 aa, Artificial Sequence
  Description of Artificial Sequence: Synthetic peptide
  XENP022516 vlCDR2
YTSRLHS

SEQ ID NO: 32859 - protein, 9 aa, Artificial Sequence
  Description of Artificial Sequence: Synthetic peptide
  XENP022516 vlCDR3
QQGNTLPYT

SEQ ID NO: 32860 - protein, 447 aa, Artificial Sequence; identical to SEQ ID NO: 17235
  Description of Artificial Sequence: Synthetic polypeptide
  XENP022517 2A11_H1_L2.25-one-arm Fab-Fc Heavy Chain

SEQ ID NO: 32861 - protein, 118 aa, Artificial Sequence; identical to SEQ ID NO: 17236
  Description of Artificial Sequence: Synthetic polypeptide
  VH of XENP022517

SEQ ID NO: 32862 - protein, 5 aa, Artificial Sequence
  Description of Artificial Sequence: Synthetic peptide
  XENP022517 vhCDR1
DYYMH

SEQ ID NO: 32863 - protein, 17 aa, Artificial Sequence
  Description of Artificial Sequence: Synthetic peptide
  XENP022517 vhCDR2
WIDPENGDTEYAPKFQG

SEQ ID NO: 32864 - protein, 9 aa, Artificial Sequence
  Description of Artificial Sequence: Synthetic peptide
  XENP022517 vhCDR3
RGVRQALDY

SEQ ID NO: 32865 - protein, 231 aa, Artificial Sequence; identical to SEQ ID NO: 32799
  Description of Artificial Sequence: Synthetic polypeptide
  XENP022517 2A11_H1_L2.25-one-arm Fc only Heavy Chain

SEQ ID NO: 32866 - protein, 214 aa, Artificial Sequence; identical to SEQ ID NO: 22179
  Description of Artificial Sequence: Synthetic polypeptide
  XENP022517 2A11_H1_L2.25-one-arm Light Chain

SEQ ID NO: 32867 - protein, 107 aa, Artificial Sequence; identical to SEQ ID NO: 22180
  Description of Artificial Sequence: Synthetic polypeptide
  VL of XENP022517

SEQ ID NO: 32868 - protein, 11 aa, Artificial Sequence
  Description of Artificial Sequence: Synthetic peptide
  XENP022517 vlCDR1
QASQDIGNHLN

SEQ ID NO: 32869 - protein, 7 aa, Artificial Sequence
  Description of Artificial Sequence: Synthetic peptide
  XENP022517 vlCDR2
YTSRLHS

SEQ ID NO: 32870 - protein, 9 aa, Artificial Sequence
  Description of Artificial Sequence: Synthetic peptide
  XENP022517 vlCDR3
QQGNTLPYT

SEQ ID NO: 32871 - protein, 447 aa, Artificial Sequence; identical to SEQ ID NO: 22064
  Description of Artificial Sequence: Synthetic polypeptide
  XENP022674 2A11_H1.125_L2.126-one-arm Fab-Fc Heavy Chain

SEQ ID NO: 32872 - protein, 118 aa, Artificial Sequence; identical to SEQ ID NO: 22065
  Description of Artificial Sequence: Synthetic polypeptide
  VH of XENP022674

SEQ ID NO: 32873 - protein, 5 aa, Artificial Sequence
  Description of Artificial Sequence: Synthetic peptide
  XENP022674 vhCDR1
HYFMH

SEQ ID NO: 32874 - protein, 17 aa, Artificial Sequence
  Description of Artificial Sequence: Synthetic peptide
  XENP022674 vhCDR2
WIDPYLGDTEYAPKFQG

SEQ ID NO: 32875 - protein, 9 aa, Artificial Sequence
  Description of Artificial Sequence: Synthetic peptide
  XENP022674 vhCDR3
RGVYQALDY

SEQ ID NO: 32876 - protein, 231 aa, Artificial Sequence; identical to SEQ ID NO: 32799
  Description of Artificial Sequence: Synthetic polypeptide
  XENP022674 2A11_H1.125_L2.126-one-arm Fc only Heavy Chain

SEQ ID NO: 32877 - protein, 214 aa, Artificial Sequence; identical to SEQ ID NO: 22259
  Description of Artificial Sequence: Synthetic polypeptide
  XENP022674 2A11_H1.125_L2.126-one-arm Light Chain

SEQ ID NO: 32878 - protein, 107 aa, Artificial Sequence; identical to SEQ ID NO: 22260
  Description of Artificial Sequence: Synthetic polypeptide
  VL of XENP022674

SEQ ID NO: 32879 - protein, 11 aa, Artificial Sequence
  Description of Artificial Sequence: Synthetic peptide
  XENP022674 vlCDR1
QASQDIGNYLN

SEQ ID NO: 32880 - protein, 7 aa, Artificial Sequence
  Description of Artificial Sequence: Synthetic peptide
  XENP022674 vlCDR2
FTSYLHS

SEQ ID NO: 32881 - protein, 9 aa, Artificial Sequence
  Description of Artificial Sequence: Synthetic peptide
  XENP022674 vlCDR3
QEGNTLPYT

SEQ ID NO: 32882 - protein, 447 aa, Artificial Sequence; identical to SEQ ID NO: 22084
  Description of Artificial Sequence: Synthetic polypeptide
  XENP022676 2A11_H1.144_L2.142-one-arm Fab-Fc Heavy Chain

SEQ ID NO: 32883 - protein, 118 aa, Artificial Sequence; identical to SEQ ID NO: 22085
  Description of Artificial Sequence: Synthetic polypeptide
  VH of XENP022676

SEQ ID NO: 32884 - protein, 5 aa, Artificial Sequence
  Description of Artificial Sequence: Synthetic peptide
  XENP022676 vhCDR1
DYFMH

SEQ ID NO: 32885 - protein, 17 aa, Artificial Sequence
  Description of Artificial Sequence: Synthetic peptide
  XENP022676 vhCDR2
WIDPELGDTEYAPKFQG

SEQ ID NO: 32886 - protein, 9 aa, Artificial Sequence
  Description of Artificial Sequence: Synthetic peptide
  XENP022676 vhCDR3
RGVYQALDY

SEQ ID NO: 32887 - protein, 231 aa, Artificial Sequence; identical to SEQ ID NO: 32799
  Description of Artificial Sequence: Synthetic polypeptide
  XENP022676 2A11_H1.144_L2.142-one-arm Fc only Heavy Chain

SEQ ID NO: 32888 - protein, 214 aa, Artificial Sequence; identical to SEQ ID NO: 22279
  Description of Artificial Sequence: Synthetic polypeptide
  XENP022676 2A11_H1.144_L2.142-one-arm Light Chain

SEQ ID NO: 32889 - protein, 107 aa, Artificial Sequence; identical to SEQ ID NO: 22280
  Description of Artificial Sequence: Synthetic polypeptide
  VL of XENP022676

SEQ ID NO: 32890 - protein, 11 aa, Artificial Sequence
  Description of Artificial Sequence: Synthetic peptide
  XENP022676 vlCDR1
QASQDIGNYLN

SEQ ID NO: 32891 - protein, 7 aa, Artificial Sequence
  Description of Artificial Sequence: Synthetic peptide
  XENP022676 vlCDR2
FTSYLHS

SEQ ID NO: 32892 - protein, 9 aa, Artificial Sequence
  Description of Artificial Sequence: Synthetic peptide
  XENP022676 vlCDR3
QQGNTLPYT

SEQ ID NO: 32893 - protein, 450 aa, Artificial Sequence; identical to SEQ ID NO: 22324
  Description of Artificial Sequence: Synthetic polypeptide
  XENP022519 7G8_H3.18_L1.11-one-arm Fab-Fc Heavy Chain

SEQ ID NO: 32894 - protein, 121 aa, Artificial Sequence; identical to SEQ ID NO: 22325
  Description of Artificial Sequence: Synthetic polypeptide
  VH of XENP022519

SEQ ID NO: 32895 - protein, 5 aa, Artificial Sequence
  Description of Artificial Sequence: Synthetic peptide
  XENP022519 vhCDR1
DAWMD

SEQ ID NO: 32896 - protein, 19 aa, Artificial Sequence
  Description of Artificial Sequence: Synthetic peptide
  XENP022519 vhCDR2
EISTKANNHATYYAESVKG

SEQ ID NO: 32897 - protein, 10 aa, Artificial Sequence
  Description of Artificial Sequence: Synthetic peptide
  XENP022519 vhCDR3
LATWDWYFDV

SEQ ID NO: 32898 - protein, 231 aa, Artificial Sequence; identical to SEQ ID NO: 32799
  Description of Artificial Sequence: Synthetic polypeptide
  XENP022519 7G8_H3.18_L1.11-one-arm Fc-only Heavy Chain

SEQ ID NO: 32899 - protein, 218 aa, Artificial Sequence; identical to SEQ ID NO: 22359
  Description of Artificial Sequence: Synthetic polypeptide
  XENP022519 7G8_H3.18_L1.11-one-arm Light Chain

SEQ ID NO: 32900 - protein, 111 aa, Artificial Sequence; identical to SEQ ID NO: 22360
  Description of Artificial Sequence: Synthetic polypeptide
  VL of XENP022519

SEQ ID NO: 32901 - protein, 15 aa, Artificial Sequence
  Description of Artificial Sequence: Synthetic peptide
  XENP022519 vlCDR1
RASQSVDYDGDSYMN

SEQ ID NO: 32902 - protein, 7 aa, Artificial Sequence
  Description of Artificial Sequence: Synthetic peptide
  XENP022519 vlCDR2
AASELES

SEQ ID NO: 32903 - protein, 9 aa, Artificial Sequence
  Description of Artificial Sequence: Synthetic peptide
  XENP022519 vlCDR3
QQSNEDPFT

SEQ ID NO: 32904 - protein, 450 aa, Artificial Sequence; identical to SEQ ID NO: 22424
  Description of Artificial Sequence: Synthetic polypeptide
  XENP022520 7G8_H3.28_L1.13-one-arm Fab-Fc Heavy Chain

SEQ ID NO: 32905 - protein, 121 aa, Artificial Sequence; identical to SEQ ID NO: 22425
  Description of Artificial Sequence: Synthetic polypeptide
  VH of XENP022520

SEQ ID NO: 32906 - protein, 5 aa, Artificial Sequence
  Description of Artificial Sequence: Synthetic peptide
  XENP022520 vhCDR1
DAWMD

SEQ ID NO: 32907 - protein, 19 aa, Artificial Sequence
  Description of Artificial Sequence: Synthetic peptide
  XENP022520 vhCDR2
EISTKAYNHATYYAESVKG

SEQ ID NO: 32908 - protein, 10 aa, Artificial Sequence
  Description of Artificial Sequence: Synthetic peptide
  XENP022520 vhCDR3
LATWDWYFDV

SEQ ID NO: 32909 - protein, 231 aa, Artificial Sequence; identical to SEQ ID NO: 32799
  Description of Artificial Sequence: Synthetic polypeptide
  XENP022520 7G8_H3.28_L1.13-one-arm Fc-only Heavy Chain

SEQ ID NO: 32910 - protein, 218 aa, Artificial Sequence; identical to SEQ ID NO: 22419
  Description of Artificial Sequence: Synthetic polypeptide
  XENP022520 7G8_H3.28_L1.13-one-arm Light Chain

SEQ ID NO: 32911 - protein, 111 aa, Artificial Sequence; identical to SEQ ID NO: 22420
  Description of Artificial Sequence: Synthetic polypeptide
  VL of XENP022520

SEQ ID NO: 32912 - protein, 15 aa, Artificial Sequence
  Description of Artificial Sequence: Synthetic peptide
  XENP022520 vlCDR1
RASQSVDHDGDSYMN

SEQ ID NO: 32913 - protein, 7 aa, Artificial Sequence
  Description of Artificial Sequence: Synthetic peptide
  XENP022520 vlCDR2
AASELES

SEQ ID NO: 32914 - protein, 9 aa, Artificial Sequence
  Description of Artificial Sequence: Synthetic peptide
  XENP022520 vlCDR3
QQSNEDPFT

SEQ ID NO: 32915 - protein, 450 aa, Artificial Sequence; identical to SEQ ID NO: 22484
  Description of Artificial Sequence: Synthetic polypeptide
  XENP022560 7G8_H3.30_L1.11-one-arm Fab-Fc Heavy Chain

SEQ ID NO: 32916 - protein, 121 aa, Artificial Sequence; identical to SEQ ID NO: 22485
  Description of Artificial Sequence: Synthetic polypeptide
  VH of XENP022560

SEQ ID NO: 32917 - protein, 5 aa, Artificial Sequence
  Description of Artificial Sequence: Synthetic peptide
  XENP022560 vhCDR1
DAWMS

SEQ ID NO: 32918 - protein, 19 aa, Artificial Sequence
  Description of Artificial Sequence: Synthetic peptide
  XENP022560 vhCDR2
EISTKANNHATYYAESVKG

SEQ ID NO: 32919 - protein, 10 aa, Artificial Sequence
  Description of Artificial Sequence: Synthetic peptide
  XENP022560 vhCDR3
LATWDWYFDV

SEQ ID NO: 32920 - protein, 231 aa, Artificial Sequence; identical to SEQ ID NO: 32799
  Description of Artificial Sequence: Synthetic polypeptide
  XENP022560 7G8_H3.30_L1.11-one-arm Fc-only Heavy Chain

SEQ ID NO: 32921 - protein, 218 aa, Artificial Sequence; identical to SEQ ID NO: 22359
  Description of Artificial Sequence: Synthetic polypeptide
  XENP022560 7G8_H3.30_L1.11-one-arm Light Chain

SEQ ID NO: 32922 - protein, 111 aa, Artificial Sequence; identical to SEQ ID NO: 22360
  Description of Artificial Sequence: Synthetic polypeptide
  VL of XENP022560

SEQ ID NO: 32923 - protein, 15 aa, Artificial Sequence
  Description of Artificial Sequence: Synthetic peptide
  XENP022560 vlCDR1
RASQSVDYDGDSYMN

SEQ ID NO: 32924 - protein, 7 aa, Artificial Sequence
  Description of Artificial Sequence: Synthetic peptide
  XENP022560 vlCDR2
AASELES

SEQ ID NO: 32925 - protein, 9 aa, Artificial Sequence
  Description of Artificial Sequence: Synthetic peptide
  XENP022560 vlCDR3
QQSNEDPFT

SEQ ID NO: 32926 - protein, 450 aa, Artificial Sequence; identical to SEQ ID NO: 22504
  Description of Artificial Sequence: Synthetic polypeptide
  XENP022561 7G8_H3.33_L1.11-one-arm Fab-Fc Heavy Chain

SEQ ID NO: 32927 - protein, 121 aa, Artificial Sequence; identical to SEQ ID NO: 22505
  Description of Artificial Sequence: Synthetic polypeptide
  VH of XENP022561

SEQ ID NO: 32928 - protein, 5 aa, Artificial Sequence
  Description of Artificial Sequence: Synthetic peptide
  XENP022561 vhCDR1
DAWMG

SEQ ID NO: 32929 - protein, 19 aa, Artificial Sequence
  Description of Artificial Sequence: Synthetic peptide
  XENP022561 vhCDR2
EISTKANNHATYYAESVKG

SEQ ID NO: 32930 - protein, 10 aa, Artificial Sequence
  Description of Artificial Sequence: Synthetic peptide
  XENP022561 vhCDR3
LATWDWYFDV

SEQ ID NO: 32931 - protein, 231 aa, Artificial Sequence; identical to SEQ ID NO: 32799
  Description of Artificial Sequence: Synthetic polypeptide
  XENP022561 7G8_H3.33_L1.11-one-arm Fc-only Heavy Chain

SEQ ID NO: 32932 - protein, 218 aa, Artificial Sequence; identical to SEQ ID NO: 22359
  Description of Artificial Sequence: Synthetic polypeptide
  XENP022561 7G8_H3.33_L1.11-one-arm Light Chain

SEQ ID NO: 32933 - protein, 111 aa, Artificial Sequence; identical to SEQ ID NO: 22360
  Description of Artificial Sequence: Synthetic polypeptide
  VL of XENP022561

SEQ ID NO: 32934 - protein, 15 aa, Artificial Sequence
  Description of Artificial Sequence: Synthetic peptide
  XENP022561 vlCDR1
RASQSVDYDGDSYMN

SEQ ID NO: 32935 - protein, 7 aa, Artificial Sequence
  Description of Artificial Sequence: Synthetic peptide
  XENP022561 vlCDR2
AASELES

SEQ ID NO: 32936 - protein, 9 aa, Artificial Sequence
  Description of Artificial Sequence: Synthetic peptide
  XENP022561 vlCDR3
QQSNEDPFT

SEQ ID NO: 32937 - protein, 450 aa, Artificial Sequence; identical to SEQ ID NO: 22324
  Description of Artificial Sequence: Synthetic polypeptide
  XENP022562 7G8_H3.18_L1.30-one-arm Fab-Fc Heavy Chain

SEQ ID NO: 32938 - protein, 121 aa, Artificial Sequence; identical to SEQ ID NO: 22325
  Description of Artificial Sequence: Synthetic polypeptide
  VH of XENP022562

SEQ ID NO: 32939 - protein, 5 aa, Artificial Sequence
  Description of Artificial Sequence: Synthetic peptide
  XENP022562 vhCDR1
DAWMD

SEQ ID NO: 32940 - protein, 19 aa, Artificial Sequence
  Description of Artificial Sequence: Synthetic peptide
  XENP022562 vhCDR2
EISTKANNHATYYAESVKG

SEQ ID NO: 32941 - protein, 10 aa, Artificial Sequence
  Description of Artificial Sequence: Synthetic peptide
  XENP022562 vhCDR3
LATWDWYFDV

SEQ ID NO: 32942 - protein, 231 aa, Artificial Sequence; identical to SEQ ID NO: 32799
  Description of Artificial Sequence: Synthetic polypeptide
  XENP022562 7G8_H3.18_L1.30_[Anti-LAG-3]_Fab-empty_Fc(216)_Ig G1_PVA_/S267K_pI(-)_Isosteric_A_L368D/K370S-IgG1_ISO(+RR)_C220S /S364K/E357Q Heavy-scFv Chain

SEQ ID NO: 32943 - protein, 218 aa, Artificial Sequence; identical to SEQ ID NO: 22539
  Description of Artificial Sequence: Synthetic polypeptide
  XENP022562 7G8_H3.18_L1.30-one-arm Light Chain

SEQ ID NO: 32944 - protein, 111 aa, Artificial Sequence; identical to SEQ ID NO: 22540
  Description of Artificial Sequence: Synthetic polypeptide
  VL of XENP022562

SEQ ID NO: 32945 - protein, 15 aa, Artificial Sequence
  Description of Artificial Sequence: Synthetic peptide
  XENP022562 vlCDR1
RASQSVDYDGDSYMN

SEQ ID NO: 32946 - protein, 7 aa, Artificial Sequence
  Description of Artificial Sequence: Synthetic peptide
  XENP022562 vlCDR2
AASELES

SEQ ID NO: 32947 - protein, 9 aa, Artificial Sequence
  Description of Artificial Sequence: Synthetic peptide
  XENP022562 vlCDR3
QQSNEDPFT

SEQ ID NO: 32948 - protein, 450 aa, Artificial Sequence; identical to SEQ ID NO: 22484
  Description of Artificial Sequence: Synthetic polypeptide
  XENP022563 7G8_H3.30_L1.30-one-arm Fab-Fc Heavy Chain

SEQ ID NO: 32949 - protein, 121 aa, Artificial Sequence; identical to SEQ ID NO: 22485
  Description of Artificial Sequence: Synthetic polypeptide
  VH of XENP022563

SEQ ID NO: 32950 - protein, 5 aa, Artificial Sequence
  Description of Artificial Sequence: Synthetic peptide
  XENP022563 vhCDR1
DAWMS

SEQ ID NO: 32951 - protein, 19 aa, Artificial Sequence
  Description of Artificial Sequence: Synthetic peptide
  XENP022563 vhCDR2
EISTKANNHATYYAESVKG

SEQ ID NO: 32952 - protein, 10 aa, Artificial Sequence
  Description of Artificial Sequence: Synthetic peptide
  XENP022563 vhCDR3
LATWDWYFDV

SEQ ID NO: 32953 - protein, 231 aa, Artificial Sequence; identical to SEQ ID NO: 32799
  Description of Artificial Sequence: Synthetic polypeptide
  XENP022563 7G8_H3.30_L1.30-one-arm Fc-only Heavy Chain

SEQ ID NO: 32954 - protein, 218 aa, Artificial Sequence; identical to SEQ ID NO: 22539
  Description of Artificial Sequence: Synthetic polypeptide
  XENP022563 7G8_H3.30_L1.30-one-arm Light Chain

SEQ ID NO: 32955 - protein, 111 aa, Artificial Sequence; identical to SEQ ID NO: 22540
  Description of Artificial Sequence: Synthetic polypeptide
  VL of XENP022563

SEQ ID NO: 32956 - protein, 15 aa, Artificial Sequence
  Description of Artificial Sequence: Synthetic peptide
  XENP022563 vlCDR1
RASQSVDYDGDSYMN

SEQ ID NO: 32957 - protein, 7 aa, Artificial Sequence
  Description of Artificial Sequence: Synthetic peptide
  XENP022563 vlCDR2
AASELES

SEQ ID NO: 32958 - protein, 9 aa, Artificial Sequence
  Description of Artificial Sequence: Synthetic peptide
  XENP022563 vlCDR3
QQSNEDPFT

SEQ ID NO: 32959 - protein, 450 aa, Artificial Sequence; identical to SEQ ID NO: 22504
  Description of Artificial Sequence: Synthetic polypeptide
  XENP022564 7G8_H3.33_L1.30-one-arm Fab-Fc Heavy Chain

SEQ ID NO: 32960 - protein, 121 aa, Artificial Sequence; identical to SEQ ID NO: 22505
  Description of Artificial Sequence: Synthetic polypeptide
  VH of XENP022564

SEQ ID NO: 32961 - protein, 5 aa, Artificial Sequence
  Description of Artificial Sequence: Synthetic peptide
  XENP022564 vhCDR1
DAWMG

SEQ ID NO: 32962 - protein, 19 aa, Artificial Sequence
  Description of Artificial Sequence: Synthetic peptide
  XENP022564 vhCDR2
EISTKANNHATYYAESVKG

SEQ ID NO: 32963 - protein, 10 aa, Artificial Sequence
  Description of Artificial Sequence: Synthetic peptide
  XENP022564 vhCDR3
LATWDWYFDV

SEQ ID NO: 32964 - protein, 231 aa, Artificial Sequence; identical to SEQ ID NO: 32799
  Description of Artificial Sequence: Synthetic polypeptide
  XENP022564 7G8_H3.33_L1.30-one-arm Fc-only Heavy Chain

SEQ ID NO: 32965 - protein, 218 aa, Artificial Sequence; identical to SEQ ID NO: 22539
  Description of Artificial Sequence: Synthetic polypeptide
  XENP022564 7G8_H3.33_L1.30-one-arm Light Chain

SEQ ID NO: 32966 - protein, 111 aa, Artificial Sequence; identical to SEQ ID NO: 22540
  Description of Artificial Sequence: Synthetic polypeptide
  VL of XENP022564

SEQ ID NO: 32967 - protein, 15 aa, Artificial Sequence
  Description of Artificial Sequence: Synthetic peptide
  XENP022564 vlCDR1
RASQSVDYDGDSYMN

SEQ ID NO: 32968 - protein, 7 aa, Artificial Sequence
  Description of Artificial Sequence: Synthetic peptide
  XENP022564 vlCDR2
AASELES

SEQ ID NO: 32969 - protein, 9 aa, Artificial Sequence
  Description of Artificial Sequence: Synthetic peptide
  XENP022564 vlCDR3
QQSNEDPFT

SEQ ID NO: 32970 - protein, 450 aa, Artificial Sequence; identical to SEQ ID NO: 22484
  Description of Artificial Sequence: Synthetic polypeptide
  XENP022606 7G8_H3.30_L1.34-one-arm Fab-Fc Heavy Chain

SEQ ID NO: 32971 - protein, 121 aa, Artificial Sequence; identical to SEQ ID NO: 22485
  Description of Artificial Sequence: Synthetic polypeptide
  VH of XENP022606

SEQ ID NO: 32972 - protein, 5 aa, Artificial Sequence
  Description of Artificial Sequence: Synthetic peptide
  XENP022606 vhCDR1
DAWMS

SEQ ID NO: 32973 - protein, 19 aa, Artificial Sequence
  Description of Artificial Sequence: Synthetic peptide
  XENP022606 vhCDR2
EISTKANNHATYYAESVKG

SEQ ID NO: 32974 - protein, 10 aa, Artificial Sequence
  Description of Artificial Sequence: Synthetic peptide
  XENP022606 vhCDR3
LATWDWYFDV

SEQ ID NO: 32975 - protein, 231 aa, Artificial Sequence; identical to SEQ ID NO: 32799
  Description of Artificial Sequence: Synthetic polypeptide
  XENP022606 7G8_H3.30_L1.34-one-arm Fc-only Heavy Chain

SEQ ID NO: 32976 - protein, 218 aa, Artificial Sequence; identical to SEQ ID NO: 22599
  Description of Artificial Sequence: Synthetic polypeptide
  XENP022606 7G8_H3.30_L1.34-one-arm Light Chain

SEQ ID NO: 32977 - protein, 111 aa, Artificial Sequence; identical to SEQ ID NO: 22600
  Description of Artificial Sequence: Synthetic polypeptide
  VL of XENP022606

SEQ ID NO: 32978 - protein, 15 aa, Artificial Sequence
  Description of Artificial Sequence: Synthetic peptide
  XENP022606 vlCDR1
RASQSVDYDGDSYMN

SEQ ID NO: 32979 - protein, 7 aa, Artificial Sequence
  Description of Artificial Sequence: Synthetic peptide
  XENP022606 vlCDR2
AASELES

SEQ ID NO: 32980 - protein, 9 aa, Artificial Sequence
  Description of Artificial Sequence: Synthetic peptide
  XENP022606 vlCDR3
QQSNEDPFT

SEQ ID NO: 32981 - protein, 450 aa, Artificial Sequence; identical to SEQ ID NO: 22484
  Description of Artificial Sequence: Synthetic polypeptide
  XENP022607 7G8_H3.30_L1.36-one-arm Fab-Fc Heavy Chain

SEQ ID NO: 32982 - protein, 121 aa, Artificial Sequence; identical to SEQ ID NO: 22485
  Description of Artificial Sequence: Synthetic polypeptide
  VH of XENP022607

SEQ ID NO: 32983 - protein, 5 aa, Artificial Sequence
  Description of Artificial Sequence: Synthetic peptide
  XENP022607 vhCDR1
DAWMS

SEQ ID NO: 32984 - protein, 19 aa, Artificial Sequence
  Description of Artificial Sequence: Synthetic peptide
  XENP022607 vhCDR2
EISTKANNHATYYAESVKG

SEQ ID NO: 32985 - protein, 10 aa, Artificial Sequence
  Description of Artificial Sequence: Synthetic peptide
  XENP022607 vhCDR3
LATWDWYFDV

SEQ ID NO: 32986 - protein, 231 aa, Artificial Sequence; identical to SEQ ID NO: 32799
  Description of Artificial Sequence: Synthetic polypeptide
  XENP022607 7G8_H3.30_L1.36-one-arm Fc-only Heavy Chain

SEQ ID NO: 32987 - protein, 218 aa, Artificial Sequence; identical to SEQ ID NO: 22619
  Description of Artificial Sequence: Synthetic polypeptide
  XENP022607 7G8_H3.30_L1.36-one-arm Light Chain

SEQ ID NO: 32988 - protein, 111 aa, Artificial Sequence; identical to SEQ ID NO: 22620
  Description of Artificial Sequence: Synthetic polypeptide
  VL of XENP022607

SEQ ID NO: 32989 - protein, 15 aa, Artificial Sequence
  Description of Artificial Sequence: Synthetic peptide
  XENP022607 vlCDR1
RASQSVDHDGDSYMN

SEQ ID NO: 32990 - protein, 7 aa, Artificial Sequence
  Description of Artificial Sequence: Synthetic peptide
  XENP022607 vlCDR2
AASELES

SEQ ID NO: 32991 - protein, 9 aa, Artificial Sequence
  Description of Artificial Sequence: Synthetic peptide
  XENP022607 vlCDR3
QQSNEDPFT

SEQ ID NO: 32992 - protein, 450 aa, Artificial Sequence; identical to SEQ ID NO: 22304
  Description of Artificial Sequence: Synthetic polypeptide
  XENP022608 7G8_H3L1-one-arm Fab-Fc Heavy Chain

SEQ ID NO: 32993 - protein, 121 aa, Artificial Sequence; identical to SEQ ID NO: 17806
  Description of Artificial Sequence: Synthetic polypeptide
  VH of XENP022608

SEQ ID NO: 32994 - protein, 5 aa, Artificial Sequence
  Description of Artificial Sequence: Synthetic peptide
  XENP022608 vhCDR1
DAWMD

SEQ ID NO: 32995 - protein, 19 aa, Artificial Sequence
  Description of Artificial Sequence: Synthetic peptide
  XENP022608 vhCDR2
EIRTKANNHATYYAESVKG

SEQ ID NO: 32996 - protein, 10 aa, Artificial Sequence
  Description of Artificial Sequence: Synthetic peptide
  XENP022608 vhCDR3
LANWDWYFDV

SEQ ID NO: 32997 - protein, 231 aa, Artificial Sequence; identical to SEQ ID NO: 32799
  Description of Artificial Sequence: Synthetic polypeptide
  XENP022608 7G8_H3L1-one-arm Fc-only Heavy Chain

SEQ ID NO: 32998 - protein, 218 aa, Artificial Sequence; identical to SEQ ID NO: 17600
  Description of Artificial Sequence: Synthetic polypeptide
  XENP022608 7G8_H3L1-one-arm Light Chain

SEQ ID NO: 32999 - protein, 111 aa, Artificial Sequence; identical to SEQ ID NO: 17601
  Description of Artificial Sequence: Synthetic polypeptide
  VL of XENP022608

SEQ ID NO: 33000 - protein, 15 aa, Artificial Sequence
  Description of Artificial Sequence: Synthetic peptide
  XENP022608 vlCDR1
RASQSVDYDGDSYMN

SEQ ID NO: 33001 - protein, 7 aa, Artificial Sequence
  Description of Artificial Sequence: Synthetic peptide
  XENP022608 vlCDR2
AASNLES

SEQ ID NO: 33002 - protein, 9 aa, Artificial Sequence
  Description of Artificial Sequence: Synthetic peptide
  XENP022608 vlCDR3
QQSNEDPFT

SEQ ID NO: 33003 - protein, 222 aa, Artificial Sequence
  Description of Artificial Sequence: Synthetic polypeptide
  XENP022721 1C11_H1L3_Fab Heavy Chain
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 33004 - protein, 117 aa, Artificial Sequence
  Description of Artificial Sequence: Synthetic polypeptide
  VH of XENP022721
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSS

SEQ ID NO: 33005 - protein, 5 aa, Artificial Sequence
  Description of Artificial Sequence: Synthetic peptide
  XENP022721 vhCDR1
HYGMN

SEQ ID NO: 33006 - protein, 17 aa, Artificial Sequence
  Description of Artificial Sequence: Synthetic peptide
  XENP022721 vhCDR2
WINTYTGEPTYADKFQG

SEQ ID NO: 33007 - protein, 8 aa, Artificial Sequence
  Description of Artificial Sequence: Synthetic peptide
  XENP022721 vhCDR3
DYYGSSPY

SEQ ID NO: 33008 - protein, 219 aa, Artificial Sequence
  Description of Artificial Sequence: Synthetic polypeptide
  XENP022721 1C11_H1L3_Fab Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33009 - protein, 112 aa, Artificial Sequence
  Description of Artificial Sequence: Synthetic polypeptide
  VL of XENP022721
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 33010 - protein, 16 aa, Artificial Sequence
  Description of Artificial Sequence: Synthetic peptide
  XENP022721 vlCDR1
KSSQSIVHSNGNTYLE

SEQ ID NO: 33011 - protein, 7 aa, Artificial Sequence
  Description of Artificial Sequence: Synthetic peptide
  XENP022721 vlCDR2
KVSNRFS

SEQ ID NO: 33012 - protein, 9 aa, Artificial Sequence
  Description of Artificial Sequence: Synthetic peptide
  XENP022721 vlCDR3
FQGSHVPNT

SEQ ID NO: 33013 - protein, 222 aa, Artificial Sequence
  Description of Artificial Sequence: Synthetic polypeptide
  XENP022722 1C11_H2L1_Fab Heavy Chain
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 33014 - protein, 117 aa, Artificial Sequence
  Description of Artificial Sequence: Synthetic polypeptide
  VH of XENP022722
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSS

SEQ ID NO: 33015 - protein, 5 aa, Artificial Sequence
  Description of Artificial Sequence: Synthetic peptide
  XENP022722 vhCDR1
HYGMN

SEQ ID NO: 33016 - protein, 17 aa, Artificial Sequence
  Description of Artificial Sequence: Synthetic peptide
  XENP022722 vhCDR2
WINTYTGEPTYADSVKG

SEQ ID NO: 33017 - protein, 8 aa, Artificial Sequence
  Description of Artificial Sequence: Synthetic peptide
  XENP022722 vhCDR3
DYYGSSPY

SEQ ID NO: 33018 - protein, 219 aa, Artificial Sequence
  Description of Artificial Sequence: Synthetic polypeptide
  XENP022722 1C11_H2L1_Fab Light Chain
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33019 - protein, 112 aa, Artificial Sequence
  Description of Artificial Sequence: Synthetic polypeptide
  VL of XENP022722
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIK

SEQ ID NO: 33020 - protein, 16 aa, Artificial Sequence
  Description of Artificial Sequence: Synthetic peptide
  XENP022722 vlCDR1
RSSQSIVHSNGNTYLE

SEQ ID NO: 33021 - protein, 7 aa, Artificial Sequence
  Description of Artificial Sequence: Synthetic peptide
  XENP022722 vlCDR2
KVSNRFS

SEQ ID NO: 33022 - protein, 9 aa, Artificial Sequence
  Description of Artificial Sequence: Synthetic peptide
  XENP022722 vlCDR3
FQGSHVPNT

SEQ ID NO: 33023 - protein, 222 aa, Artificial Sequence; identical to SEQ ID NO: 33013
  Description of Artificial Sequence: Synthetic polypeptide
  XENP022723 1C11_H2L2_Fab Heavy Chain

SEQ ID NO: 33024 - protein, 117 aa, Artificial Sequence; identical to SEQ ID NO: 33014
  Description of Artificial Sequence: Synthetic polypeptide
  VH of XENP022723

SEQ ID NO: 33025 - protein, 5 aa, Artificial Sequence
  Description of Artificial Sequence: Synthetic peptide
  XENP022723 vhCDR1
HYGMN

SEQ ID NO: 33026 - protein, 17 aa, Artificial Sequence
  Description of Artificial Sequence: Synthetic peptide
  XENP022723 vhCDR2
WINTYTGEPTYADSVKG

SEQ ID NO: 33027 - protein, 8 aa, Artificial Sequence
  Description of Artificial Sequence: Synthetic peptide
  XENP022723 vhCDR3
DYYGSSPY

SEQ ID NO: 33028 - protein, 219 aa, Artificial Sequence
  Description of Artificial Sequence: Synthetic polypeptide
  XENP022723 1C11_H2L2_Fab Light Chain
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33029 - protein, 112 aa, Artificial Sequence
  Description of Artificial Sequence: Synthetic polypeptide
  VL of XENP022723
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIK

SEQ ID NO: 33030 - protein, 16 aa, Artificial Sequence
  Description of Artificial Sequence: Synthetic peptide
  XENP022723 vlCDR1
RSSQSIVHSNGNTYLE

SEQ ID NO: 33031 - protein, 7 aa, Artificial Sequence
  Description of Artificial Sequence: Synthetic peptide
  XENP022723 vlCDR2
KVSNRFS

SEQ ID NO: 33032 - protein, 9 aa, Artificial Sequence
  Description of Artificial Sequence: Synthetic peptide
  XENP022723 vlCDR3
FQGSHVPNT

SEQ ID NO: 33033 - protein, 222 aa, Artificial Sequence
  Description of Artificial Sequence: Synthetic polypeptide
  XENP022724 1C11_H3L3_Fab Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 33034 - protein, 117 aa, Artificial Sequence
  Description of Artificial Sequence: Synthetic polypeptide
  VH of XENP022724
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33035 - protein, 5 aa, Artificial Sequence
  Description of Artificial Sequence: Synthetic peptide
  XENP022724 vhCDR1
HYGMN

SEQ ID NO: 33036 - protein, 17 aa, Artificial Sequence
  Description of Artificial Sequence: Synthetic peptide
  XENP022724 vhCDR2
WINTYTGEPTYADGFTG

SEQ ID NO: 33037 - protein, 8 aa, Artificial Sequence
  Description of Artificial Sequence: Synthetic peptide
  XENP022724 vhCDR3
DYYGSSPY

SEQ ID NO: 33038 - protein, 219 aa, Artificial Sequence; identical to SEQ ID NO: 33008
  Description of Artificial Sequence: Synthetic polypeptide
  XENP022724 1C11_H3L3_Fab Light Chain

SEQ ID NO: 33039 - protein, 112 aa, Artificial Sequence; identical to SEQ ID NO: 33009
  Description of Artificial Sequence: Synthetic polypeptide
  VL of XENP022724

SEQ ID NO: 33040 - protein, 16 aa, Artificial Sequence
  Description of Artificial Sequence: Synthetic peptide
  XENP022724 vlCDR1
KSSQSIVHSNGNTYLE

SEQ ID NO: 33041 - protein, 7 aa, Artificial Sequence
  Description of Artificial Sequence: Synthetic peptide
  XENP022724 vlCDR2
KVSNRFS

SEQ ID NO: 33042 - protein, 9 aa, Artificial Sequence
  Description of Artificial Sequence: Synthetic peptide
  XENP022724 vlCDR3
FQGSHVPNT

SEQ ID NO: 33043 - protein, 222 aa, Artificial Sequence
  Description of Artificial Sequence: Synthetic polypeptide
  XENP022725 1C11_H0L0_Fab Heavy Chain
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 33044 - protein, 117 aa, Artificial Sequence
  Description of Artificial Sequence: Synthetic polypeptide
  VH of XENP022725
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSS

SEQ ID NO: 33045 - protein, 5 aa, Artificial Sequence
  Description of Artificial Sequence: Synthetic peptide
  XENP022725 vhCDR1
HYGMN

SEQ ID NO: 33046 - protein, 17 aa, Artificial Sequence
  Description of Artificial Sequence: Synthetic peptide
  XENP022725 vhCDR2
WINTYTGEPTYADDFKG

SEQ ID NO: 33047 - protein, 8 aa, Artificial Sequence
  Description of Artificial Sequence: Synthetic peptide
  XENP022725 vhCDR3
DYYGSSPY

SEQ ID NO: 33048 - protein, 219 aa, Artificial Sequence
  Description of Artificial Sequence: Synthetic polypeptide
  XENP022725 1C11_H0L0_Fab Light Chain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33049 - protein, 112 aa, Artificial Sequence
  Description of Artificial Sequence: Synthetic polypeptide
  VL of XENP022725
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIK

SEQ ID NO: 33050 - protein, 16 aa, Artificial Sequence
  Description of Artificial Sequence: Synthetic peptide
  XENP022725 vlCDR1
RSSQSIVHSNGNTYLE

SEQ ID NO: 33051 - protein, 7 aa, Artificial Sequence
  Description of Artificial Sequence: Synthetic peptide
  XENP022725 vlCDR2
KVSNRFS

SEQ ID NO: 33052 - protein, 9 aa, Artificial Sequence
  Description of Artificial Sequence: Synthetic peptide
  XENP022725 vlCDR3
FQGSHVPNT

SEQ ID NO: 33053 - protein, 222 aa, Artificial Sequence; identical to SEQ ID NO: 33033
  Description of Artificial Sequence: Synthetic polypeptide
  XENP022991 1C11_H3L1_Fab Heavy Chain

SEQ ID NO: 33054 - protein, 117 aa, Artificial Sequence; identical to SEQ ID NO: 33034
  Description of Artificial Sequence: Synthetic polypeptide
  VH of XENP022991

SEQ ID NO: 33055 - protein, 5 aa, Artificial Sequence
  Description of Artificial Sequence: Synthetic peptide
  XENP022991 vhCDR1
HYGMN

SEQ ID NO: 33056 - protein, 17 aa, Artificial Sequence
  Description of Artificial Sequence: Synthetic peptide
  XENP022991 vhCDR2
WINTYTGEPTYADGFTG

SEQ ID NO: 33057 - protein, 8 aa, Artificial Sequence
  Description of Artificial Sequence: Synthetic peptide
  XENP022991 vhCDR3
DYYGSSPY

SEQ ID NO: 33058 - protein, 219 aa, Artificial Sequence; identical to SEQ ID NO: 33018
  Description of Artificial Sequence: Synthetic polypeptide
  XENP022991 1C11_H3L1_Fab Light Chain

SEQ ID NO: 33059 - protein, 112 aa, Artificial Sequence; identical to SEQ ID NO: 33019
  Description of Artificial Sequence: Synthetic polypeptide
  VL of XENP022991

SEQ ID NO: 33060 - protein, 16 aa, Artificial Sequence
  Description of Artificial Sequence: Synthetic peptide
  XENP022991 vlCDR1
RSSQSIVHSNGNTYLE

SEQ ID NO: 33061 - protein, 7 aa, Artificial Sequence
  Description of Artificial Sequence: Synthetic peptide
  XENP022991 vlCDR2
KVSNRFS

SEQ ID NO: 33062 - protein, 9 aa, Artificial Sequence
  Description of Artificial Sequence: Synthetic peptide
  XENP022991 vlCDR3
FQGSHVPNT

SEQ ID NO: 33063 - protein, 222 aa, Artificial Sequence; identical to SEQ ID NO: 33033
  Description of Artificial Sequence: Synthetic polypeptide
  XENP022992 1C11_H3L2_Fab Heavy Chain

SEQ ID NO: 33064 - protein, 117 aa, Artificial Sequence; identical to SEQ ID NO: 33034
  Description of Artificial Sequence: Synthetic polypeptide
  VH of XENP022992

SEQ ID NO: 33065 - protein, 5 aa, Artificial Sequence
  Description of Artificial Sequence: Synthetic peptide
  XENP022992 vhCDR1
HYGMN

SEQ ID NO: 33066 - protein, 17 aa, Artificial Sequence
  Description of Artificial Sequence: Synthetic peptide
  XENP022992 vhCDR2
WINTYTGEPTYADGFTG

SEQ ID NO: 33067 - protein, 8 aa, Artificial Sequence
  Description of Artificial Sequence: Synthetic peptide
  XENP022992 vhCDR3
DYYGSSPY

SEQ ID NO: 33068 - protein, 219 aa, Artificial Sequence; identical to SEQ ID NO: 33028
  Description of Artificial Sequence: Synthetic polypeptide
  XENP022992 1C11_H3L2_Fab Light Chain

SEQ ID NO: 33069 - protein, 112 aa, Artificial Sequence; identical to SEQ ID NO: 33029
  Description of Artificial Sequence: Synthetic polypeptide
  VL of XENP022992

SEQ ID NO: 33070 - protein, 16 aa, Artificial Sequence
  Description of Artificial Sequence: Synthetic peptide
  XENP022992 vlCDR1
RSSQSIVHSNGNTYLE

SEQ ID NO: 33071 - protein, 7 aa, Artificial Sequence
  Description of Artificial Sequence: Synthetic peptide
  XENP022992 vlCDR2
KVSNRFS

SEQ ID NO: 33072 - protein, 9 aa, Artificial Sequence
  Description of Artificial Sequence: Synthetic peptide
  XENP022992 vlCDR3
FQGSHVPNT

SEQ ID NO: 33073 - protein, 251 aa, Artificial Sequence
  Description of Artificial Sequence: Synthetic polypeptide
  XENP023574 1C11_L1H3_scFv
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIKGKPGSGKPGSGKPGSGKPGSQIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 33074 - protein, 112 aa, Artificial Sequence; identical to SEQ ID NO: 33019
  Description of Artificial Sequence: Synthetic polypeptide
  VH of XENP023574

SEQ ID NO: 33075 - protein, 119 aa, Artificial Sequence
  Description of Artificial Sequence: Synthetic polypeptide
  VL of XENP023574
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 33076 - protein, 16 aa, Artificial Sequence
  Description of Artificial Sequence: Synthetic peptide
  XENP023574 vhCDR1
RSSQSIVHSNGNTYLE

SEQ ID NO: 33077 - protein, 7 aa, Artificial Sequence
  Description of Artificial Sequence: Synthetic peptide
  XENP023574 vhCDR2
KVSNRFS

SEQ ID NO: 33078 - protein, 9 aa, Artificial Sequence
  Description of Artificial Sequence: Synthetic peptide
  XENP023574 vhCDR3
FQGSHVPNT

SEQ ID NO: 33079 - protein, 5 aa, Artificial Sequence
  Description of Artificial Sequence: Synthetic peptide
  XENP023574 vlCDR1
HYGMN

SEQ ID NO: 33080 - protein, 17 aa, Artificial Sequence
  Description of Artificial Sequence: Synthetic peptide
  XENP023574 vlCDR2
WINTYTGEPTYADGFTG

SEQ ID NO: 33081 - protein, 8 aa, Artificial Sequence
  Description of Artificial Sequence: Synthetic peptide
  XENP023574 vlCDR3
DYYGSSPY

SEQ ID NO: 33082 - protein, 251 aa, Artificial Sequence
  Description of Artificial Sequence: Synthetic polypeptide
  XENP023575 1C11_L2H3_scFv
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIKGKPGSGKPGSGKPGSGKPGSQIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 33083 - protein, 112 aa, Artificial Sequence; identical to SEQ ID NO: 33029
  Description of Artificial Sequence: Synthetic polypeptide
  VH of XENP023575

SEQ ID NO: 33084 - protein, 119 aa, Artificial Sequence; identical to SEQ ID NO: 33075
  Description of Artificial Sequence: Synthetic polypeptide
  VL of XENP023575

SEQ ID NO: 33085 - protein, 16 aa, Artificial Sequence
  Description of Artificial Sequence: Synthetic peptide
  XENP023575 vhCDR1
RSSQSIVHSNGNTYLE

SEQ ID NO: 33086 - protein, 7 aa, Artificial Sequence
  Description of Artificial Sequence: Synthetic peptide
  XENP023575 vhCDR2
KVSNRFS

SEQ ID NO: 33087 - protein, 9 aa, Artificial Sequence
  Description of Artificial Sequence: Synthetic peptide
  XENP023575 vhCDR3
FQGSHVPNT

SEQ ID NO: 33088 - protein, 5 aa, Artificial Sequence
  Description of Artificial Sequence: Synthetic peptide
  XENP023575 vlCDR1
HYGMN

SEQ ID NO: 33089 - protein, 17 aa, Artificial Sequence
  Description of Artificial Sequence: Synthetic peptide
  XENP023575 vlCDR2
WINTYTGEPTYADGFTG

SEQ ID NO: 33090 - protein, 8 aa, Artificial Sequence
  Description of Artificial Sequence: Synthetic peptide
  XENP023575 vlCDR3
DYYGSSPY

SEQ ID NO: 33091 - protein, 251 aa, Artificial Sequence
  Description of Artificial Sequence: Synthetic polypeptide
  XENP023576 1C11_L3H3_scFv
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGKPGSGKPGSGKPGSGKPGSQIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 33092 - protein, 112 aa, Artificial Sequence; identical to SEQ ID NO: 33009
  Description of Artificial Sequence: Synthetic polypeptide
  VH of XENP023576

SEQ ID NO: 33093 - protein, 119 aa, Artificial Sequence; identical to SEQ ID NO: 33075
  Description of Artificial Sequence: Synthetic polypeptide
  VL of XENP023576

SEQ ID NO: 33094 - protein, 16 aa, Artificial Sequence
  Description of Artificial Sequence: Synthetic peptide
  XENP023576 vhCDR1
KSSQSIVHSNGNTYLE

SEQ ID NO: 33095 - protein, 7 aa, Artificial Sequence
  Description of Artificial Sequence: Synthetic peptide
  XENP023576 vhCDR2
KVSNRFS

SEQ ID NO: 33096 - protein, 9 aa, Artificial Sequence
  Description of Artificial Sequence: Synthetic peptide
  XENP023576 vhCDR3
FQGSHVPNT

SEQ ID NO: 33097 - protein, 5 aa, Artificial Sequence
  Description of Artificial Sequence: Synthetic peptide
  XENP023576 vlCDR1
HYGMN

SEQ ID NO: 33098 - protein, 17 aa, Artificial Sequence
  Description of Artificial Sequence: Synthetic peptide
  XENP023576 vlCDR2
WINTYTGEPTYADGFTG

SEQ ID NO: 33099 - protein, 8 aa, Artificial Sequence
  Description of Artificial Sequence: Synthetic peptide
  XENP023576 vlCDR3
DYYGSSPY

SEQ ID NO: 33100 - protein, 251 aa, Artificial Sequence
  Description of Artificial Sequence: Synthetic polypeptide
  XENP023577 1C11_H3_L3.1_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33101 - protein, 117 aa, Artificial Sequence; identical to SEQ ID NO: 33034
  Description of Artificial Sequence: Synthetic polypeptide
  VH of XENP023577

SEQ ID NO: 33102 - protein, 114 aa, Artificial Sequence
  Description of Artificial Sequence: Synthetic polypeptide
  VL of XENP023577
DILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33103 - protein, 5 aa, Artificial Sequence
  Description of Artificial Sequence: Synthetic peptide
  XENP023577 vhCDR1
HYGMN

SEQ ID NO: 33104 - protein, 17 aa, Artificial Sequence
  Description of Artificial Sequence: Synthetic peptide
  XENP023577 vhCDR2
WINTYTGEPTYADGFTG

SEQ ID NO: 33105 - protein, 8 aa, Artificial Sequence
  Description of Artificial Sequence: Synthetic peptide
  XENP023577 vhCDR3
DYYGSSPY

SEQ ID NO: 33106 - protein, 16 aa, Artificial Sequence
  Description of Artificial Sequence: Synthetic peptide
  XENP023577 vlCDR1
KSSQSIVHSNGNTYLE

SEQ ID NO: 33107 - protein, 7 aa, Artificial Sequence
  Description of Artificial Sequence: Synthetic peptide
  XENP023577 vlCDR2
KVSNRFS

SEQ ID NO: 33108 - protein, 9 aa, Artificial Sequence
  Description of Artificial Sequence: Synthetic peptide
  XENP023577 vlCDR3
FQGSHVPNT

SEQ ID NO: 33109 - protein, 251 aa, Artificial Sequence
  Description of Artificial Sequence: Synthetic polypeptide
  XENP023578 1C11_H3_L3.2_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDLLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33110 - protein, 117 aa, Artificial Sequence; identical to SEQ ID NO: 33034
  Description of Artificial Sequence: Synthetic polypeptide
  VH of XENP023578

SEQ ID NO: 33111 - protein, 114 aa, Artificial Sequence
  Description of Artificial Sequence: Synthetic polypeptide
  VL of XENP023578
DLLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33112 - protein, 5 aa, Artificial Sequence
  Description of Artificial Sequence: Synthetic peptide
  XENP023578 vhCDR1
HYGMN

SEQ ID NO: 33113 - protein, 17 aa, Artificial Sequence
  Description of Artificial Sequence: Synthetic peptide
  XENP023578 vhCDR2
WINTYTGEPTYADGFTG

SEQ ID NO: 33114 - protein, 8 aa, Artificial Sequence
  Description of Artificial Sequence: Synthetic peptide
  XENP023578 vhCDR3
DYYGSSPY

SEQ ID NO: 33115 - protein, 16 aa, Artificial Sequence
  Description of Artificial Sequence: Synthetic peptide
  XENP023578 vlCDR1
KSSQSIVHSNGNTYLE

SEQ ID NO: 33116 - protein, 7 aa, Artificial Sequence
  Description of Artificial Sequence: Synthetic peptide
  XENP023578 vlCDR2
KVSNRFS

SEQ ID NO: 33117 - protein, 9 aa, Artificial Sequence
  Description of Artificial Sequence: Synthetic peptide
  XENP023578 vlCDR3
FQGSHVPNT

SEQ ID NO: 33118 - protein, 251 aa, Artificial Sequence
  Description of Artificial Sequence: Synthetic polypeptide
  XENP023579 1C11_H3_L3.3_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33119 - protein, 117 aa, Artificial Sequence; identical to SEQ ID NO: 33034
  Description of Artificial Sequence: Synthetic polypeptide
  VH of XENP023579

SEQ ID NO: 33120 - protein, 114 aa, Artificial Sequence
  Description of Artificial Sequence: Synthetic polypeptide
  VL of XENP023579
DVVMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33121 - protein, 5 aa, Artificial Sequence
  Description of Artificial Sequence: Synthetic peptide
  XENP023579 vhCDR1
HYGMN

SEQ ID NO: 33122 - protein, 17 aa, Artificial Sequence
  Description of Artificial Sequence: Synthetic peptide
  XENP023579 vhCDR2
WINTYTGEPTYADGFTG

SEQ ID NO: 33123 - protein, 8 aa, Artificial Sequence
  Description of Artificial Sequence: Synthetic peptide
  XENP023579 vhCDR3
DYYGSSPY

SEQ ID NO: 33124 - protein, 16 aa, Artificial Sequence
  Description of Artificial Sequence: Synthetic peptide
  XENP023579 vlCDR1
KSSQSIVHSNGNTYLE

SEQ ID NO: 33125 - protein, 7 aa, Artificial Sequence
  Description of Artificial Sequence: Synthetic peptide
  XENP023579 vlCDR2
KVSNRFS

SEQ ID NO: 33126 - protein, 9 aa, Artificial Sequence
  Description of Artificial Sequence: Synthetic peptide
  XENP023579 vlCDR3
FQGSHVPNT

SEQ ID NO: 33127 - protein, 251 aa, Artificial Sequence
  Description of Artificial Sequence: Synthetic polypeptide
  XENP023580 1C11_H3_L3.4_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVEMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33128 - protein, 117 aa, Artificial Sequence; identical to SEQ ID NO: 33034
  Description of Artificial Sequence: Synthetic polypeptide
  VH of XENP023580

SEQ ID NO: 33129 - protein, 114 aa, Artificial Sequence
  Description of Artificial Sequence: Synthetic polypeptide
  VL of XENP023580
DVEMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33130 - protein, 5 aa, Artificial Sequence
  Description of Artificial Sequence: Synthetic peptide
  XENP023580 vhCDR1
HYGMN

SEQ ID NO: 33131 - protein, 17 aa, Artificial Sequence
  Description of Artificial Sequence: Synthetic peptide
  XENP023580 vhCDR2
WINTYTGEPTYADGFTG

SEQ ID NO: 33132 - protein, 8 aa, Artificial Sequence
  Description of Artificial Sequence: Synthetic peptide
  XENP023580 vhCDR3
DYYGSSPY

SEQ ID NO: 33133 - protein, 16 aa, Artificial Sequence
  Description of Artificial Sequence: Synthetic peptide
  XENP023580 vlCDR1
KSSQSIVHSNGNTYLE

SEQ ID NO: 33134 - protein, 7 aa, Artificial Sequence
  Description of Artificial Sequence: Synthetic peptide
  XENP023580 vlCDR2
KVSNRFS

SEQ ID NO: 33135 - protein, 9 aa, Artificial Sequence
  Description of Artificial Sequence: Synthetic peptide
  XENP023580 vlCDR3
FQGSHVPNT

SEQ ID NO: 33136 - protein, 251 aa, Artificial Sequence
  Description of Artificial Sequence: Synthetic polypeptide
  XENP023581 1C11_H3_L3.5_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33137 - protein, 117 aa, Artificial Sequence; identical to SEQ ID NO: 33034
  Description of Artificial Sequence: Synthetic polypeptide
  VH of XENP023581

SEQ ID NO: 33138 - protein, 114 aa, Artificial Sequence
  Description of Artificial Sequence: Synthetic polypeptide
  VL of XENP023581
DVQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33139 - protein, 5 aa, Artificial Sequence
  Description of Artificial Sequence: Synthetic peptide
  XENP023581 vhCDR1
HYGMN

SEQ ID NO: 33140 - protein, 17 aa, Artificial Sequence
  Description of Artificial Sequence: Synthetic peptide
  XENP023581 vhCDR2
WINTYTGEPTYADGFTG

SEQ ID NO: 33141 - protein, 8 aa, Artificial Sequence
  Description of Artificial Sequence: Synthetic peptide
  XENP023581 vhCDR3
DYYGSSPY

SEQ ID NO: 33142 - protein, 16 aa, Artificial Sequence
  Description of Artificial Sequence: Synthetic peptide
  XENP023581 vlCDR1
KSSQSIVHSNGNTYLE

SEQ ID NO: 33143 - protein, 7 aa, Artificial Sequence
  Description of Artificial Sequence: Synthetic peptide
  XENP023581 vlCDR2
KVSNRFS

SEQ ID NO: 33144 - protein, 9 aa, Artificial Sequence
  Description of Artificial Sequence: Synthetic peptide
  XENP023581 vlCDR3
FQGSHVPNT

SEQ ID NO: 33145 - protein, 251 aa, Artificial Sequence
  Description of Artificial Sequence: Synthetic polypeptide
  XENP023582 1C11_H3_L3.6_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVDMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33146 - protein, 117 aa, Artificial Sequence; identical to SEQ ID NO: 33034
  Description of Artificial Sequence: Synthetic polypeptide
  VH of XENP023582

SEQ ID NO: 33147 - protein, 114 aa, Artificial Sequence
  Description of Artificial Sequence: Synthetic polypeptide
  VL of XENP023582
DVDMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33148 - protein, 5 aa, Artificial Sequence
  Description of Artificial Sequence: Synthetic peptide
  XENP023582 vhCDR1
HYGMN

SEQ ID NO: 33149 - protein, 17 aa, Artificial Sequence
  Description of Artificial Sequence: Synthetic peptide
  XENP023582 vhCDR2
WINTYTGEPTYADGFTG

SEQ ID NO: 33150 - protein, 8 aa, Artificial Sequence
  Description of Artificial Sequence: Synthetic peptide
  XENP023582 vhCDR3
DYYGSSPY

SEQ ID NO: 33151 - protein, 16 aa, Artificial Sequence
  Description of Artificial Sequence: Synthetic peptide
  XENP023582 vlCDR1
KSSQSIVHSNGNTYLE

SEQ ID NO: 33152 - protein, 7 aa, Artificial Sequence
  Description of Artificial Sequence: Synthetic peptide
  XENP023582 vlCDR2
KVSNRFS

SEQ ID NO: 33153 - protein, 9 aa, Artificial Sequence
  Description of Artificial Sequence: Synthetic peptide
  XENP023582 vlCDR3
FQGSHVPNT

SEQ ID NO: 33154 - protein, 251 aa, Artificial Sequence
  Description of Artificial Sequence: Synthetic polypeptide
  XENP023583 1C11_H3_L3.7_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33155 - protein, 117 aa, Artificial Sequence; identical to SEQ ID NO: 33034
  Description of Artificial Sequence: Synthetic polypeptide
  VH of XENP023583

SEQ ID NO: 33156 - protein, 114 aa, Artificial Sequence
  Description of Artificial Sequence: Synthetic polypeptide
  VL of XENP023583
DIQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33157 - protein, 5 aa, Artificial Sequence
  Description of Artificial Sequence: Synthetic peptide
  XENP023583 vhCDR1
HYGMN

SEQ ID NO: 33158 - protein, 17 aa, Artificial Sequence
  Description of Artificial Sequence: Synthetic peptide
  XENP023583 vhCDR2
WINTYTGEPTYADGFTG

SEQ ID NO: 33159 - protein, 8 aa, Artificial Sequence
  Description of Artificial Sequence: Synthetic peptide
  XENP023583 vhCDR3
DYYGSSPY

SEQ ID NO: 33160 - protein, 16 aa, Artificial Sequence
  Description of Artificial Sequence: Synthetic peptide
  XENP023583 vlCDR1
KSSQSIVHSNGNTYLE

SEQ ID NO: 33161 - protein, 7 aa, Artificial Sequence
  Description of Artificial Sequence: Synthetic peptide
  XENP023583 vlCDR2
KVSNRFS

SEQ ID NO: 33162 - protein, 9 aa, Artificial Sequence
  Description of Artificial Sequence: Synthetic peptide
  XENP023583 vlCDR3
FQGSHVPNT

SEQ ID NO: 33163 - protein, 251 aa, Artificial Sequence
  Description of Artificial Sequence: Synthetic polypeptide
  XENP023584 1C11_H3_L3.9_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPKSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33164 - protein, 117 aa, Artificial Sequence; identical to SEQ ID NO: 33034
  Description of Artificial Sequence: Synthetic polypeptide
  VH of XENP023584

SEQ ID NO: 33165 - protein, 114 aa, Artificial Sequence
  Description of Artificial Sequence: Synthetic polypeptide
  VL of XENP023584
DVLMTQSPKSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33166 - protein, 5 aa, Artificial Sequence
  Description of Artificial Sequence: Synthetic peptide
  XENP023584 vhCDR1
HYGMN

SEQ ID NO: 33167 - protein, 17 aa, Artificial Sequence
  Description of Artificial Sequence: Synthetic peptide
  XENP023584 vhCDR2
WINTYTGEPTYADGFTG

SEQ ID NO: 33168 - protein, 8 aa, Artificial Sequence
  Description of Artificial Sequence: Synthetic peptide
  XENP023584 vhCDR3
DYYGSSPY

SEQ ID NO: 33169 - protein, 16 aa, Artificial Sequence
  Description of Artificial Sequence: Synthetic peptide
  XENP023584 vlCDR1
KSSQSIVHSNGNTYLE

SEQ ID NO: 33170 - protein, 7 aa, Artificial Sequence
  Description of Artificial Sequence: Synthetic peptide
  XENP023584 vlCDR2
KVSNRFS

SEQ ID NO: 33171 - protein, 9 aa, Artificial Sequence
  Description of Artificial Sequence: Synthetic peptide
  XENP023584 vlCDR3
FQGSHVPNT

SEQ ID NO: 33172 - protein, 251 aa, Artificial Sequence
  Description of Artificial Sequence: Synthetic polypeptide
  XENP023585 1C11_H3_L3.10_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPLSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33173 - protein, 117 aa, Artificial Sequence; identical to SEQ ID NO: 33034
  Description of Artificial Sequence: Synthetic polypeptide
  VH of XENP023585

SEQ ID NO: 33174 - protein, 114 aa, Artificial Sequence
  Description of Artificial Sequence: Synthetic polypeptide
  VL of XENP023585
DVLMTQSPLSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33175 - protein, 5 aa, Artificial Sequence
  Description of Artificial Sequence: Synthetic peptide
  XENP023585 vhCDR1
HYGMN

SEQ ID NO: 33176 - protein, 17 aa, Artificial Sequence
  Description of Artificial Sequence: Synthetic peptide
  XENP023585 vhCDR2
WINTYTGEPTYADGFTG

SEQ ID NO: 33177 - protein, 8 aa, Artificial Sequence
  Description of Artificial Sequence: Synthetic peptide
  XENP023585 vhCDR3
DYYGSSPY

SEQ ID NO: 33178 - protein, 16 aa, Artificial Sequence
  Description of Artificial Sequence: Synthetic peptide
  XENP023585 vlCDR1
KSSQSIVHSNGNTYLE

SEQ ID NO: 33179 - protein, 7 aa, Artificial Sequence
  Description of Artificial Sequence: Synthetic peptide
  XENP023585 vlCDR2
KVSNRFS

SEQ ID NO: 33180 - protein, 9 aa, Artificial Sequence
  Description of Artificial Sequence: Synthetic peptide
  XENP023585 vlCDR3
FQGSHVPNT

SEQ ID NO: 33181 - protein, 251 aa, Artificial Sequence
  Description of Artificial Sequence: Synthetic polypeptide
  XENP023586 1C11_H3_L3.11_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPSSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33182 - protein, 117 aa, Artificial Sequence; identical to SEQ ID NO: 33034
  Description of Artificial Sequence: Synthetic polypeptide
  VH of XENP023586

SEQ ID NO: 33183 - protein, 114 aa, Artificial Sequence
  Description of Artificial Sequence: Synthetic polypeptide
  VL of XENP023586
DVLMTQSPSSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33184 - protein, 5 aa, Artificial Sequence
  Description of Artificial Sequence: Synthetic peptide
  XENP023586 vhCDR1
HYGMN

SEQ ID NO: 33185 - protein, 17 aa, Artificial Sequence
  Description of Artificial Sequence: Synthetic peptide
  XENP023586 vhCDR2
WINTYTGEPTYADGFTG

SEQ ID NO: 33186 - protein, 8 aa, Artificial Sequence
  Description of Artificial Sequence: Synthetic peptide
  XENP023586 vhCDR3
DYYGSSPY

SEQ ID NO: 33187 - protein, 16 aa, Artificial Sequence
  Description of Artificial Sequence: Synthetic peptide
  XENP023586 vlCDR1
KSSQSIVHSNGNTYLE

SEQ ID NO: 33188 - protein, 7 aa, Artificial Sequence
  Description of Artificial Sequence: Synthetic peptide
  XENP023586 vlCDR2
KVSNRFS

SEQ ID NO: 33189 - protein, 9 aa, Artificial Sequence
  Description of Artificial Sequence: Synthetic peptide
  XENP023586 vlCDR3
FQGSHVPNT

SEQ ID NO: 33190 - protein, 251 aa, Artificial Sequence
  Description of Artificial Sequence: Synthetic polypeptide
  XENP023587 1C11_H3_L3.12_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPGSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33191 - protein, 117 aa, Artificial Sequence; identical to SEQ ID NO: 33034
  Description of Artificial Sequence: Synthetic polypeptide
  VH of XENP023587

SEQ ID NO: 33192 - protein, 114 aa, Artificial Sequence
  Description of Artificial Sequence: Synthetic polypeptide
  VL of XENP023587
DVLMTQSPGSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33193 - protein, 5 aa, Artificial Sequence
  Description of Artificial Sequence: Synthetic peptide
  XENP023587 vhCDR1
HYGMN

SEQ ID NO: 33194 - protein, 17 aa, Artificial Sequence
  Description of Artificial Sequence: Synthetic peptide
  XENP023587 vhCDR2
WINTYTGEPTYADGFTG

SEQ ID NO: 33195 - protein, 8 aa, Artificial Sequence
  Description of Artificial Sequence: Synthetic peptide
  XENP023587 vhCDR3
DYYGSSPY

SEQ ID NO: 33196 - protein, 16 aa, Artificial Sequence
  Description of Artificial Sequence: Synthetic peptide
  XENP023587 vlCDR1
KSSQSIVHSNGNTYLE

SEQ ID NO: 33197 - protein, 7 aa, Artificial Sequence
  Description of Artificial Sequence: Synthetic peptide
  XENP023587 vlCDR2
KVSNRFS

SEQ ID NO: 33198 - protein, 9 aa, Artificial Sequence
  Description of Artificial Sequence: Synthetic peptide
  XENP023587 vlCDR3
FQGSHVPNT

SEQ ID NO: 33199 - protein, 251 aa, Artificial Sequence
  Description of Artificial Sequence: Synthetic polypeptide
  XENP023588 1C11_H3_L3.14_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLPVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33200 - protein, 117 aa, Artificial Sequence; identical to SEQ ID NO: 33034
  Description of Artificial Sequence: Synthetic polypeptide
  VH of XENP023588

SEQ ID NO: 33201 - protein, 114 aa, Artificial Sequence
  Description of Artificial Sequence: Synthetic polypeptide
  VL of XENP023588
DVLMTQSPDSLPVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33202 - protein, 5 aa, Artificial Sequence
  Description of Artificial Sequence: Synthetic peptide
  XENP023588 vhCDR1
HYGMN

SEQ ID NO: 33203 - protein, 17 aa, Artificial Sequence
  Description of Artificial Sequence: Synthetic peptide
  XENP023588 vhCDR2
WINTYTGEPTYADGFTG

SEQ ID NO: 33204 - protein, 8 aa, Artificial Sequence
  Description of Artificial Sequence: Synthetic peptide
  XENP023588 vhCDR3
DYYGSSPY

SEQ ID NO: 33205 - protein, 16 aa, Artificial Sequence
  Description of Artificial Sequence: Synthetic peptide
  XENP023588 vlCDR1
KSSQSIVHSNGNTYLE

SEQ ID NO: 33206 - protein, 7 aa, Artificial Sequence
  Description of Artificial Sequence: Synthetic peptide
  XENP023588 vlCDR2
KVSNRFS

SEQ ID NO: 33207 - protein, 9 aa, Artificial Sequence
  Description of Artificial Sequence: Synthetic peptide
  XENP023588 vlCDR3
FQGSHVPNT

SEQ ID NO: 33208 - protein, 251 aa, Artificial Sequence
  Description of Artificial Sequence: Synthetic polypeptide
  XENP023589 1C11_H3_L3.15_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33209 - protein, 117 aa, Artificial Sequence; identical to SEQ ID NO: 33034
  Description of Artificial Sequence: Synthetic polypeptide
  VH of XENP023589

SEQ ID NO: 33210 - protein, 114 aa, Artificial Sequence
  Description of Artificial Sequence: Synthetic polypeptide
  VL of XENP023589
DVLMTQSPDSLSVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33211 - protein, 5 aa, Artificial Sequence
  Description of Artificial Sequence: Synthetic peptide
  XENP023589 vhCDR1
HYGMN

SEQ ID NO: 33212 - protein, 17 aa, Artificial Sequence
  Description of Artificial Sequence: Synthetic peptide
  XENP023589 vhCDR2
WINTYTGEPTYADGFTG

SEQ ID NO: 33213 - protein, 8 aa, Artificial Sequence
  Description of Artificial Sequence: Synthetic peptide
  XENP023589 vhCDR3
DYYGSSPY

SEQ ID NO: 33214 - protein, 16 aa, Artificial Sequence
  Description of Artificial Sequence: Synthetic peptide
  XENP023589 vlCDR1
KSSQSIVHSNGNTYLE

SEQ ID NO: 33215 - protein, 7 aa, Artificial Sequence
  Description of Artificial Sequence: Synthetic peptide
  XENP023589 vlCDR2
KVSNRFS

SEQ ID NO: 33216 - protein, 9 aa, Artificial Sequence
  Description of Artificial Sequence: Synthetic peptide
  XENP023589 vlCDR3
FQGSHVPNT

SEQ ID NO: 33217 - protein, 251 aa, Artificial Sequence
  Description of Artificial Sequence: Synthetic polypeptide
  XENP023590 1C11_H3_L3.16_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLTVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33218 - protein, 117 aa, Artificial Sequence; identical to SEQ ID NO: 33034
  Description of Artificial Sequence: Synthetic polypeptide
  VH of XENP023590

SEQ ID NO: 33219 - protein, 114 aa, Artificial Sequence
  Description of Artificial Sequence: Synthetic polypeptide
  VL of XENP023590
DVLMTQSPDSLTVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33220 - protein, 5 aa, Artificial Sequence
  Description of Artificial Sequence: Synthetic peptide
  XENP023590 vhCDR1
HYGMN

SEQ ID NO: 33221 - protein, 17 aa, Artificial Sequence
  Description of Artificial Sequence: Synthetic peptide
  XENP023590 vhCDR2
WINTYTGEPTYADGFTG

SEQ ID NO: 33222 - protein, 8 aa, Artificial Sequence
  Description of Artificial Sequence: Synthetic peptide
  XENP023590 vhCDR3
DYYGSSPY

SEQ ID NO: 33223 - protein, 16 aa, Artificial Sequence
  Description of Artificial Sequence: Synthetic peptide
  XENP023590 vlCDR1
KSSQSIVHSNGNTYLE

SEQ ID NO: 33224 - protein, 7 aa, Artificial Sequence
  Description of Artificial Sequence: Synthetic peptide
  XENP023590 vlCDR2
KVSNRFS

SEQ ID NO: 33225 - protein, 9 aa, Artificial Sequence
  Description of Artificial Sequence: Synthetic peptide
  XENP023590 vlCDR3
FQGSHVPNT

SEQ ID NO: 33226 - protein, 251 aa, Artificial Sequence
  Description of Artificial Sequence: Synthetic polypeptide
  XENP023591 1C11_H3_L3.17_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSASVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33227 - protein, 117 aa, Artificial Sequence; identical to SEQ ID NO: 33034
  Description of Artificial Sequence: Synthetic polypeptide
  VH of XENP023591

SEQ ID NO: 33228 - protein, 114 aa, Artificial Sequence
  Description of Artificial Sequence: Synthetic polypeptide
  VL of XENP023591
DVLMTQSPDSLSASVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33229 - protein, 5 aa, Artificial Sequence
  Description of Artificial Sequence: Synthetic peptide
  XENP023591 vhCDR1
HYGMN

SEQ ID NO: 33230 - protein, 17 aa, Artificial Sequence
  Description of Artificial Sequence: Synthetic peptide
  XENP023591 vhCDR2
WINTYTGEPTYADGFTG

SEQ ID NO: 33231 - protein, 8 aa, Artificial Sequence
  Description of Artificial Sequence: Synthetic peptide
  XENP023591 vhCDR3
DYYGSSPY

SEQ ID NO: 33232 - protein, 16 aa, Artificial Sequence
  Description of Artificial Sequence: Synthetic peptide
  XENP023591 vlCDR1
KSSQSIVHSNGNTYLE

SEQ ID NO: 33233 - protein, 7 aa, Artificial Sequence
  Description of Artificial Sequence: Synthetic peptide
  XENP023591 vlCDR2
KVSNRFS

SEQ ID NO: 33234 - protein, 9 aa, Artificial Sequence
  Description of Artificial Sequence: Synthetic peptide
  XENP023591 vlCDR3
FQGSHVPNT

SEQ ID NO: 33235 - protein, 251 aa, Artificial Sequence
  Description of Artificial Sequence: Synthetic polypeptide
  XENP023592 1C11_H3_L3.18_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33236 - protein, 117 aa, Artificial Sequence; identical to SEQ ID NO: 33034
  Description of Artificial Sequence: Synthetic polypeptide
  VH of XENP023592

SEQ ID NO: 33237 - protein, 114 aa, Artificial Sequence
  Description of Artificial Sequence: Synthetic polypeptide
  VL of XENP023592
DVLMTQSPDSLSVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33238 - protein, 5 aa, Artificial Sequence
  Description of Artificial Sequence: Synthetic peptide
  XENP023592 vhCDR1
HYGMN

SEQ ID NO: 33239 - protein, 17 aa, Artificial Sequence
  Description of Artificial Sequence: Synthetic peptide
  XENP023592 vhCDR2
WINTYTGEPTYADGFTG

SEQ ID NO: 33240 - protein, 8 aa, Artificial Sequence
  Description of Artificial Sequence: Synthetic peptide
  XENP023592 vhCDR3
DYYGSSPY

SEQ ID NO: 33241 - protein, 16 aa, Artificial Sequence
  Description of Artificial Sequence: Synthetic peptide
  XENP023592 vlCDR1
KSSQSIVHSNGNTYLE

SEQ ID NO: 33242 - protein, 7 aa, Artificial Sequence
  Description of Artificial Sequence: Synthetic peptide
  XENP023592 vlCDR2
KVSNRFS

SEQ ID NO: 33243 - protein, 9 aa, Artificial Sequence
  Description of Artificial Sequence: Synthetic peptide
  XENP023592 vlCDR3
FQGSHVPNT

SEQ ID NO: 33244 - protein, 251 aa, Artificial Sequence
  Description of Artificial Sequence: Synthetic polypeptide
  XENP023593 1C11_H3_L3.19_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSLSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33245 - protein, 117 aa, Artificial Sequence; identical to SEQ ID NO: 33034
  Description of Artificial Sequence: Synthetic polypeptide
  VH of XENP023593

SEQ ID NO: 33246 - protein, 114 aa, Artificial Sequence
  Description of Artificial Sequence: Synthetic polypeptide
  VL of XENP023593
DVLMTQSPDSLSLSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33247 - protein, 5 aa, Artificial Sequence
  Description of Artificial Sequence: Synthetic peptide
  XENP023593 vhCDR1
HYGMN

SEQ ID NO: 33248 - protein, 17 aa, Artificial Sequence
  Description of Artificial Sequence: Synthetic peptide
  XENP023593 vhCDR2
WINTYTGEPTYADGFTG

SEQ ID NO: 33249 - protein, 8 aa, Artificial Sequence
  Description of Artificial Sequence: Synthetic peptide
  XENP023593 vhCDR3
DYYGSSPY

SEQ ID NO: 33250 - protein, 16 aa, Artificial Sequence
  Description of Artificial Sequence: Synthetic peptide
  XENP023593 vlCDR1
KSSQSIVHSNGNTYLE

SEQ ID NO: 33251 - protein, 7 aa, Artificial Sequence
  Description of Artificial Sequence: Synthetic peptide
  XENP023593 vlCDR2
KVSNRFS

SEQ ID NO: 33252 - protein, 9 aa, Artificial Sequence
  Description of Artificial Sequence: Synthetic peptide
  XENP023593 vlCDR3
FQGSHVPNT

SEQ ID NO: 33253 - protein, 251 aa, Artificial Sequence
  Description of Artificial Sequence: Synthetic polypeptide
  XENP023594 1C11_H3_L3.20_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSSGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33254 - protein, 117 aa, Artificial Sequence; identical to SEQ ID NO: 33034
  Description of Artificial Sequence: Synthetic polypeptide
  VH of XENP023594

SEQ ID NO: 33255 - protein, 114 aa, Artificial Sequence
  Description of Artificial Sequence: Synthetic polypeptide
  VL of XENP023594
DVLMTQSPDSLAVSSGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33256 - protein, 5 aa, Artificial Sequence
  Description of Artificial Sequence: Synthetic peptide
  XENP023594 vhCDR1
HYGMN

SEQ ID NO: 33257 - protein, 17 aa, Artificial Sequence
  Description of Artificial Sequence: Synthetic peptide
  XENP023594 vhCDR2
WINTYTGEPTYADGFTG

SEQ ID NO: 33258 - protein, 8 aa, Artificial Sequence
  Description of Artificial Sequence: Synthetic peptide
  XENP023594 vhCDR3
DYYGSSPY

SEQ ID NO: 33259 - protein, 16 aa, Artificial Sequence
  Description of Artificial Sequence: Synthetic peptide
  XENP023594 vlCDR1
KSSQSIVHSNGNTYLE

SEQ ID NO: 33260 - protein, 7 aa, Artificial Sequence
  Description of Artificial Sequence: Synthetic peptide
  XENP023594 vlCDR2
KVSNRFS

SEQ ID NO: 33261 - protein, 9 aa, Artificial Sequence
  Description of Artificial Sequence: Synthetic peptide
  XENP023594 vlCDR3
FQGSHVPNT

SEQ ID NO: 33262 - protein, 251 aa, Artificial Sequence
  Description of Artificial Sequence: Synthetic polypeptide
  XENP023595 1C11_H3_L3.21_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSTGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33263 - protein, 117 aa, Artificial Sequence; identical to SEQ ID NO: 33034
  Description of Artificial Sequence: Synthetic polypeptide
  VH of XENP023595

SEQ ID NO: 33264 - protein, 114 aa, Artificial Sequence
  Description of Artificial Sequence: Synthetic polypeptide
  VL of XENP023595
DVLMTQSPDSLAVSTGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33265 - protein, 5 aa, Artificial Sequence
  Description of Artificial Sequence: Synthetic peptide
  XENP023595 vhCDR1
HYGMN

SEQ ID NO: 33266 - protein, 17 aa, Artificial Sequence
  Description of Artificial Sequence: Synthetic peptide
  XENP023595 vhCDR2
WINTYTGEPTYADGFTG

SEQ ID NO: 33267 - protein, 8 aa, Artificial Sequence
  Description of Artificial Sequence: Synthetic peptide
  XENP023595 vhCDR3
DYYGSSPY

SEQ ID NO: 33268 - protein, 16 aa, Artificial Sequence
  Description of Artificial Sequence: Synthetic peptide
  XENP023595 vlCDR1
KSSQSIVHSNGNTYLE

SEQ ID NO: 33269 - protein, 7 aa, Artificial Sequence
  Description of Artificial Sequence: Synthetic peptide
  XENP023595 vlCDR2
KVSNRFS

SEQ ID NO: 33270 - protein, 9 aa, Artificial Sequence
  Description of Artificial Sequence: Synthetic peptide
  XENP023595 vlCDR3
FQGSHVPNT

SEQ ID NO: 33271 - protein, 251 aa, Artificial Sequence
  Description of Artificial Sequence: Synthetic polypeptide
  XENP023596 1C11_H3_L3.22_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERITINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33272 - protein, 117 aa, Artificial Sequence; identical to SEQ ID NO: 33034
  Description of Artificial Sequence: Synthetic polypeptide
  VH of XENP023596

SEQ ID NO: 33273 - protein, 114 aa, Artificial Sequence
  Description of Artificial Sequence: Synthetic polypeptide
  VL of XENP023596
DVLMTQSPDSLAVSLGERITINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33274 - protein, 5 aa, Artificial Sequence
  Description of Artificial Sequence: Synthetic peptide
  XENP023596 vhCDR1
HYGMN

SEQ ID NO: 33275 - protein, 17 aa, Artificial Sequence
  Description of Artificial Sequence: Synthetic peptide
  XENP023596 vhCDR2
WINTYTGEPTYADGFTG

SEQ ID NO: 33276 - protein, 8 aa, Artificial Sequence
  Description of Artificial Sequence: Synthetic peptide
  XENP023596 vhCDR3
DYYGSSPY

SEQ ID NO: 33277 - protein, 16 aa, Artificial Sequence
  Description of Artificial Sequence: Synthetic peptide
  XENP023596 vlCDR1
KSSQSIVHSNGNTYLE

SEQ ID NO: 33278 - protein, 7 aa, Artificial Sequence
  Description of Artificial Sequence: Synthetic peptide
  XENP023596 vlCDR2
KVSNRFS

SEQ ID NO: 33279 - protein, 9 aa, Artificial Sequence
  Description of Artificial Sequence: Synthetic peptide
  XENP023596 vlCDR3
FQGSHVPNT

SEQ ID NO: 33280 - protein, 251 aa, Artificial Sequence
  Description of Artificial Sequence: Synthetic polypeptide
  XENP023601 1C11_H3_L3.23_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERVTINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33281 - protein, 117 aa, Artificial Sequence; identical to SEQ ID NO: 33034
  Description of Artificial Sequence: Synthetic polypeptide
  VH of XENP023601

SEQ ID NO: 33282 - protein, 114 aa, Artificial Sequence
  Description of Artificial Sequence: Synthetic polypeptide
  VL of XENP023601
DVLMTQSPDSLAVSLGERVTINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33283 - protein, 5 aa, Artificial Sequence
  Description of Artificial Sequence: Synthetic peptide
  XENP023601 vhCDR1
HYGMN

SEQ ID NO: 33284 - protein, 17 aa, Artificial Sequence
  Description of Artificial Sequence: Synthetic peptide
  XENP023601 vhCDR2
WINTYTGEPTYADGFTG

SEQ ID NO: 33285 - protein, 8 aa, Artificial Sequence
  Description of Artificial Sequence: Synthetic peptide
  XENP023601 vhCDR3
DYYGSSPY

SEQ ID NO: 33286 - protein, 16 aa, Artificial Sequence
  Description of Artificial Sequence: Synthetic peptide
  XENP023601 vlCDR1
KSSQSIVHSNGNTYLE

SEQ ID NO: 33287 - protein, 7 aa, Artificial Sequence
  Description of Artificial Sequence: Synthetic peptide
  XENP023601 vlCDR2
KVSNRFS

SEQ ID NO: 33288 - protein, 9 aa, Artificial Sequence
  Description of Artificial Sequence: Synthetic peptide
  XENP023601 vlCDR3
FQGSHVPNT

SEQ ID NO: 33289 - protein, 251 aa, Artificial Sequence
  Description of Artificial Sequence: Synthetic polypeptide
  XENP023602 1C11_H3_L3.25_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATISCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33290 - protein, 117 aa, Artificial Sequence; identical to SEQ ID NO: 33034
  Description of Artificial Sequence: Synthetic polypeptide
  VH of XENP023602

SEQ ID NO: 33291 - protein, 114 aa, Artificial Sequence
  Description of Artificial Sequence: Synthetic polypeptide
  VL of XENP023602
DVLMTQSPDSLAVSLGERATISCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33292 - protein, 5 aa, Artificial Sequence
  Description of Artificial Sequence: Synthetic peptide
  XENP023602 vhCDR1
HYGMN

SEQ ID NO: 33293 - protein, 17 aa, Artificial Sequence
  Description of Artificial Sequence: Synthetic peptide
  XENP023602 vhCDR2
WINTYTGEPTYADGFTG

SEQ ID NO: 33294 - protein, 8 aa, Artificial Sequence
  Description of Artificial Sequence: Synthetic peptide
  XENP023602 vhCDR3
DYYGSSPY

SEQ ID NO: 33295 - protein, 16 aa, Artificial Sequence
  Description of Artificial Sequence: Synthetic peptide
  XENP023602 vlCDR1
KSSQSIVHSNGNTYLE

SEQ ID NO: 33296 - protein, 7 aa, Artificial Sequence
  Description of Artificial Sequence: Synthetic peptide
  XENP023602 vlCDR2
KVSNRFS

SEQ ID NO: 33297 - protein, 9 aa, Artificial Sequence
  Description of Artificial Sequence: Synthetic peptide
  XENP023602 vlCDR3
FQGSHVPNT

SEQ ID NO: 33298 - protein, 251 aa, Artificial Sequence
  Description of Artificial Sequence: Synthetic polypeptide
  XENP023603 1C11_H3_L3.26_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATITCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33299 - protein, 117 aa, Artificial Sequence; identical to SEQ ID NO: 33034
  Description of Artificial Sequence: Synthetic polypeptide
  VH of XENP023603

SEQ ID NO: 33300 - protein, 114 aa, Artificial Sequence
  Description of Artificial Sequence: Synthetic polypeptide
  VL of XENP023603
DVLMTQSPDSLAVSLGERATITCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33301 - protein, 5 aa, Artificial Sequence
  Description of Artificial Sequence: Synthetic peptide
  XENP023603 vhCDR1
HYGMN

SEQ ID NO: 33302 - protein, 17 aa, Artificial Sequence
  Description of Artificial Sequence: Synthetic peptide
  XENP023603 vhCDR2
WINTYTGEPTYADGFTG

SEQ ID NO: 33303 - protein, 8 aa, Artificial Sequence
  Description of Artificial Sequence: Synthetic peptide
  XENP023603 vhCDR3
DYYGSSPY

SEQ ID NO: 33304 - protein, 16 aa, Artificial Sequence
  Description of Artificial Sequence: Synthetic peptide
  XENP023603 vlCDR1
KSSQSIVHSNGNTYLE

SEQ ID NO: 33305 - protein, 7 aa, Artificial Sequence
  Description of Artificial Sequence: Synthetic peptide
  XENP023603 vlCDR2
KVSNRFS

SEQ ID NO: 33306 - protein, 9 aa, Artificial Sequence
  Description of Artificial Sequence: Synthetic peptide
  XENP023603 vlCDR3
FQGSHVPNT

SEQ ID NO: 33307 - protein, 251 aa, Artificial Sequence
  Description of Artificial Sequence: Synthetic polypeptide
  XENP023604 1C11_H3_L3.27_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCQSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33308 - protein, 117 aa, Artificial Sequence; identical to SEQ ID NO: 33034
  Description of Artificial Sequence: Synthetic polypeptide
  VH of XENP023604

SEQ ID NO: 33309 - protein, 114 aa, Artificial Sequence
  Description of Artificial Sequence: Synthetic polypeptide
  VL of XENP023604
DVLMTQSPDSLAVSLGERATINCQSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33310 - protein, 5 aa, Artificial Sequence
  Description of Artificial Sequence: Synthetic peptide
  XENP023604 vhCDR1
HYGMN

SEQ ID NO: 33311 - protein, 17 aa, Artificial Sequence
  Description of Artificial Sequence: Synthetic peptide
  XENP023604 vhCDR2
WINTYTGEPTYADGFTG

SEQ ID NO: 33312 - protein, 8 aa, Artificial Sequence
  Description of Artificial Sequence: Synthetic peptide
  XENP023604 vhCDR3
DYYGSSPY

SEQ ID NO: 33313 - protein, 16 aa, Artificial Sequence
  Description of Artificial Sequence: Synthetic peptide
  XENP023604 vlCDR1
QSSQSIVHSNGNTYLE

SEQ ID NO: 33314 - protein, 7 aa, Artificial Sequence
  Description of Artificial Sequence: Synthetic peptide
  XENP023604 vlCDR2
KVSNRFS

SEQ ID NO: 33315 - protein, 9 aa, Artificial Sequence
  Description of Artificial Sequence: Synthetic peptide
  XENP023604 vlCDR3
FQGSHVPNT

SEQ ID NO: 33316 - protein, 251 aa, Artificial Sequence
  Description of Artificial Sequence: Synthetic polypeptide
  XENP023605 1C11_H3_L3.28_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCRSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33317 - protein, 117 aa, Artificial Sequence; identical to SEQ ID NO: 33034
  Description of Artificial Sequence: Synthetic polypeptide
  VH of XENP023605

SEQ ID NO: 33318 - protein, 114 aa, Artificial Sequence
  Description of Artificial Sequence: Synthetic polypeptide
  VL of XENP023605
DVLMTQSPDSLAVSLGERATINCRSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33319 - protein, 5 aa, Artificial Sequence
  Description of Artificial Sequence: Synthetic peptide
  XENP023605 vhCDR1
HYGMN

SEQ ID NO: 33320 - protein, 17 aa, Artificial Sequence
  Description of Artificial Sequence: Synthetic peptide
  XENP023605 vhCDR2
WINTYTGEPTYADGFTG

SEQ ID NO: 33321 - protein, 8 aa, Artificial Sequence
  Description of Artificial Sequence: Synthetic peptide
  XENP023605 vhCDR3
DYYGSSPY

SEQ ID NO: 33322 - protein, 16 aa, Artificial Sequence
  Description of Artificial Sequence: Synthetic peptide
  XENP023605 vlCDR1
RSSQSIVHSNGNTYLE

SEQ ID NO: 33323 - protein, 7 aa, Artificial Sequence
  Description of Artificial Sequence: Synthetic peptide
  XENP023605 vlCDR2
KVSNRFS

SEQ ID NO: 33324 - protein, 9 aa, Artificial Sequence
  Description of Artificial Sequence: Synthetic peptide
  XENP023605 vlCDR3
FQGSHVPNT

SEQ ID NO: 33325 - protein, 251 aa, Artificial Sequence
  Description of Artificial Sequence: Synthetic polypeptide
  XENP023606 1C11_H3_L3.29_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCSSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33326 - protein, 117 aa, Artificial Sequence; identical to SEQ ID NO: 33034
  Description of Artificial Sequence: Synthetic polypeptide
  VH of XENP023606

SEQ ID NO: 33327 - protein, 114 aa, Artificial Sequence
  Description of Artificial Sequence: Synthetic polypeptide
  VL of XENP023606
DVLMTQSPDSLAVSLGERATINCSSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33328 - protein, 5 aa, Artificial Sequence
  Description of Artificial Sequence: Synthetic peptide
  XENP023606 vhCDR1
HYGMN

SEQ ID NO: 33329 - protein, 17 aa, Artificial Sequence
  Description of Artificial Sequence: Synthetic peptide
  XENP023606 vhCDR2
WINTYTGEPTYADGFTG

SEQ ID NO: 33330 - protein, 8 aa, Artificial Sequence
  Description of Artificial Sequence: Synthetic peptide
  XENP023606 vhCDR3
DYYGSSPY

SEQ ID NO: 33331 - protein, 16 aa, Artificial Sequence
  Description of Artificial Sequence: Synthetic peptide
  XENP023606 vlCDR1
SSSQSIVHSNGNTYLE

SEQ ID NO: 33332 - protein, 7 aa, Artificial Sequence
  Description of Artificial Sequence: Synthetic peptide
  XENP023606 vlCDR2
KVSNRFS

SEQ ID NO: 33333 - protein, 9 aa, Artificial Sequence
  Description of Artificial Sequence: Synthetic peptide
  XENP023606 vlCDR3
FQGSHVPNT

SEQ ID NO: 33334 - protein, 251 aa, Artificial Sequence
  Description of Artificial Sequence: Synthetic polypeptide
  XENP023607 1C11_H3_L3.30_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCTSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33335 - protein, 117 aa, Artificial Sequence; identical to SEQ ID NO: 33034
  Description of Artificial Sequence: Synthetic polypeptide
  VH of XENP023607

SEQ ID NO: 33336 - protein, 114 aa, Artificial Sequence
  Description of Artificial Sequence: Synthetic polypeptide
  VL of XENP023607
DVLMTQSPDSLAVSLGERATINCTSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33337 - protein, 5 aa, Artificial Sequence
  Description of Artificial Sequence: Synthetic peptide
  XENP023607 vhCDR1
HYGMN

SEQ ID NO: 33338 - protein, 17 aa, Artificial Sequence
  Description of Artificial Sequence: Synthetic peptide
  XENP023607 vhCDR2
WINTYTGEPTYADGFTG

SEQ ID NO: 33339 - protein, 8 aa, Artificial Sequence
  Description of Artificial Sequence: Synthetic peptide
  XENP023607 vhCDR3
DYYGSSPY

SEQ ID NO: 33340 - protein, 16 aa, Artificial Sequence
  Description of Artificial Sequence: Synthetic peptide
  XENP023607 vlCDR1
TSSQSIVHSNGNTYLE

SEQ ID NO: 33341 - protein, 7 aa, Artificial Sequence
  Description of Artificial Sequence: Synthetic peptide
  XENP023607 vlCDR2
KVSNRFS

SEQ ID NO: 33342 - protein, 9 aa, Artificial Sequence
  Description of Artificial Sequence: Synthetic peptide
  XENP023607 vlCDR3
FQGSHVPNT

SEQ ID NO: 33343 - protein, 251 aa, Artificial Sequence
  Description of Artificial Sequence: Synthetic polypeptide
  XENP023608 1C11_H3_L3.31_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKTSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33344 - protein, 117 aa, Artificial Sequence; identical to SEQ ID NO: 33034
  Description of Artificial Sequence: Synthetic polypeptide
  VH of XENP023608

SEQ ID NO: 33345 - protein, 114 aa, Artificial Sequence
  Description of Artificial Sequence: Synthetic polypeptide
  VL of XENP023608
DVLMTQSPDSLAVSLGERATINCKTSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33346 - protein, 5 aa, Artificial Sequence
  Description of Artificial Sequence: Synthetic peptide
  XENP023608 vhCDR1
HYGMN

SEQ ID NO: 33347 - protein, 17 aa, Artificial Sequence
  Description of Artificial Sequence: Synthetic peptide
  XENP023608 vhCDR2
WINTYTGEPTYADGFTG

SEQ ID NO: 33348 - protein, 8 aa, Artificial Sequence
  Description of Artificial Sequence: Synthetic peptide
  XENP023608 vhCDR3
DYYGSSPY

SEQ ID NO: 33349 - protein, 16 aa, Artificial Sequence
  Description of Artificial Sequence: Synthetic peptide
  XENP023608 vlCDR1
KTSQSIVHSNGNTYLE

SEQ ID NO: 33350 - protein, 7 aa, Artificial Sequence
  Description of Artificial Sequence: Synthetic peptide
  XENP023608 vlCDR2
KVSNRFS

SEQ ID NO: 33351 - protein, 9 aa, Artificial Sequence
  Description of Artificial Sequence: Synthetic peptide
  XENP023608 vlCDR3
FQGSHVPNT

SEQ ID NO: 33352 - protein, 251 aa, Artificial Sequence
  Description of Artificial Sequence: Synthetic polypeptide
  XENP023609 1C11_H3_L3.32_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKASQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33353 - protein, 117 aa, Artificial Sequence; identical to SEQ ID NO: 33034
  Description of Artificial Sequence: Synthetic polypeptide
  VH of XENP023609

SEQ ID NO: 33354 - protein, 114 aa, Artificial Sequence
  Description of Artificial Sequence: Synthetic polypeptide
  VL of XENP023609
DVLMTQSPDSLAVSLGERATINCKASQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33355 - protein, 5 aa, Artificial Sequence
  Description of Artificial Sequence: Synthetic peptide
  XENP023609 vhCDR1
HYGMN

SEQ ID NO: 33356 - protein, 17 aa, Artificial Sequence
  Description of Artificial Sequence: Synthetic peptide
  XENP023609 vhCDR2
WINTYTGEPTYADGFTG

SEQ ID NO: 33357 - protein, 8 aa, Artificial Sequence
  Description of Artificial Sequence: Synthetic peptide
  XENP023609 vhCDR3
DYYGSSPY

SEQ ID NO: 33358 - protein, 16 aa, Artificial Sequence
  Description of Artificial Sequence: Synthetic peptide
  XENP023609 vlCDR1
KASQSIVHSNGNTYLE

SEQ ID NO: 33359 - protein, 7 aa, Artificial Sequence
  Description of Artificial Sequence: Synthetic peptide
  XENP023609 vlCDR2
KVSNRFS

SEQ ID NO: 33360 - protein, 9 aa, Artificial Sequence
  Description of Artificial Sequence: Synthetic peptide
  XENP023609 vlCDR3
FQGSHVPNT

SEQ ID NO: 33361 - protein, 251 aa, Artificial Sequence
  Description of Artificial Sequence: Synthetic polypeptide
  XENP023610 1C11_H3_L3.34_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSVVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33362 - protein, 117 aa, Artificial Sequence; identical to SEQ ID NO: 33034
  Description of Artificial Sequence: Synthetic polypeptide
  VH of XENP023610

SEQ ID NO: 33363 - protein, 114 aa, Artificial Sequence
  Description of Artificial Sequence: Synthetic polypeptide
  VL of XENP023610
DVLMTQSPDSLAVSLGERATINCKSSQSVVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33364 - protein, 5 aa, Artificial Sequence
  Description of Artificial Sequence: Synthetic peptide
  XENP023610 vhCDR1
HYGMN

SEQ ID NO: 33365 - protein, 17 aa, Artificial Sequence
  Description of Artificial Sequence: Synthetic peptide
  XENP023610 vhCDR2
WINTYTGEPTYADGFTG

SEQ ID NO: 33366 - protein, 8 aa, Artificial Sequence
  Description of Artificial Sequence: Synthetic peptide
  XENP023610 vhCDR3
DYYGSSPY

SEQ ID NO: 33367 - protein, 16 aa, Artificial Sequence
  Description of Artificial Sequence: Synthetic peptide
  XENP023610 vlCDR1
KSSQSVVHSNGNTYLE

SEQ ID NO: 33368 - protein, 7 aa, Artificial Sequence
  Description of Artificial Sequence: Synthetic peptide
  XENP023610 vlCDR2
KVSNRFS

SEQ ID NO: 33369 - protein, 9 aa, Artificial Sequence
  Description of Artificial Sequence: Synthetic peptide
  XENP023610 vlCDR3
FQGSHVPNT

SEQ ID NO: 33370 - protein, 251 aa, Artificial Sequence
  Description of Artificial Sequence: Synthetic polypeptide
  XENP023611 1C11_H3_L3.35_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSAVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33371 - protein, 117 aa, Artificial Sequence; identical to SEQ ID NO: 33034
  Description of Artificial Sequence: Synthetic polypeptide
  VH of XENP023611

SEQ ID NO: 33372 - protein, 114 aa, Artificial Sequence
  Description of Artificial Sequence: Synthetic polypeptide
  VL of XENP023611
DVLMTQSPDSLAVSLGERATINCKSSQSAVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33373 - protein, 5 aa, Artificial Sequence
  Description of Artificial Sequence: Synthetic peptide
  XENP023611 vhCDR1
HYGMN

SEQ ID NO: 33374 - protein, 17 aa, Artificial Sequence
  Description of Artificial Sequence: Synthetic peptide
  XENP023611 vhCDR2
WINTYTGEPTYADGFTG

SEQ ID NO: 33375 - protein, 8 aa, Artificial Sequence
  Description of Artificial Sequence: Synthetic peptide
  XENP023611 vhCDR3
DYYGSSPY

SEQ ID NO: 33376 - protein, 16 aa, Artificial Sequence
  Description of Artificial Sequence: Synthetic peptide
  XENP023611 vlCDR1
KSSQSAVHSNGNTYLE

SEQ ID NO: 33377 - protein, 7 aa, Artificial Sequence
  Description of Artificial Sequence: Synthetic peptide
  XENP023611 vlCDR2
KVSNRFS

SEQ ID NO: 33378 - protein, 9 aa, Artificial Sequence
  Description of Artificial Sequence: Synthetic peptide
  XENP023611 vlCDR3
FQGSHVPNT

SEQ ID NO: 33379 - protein, 251 aa, Artificial Sequence
  Description of Artificial Sequence: Synthetic polypeptide
  XENP023612 1C11_H3_L3.36_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSSNNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33380 - protein, 117 aa, Artificial Sequence; identical to SEQ ID NO: 33034
  Description of Artificial Sequence: Synthetic polypeptide
  VH of XENP023612

SEQ ID NO: 33381 - protein, 114 aa, Artificial Sequence
  Description of Artificial Sequence: Synthetic polypeptide
  VL of XENP023612
DVLMTQSPDSLAVSLGERATINCKSSQSIVHSSNNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33382 - protein, 5 aa, Artificial Sequence
  Description of Artificial Sequence: Synthetic peptide
  XENP023612 vhCDR1
HYGMN

SEQ ID NO: 33383 - protein, 17 aa, Artificial Sequence
  Description of Artificial Sequence: Synthetic peptide
  XENP023612 vhCDR2
WINTYTGEPTYADGFTG

SEQ ID NO: 33384 - protein, 8 aa, Artificial Sequence
  Description of Artificial Sequence: Synthetic peptide
  XENP023612 vhCDR3
DYYGSSPY

SEQ ID NO: 33385 - protein, 16 aa, Artificial Sequence
  Description of Artificial Sequence: Synthetic peptide
  XENP023612 vlCDR1
KSSQSIVHSSNNTYLE

SEQ ID NO: 33386 - protein, 7 aa, Artificial Sequence
  Description of Artificial Sequence: Synthetic peptide
  XENP023612 vlCDR2
KVSNRFS

SEQ ID NO: 33387 - protein, 9 aa, Artificial Sequence
  Description of Artificial Sequence: Synthetic peptide
  XENP023612 vlCDR3
FQGSHVPNT

SEQ ID NO: 33388 - protein, 251 aa, Artificial Sequence
  Description of Artificial Sequence: Synthetic polypeptide
  XENP023613 1C11_H3_L3.37_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNSYLEWYQQKPGQSPKLLIYKVSNRFSGVPDRFSGSGSGTDFTLTISSLQAEDVAVYYCFQGSHVPNTFGGGTKVEIKGS

SEQ ID NO: 33389 - protein, 117 aa, Artificial Sequence; identical to SEQ ID NO: 33034
  Description of Artificial Sequence: Synthetic polypeptide
  VH of XENP023613

SEQ ID NO: 33390 - protein, 114 aa, Artificial Sequence
  Description of Artificial Sequence: Synthetic polypeptide
  VL of XENP023613
DVLMTQSPDSLAVSLGERATINCKSSQSIVHSNGNSYLEWYQQKPGQSPKLLIYKVSNRFSGVPDRFSGSGSGTDFTLTISSLQAEDVAVYYCFQGSHVPNTFGGGTKVEIKGS

SEQ ID NO: 33391 - protein, 5 aa, Artificial Sequence
  Description of Artificial Sequence: Synthetic peptide
  XENP023613 vhCDR1
HYGMN

SEQ ID NO: 33392 - protein, 17 aa, Artificial Sequence
  Description of Artificial Sequence: Synthetic peptide
  XENP023613 vhCDR2
WINTYTGEPTYADGFTG

SEQ ID NO: 33393 - protein, 8 aa, Artificial Sequence
  Description of Artificial Sequence: Synthetic peptide
  XENP023613 vhCDR3
DYYGSSPY

SEQ ID NO: 33394 - protein, 16 aa, Artificial Sequence
  Description of Artificial Sequence: Synthetic peptide
  XENP023613 vlCDR1
KSSQSIVHSNGNSYLE

SEQ ID NO: 33395 - protein, 7 aa, Artificial Sequence
  Description of Artificial Sequence: Synthetic peptide
  XENP023613 vlCDR2
KVSNRFS

SEQ ID NO: 33396 - protein, 9 aa, Artificial Sequence
  Description of Artificial Sequence: Synthetic peptide
  XENP023613 vlCDR3
FQGSHVPNT

SEQ ID NO: 33397 - protein, 251 aa, Artificial Sequence
  Description of Artificial Sequence: Synthetic polypeptide
  XENP023614 1C11_H3_L3.38_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIKGS

SEQ ID NO: 33398 - protein, 117 aa, Artificial Sequence; identical to SEQ ID NO: 33034
  Description of Artificial Sequence: Synthetic polypeptide
  VH of XENP023614

SEQ ID NO: 33399 - protein, 114 aa, Artificial Sequence
  Description of Artificial Sequence: Synthetic polypeptide
  VL of XENP023614
DVLMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIKGS

SEQ ID NO: 33400 - protein, 5 aa, Artificial Sequence
  Description of Artificial Sequence: Synthetic peptide
  XENP023614 vhCDR1
HYGMN

SEQ ID NO: 33401 - protein, 17 aa, Artificial Sequence
  Description of Artificial Sequence: Synthetic peptide
  XENP023614 vhCDR2
WINTYTGEPTYADGFTG

SEQ ID NO: 33402 - protein, 8 aa, Artificial Sequence
  Description of Artificial Sequence: Synthetic peptide
  XENP023614 vhCDR3
DYYGSSPY

SEQ ID NO: 33403 - protein, 16 aa, Artificial Sequence
  Description of Artificial Sequence: Synthetic peptide
  XENP023614 vlCDR1
KSSQSIVHSNGNNYLE

SEQ ID NO: 33404 - protein, 7 aa, Artificial Sequence
  Description of Artificial Sequence: Synthetic peptide
  XENP023614 vlCDR2
KVSNRFS

SEQ ID NO: 33405 - protein, 9 aa, Artificial Sequence
  Description of Artificial Sequence: Synthetic peptide
  XENP023614 vlCDR3
FQGSHVPNT

SEQ ID NO: 33406 - protein, 251 aa, Artificial Sequence
  Description of Artificial Sequence: Synthetic polypeptide
  XENP023615 1C11_H3_L3.46_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 33407 - protein, 117 aa, Artificial Sequence; identical to SEQ ID NO: 33034
  Description of Artificial Sequence: Synthetic polypeptide
  VH of XENP023615

SEQ ID NO: 33408 - protein, 114 aa, Artificial Sequence
  Description of Artificial Sequence: Synthetic polypeptide
  VL of XENP023615
DVLMTQSPDSLAVSLGERATINCKSSQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 33409 - protein, 5 aa, Artificial Sequence
  Description of Artificial Sequence: Synthetic peptide
  XENP023615 vhCDR1
HYGMN

SEQ ID NO: 33410 - protein, 17 aa, Artificial Sequence
  Description of Artificial Sequence: Synthetic peptide
  XENP023615 vhCDR2
WINTYTGEPTYADGFTG

SEQ ID NO: 33411 - protein, 8 aa, Artificial Sequence
  Description of Artificial Sequence: Synthetic peptide
  XENP023615 vhCDR3
DYYGSSPY

SEQ ID NO: 33412 - protein, 16 aa, Artificial Sequence
  Description of Artificial Sequence: Synthetic peptide
  XENP023615 vlCDR1
KSSQSIVHSNGNTYLE

SEQ ID NO: 33413 - protein, 7 aa, Artificial Sequence
  Description of Artificial Sequence: Synthetic peptide
  XENP023615 vlCDR2
KVSNRFS

SEQ ID NO: 33414 - protein, 9 aa, Artificial Sequence
  Description of Artificial Sequence: Synthetic peptide
  XENP023615 vlCDR3
FQGSHVPNT

SEQ ID NO: 33415 - protein, 251 aa, Artificial Sequence
  Description of Artificial Sequence: Synthetic polypeptide
  XENP023616 1C11_H3_L3.47_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQAPKLLIYKVSNRFSGVPDRFSGSGSGTDFTLTISSLQAEDVAVYYCFQGSHVPNTFGGGTKVEIKGS

SEQ ID NO: 33416 - protein, 117 aa, Artificial Sequence; identical to SEQ ID NO: 33034
  Description of Artificial Sequence: Synthetic polypeptide
  VH of XENP023616

SEQ ID NO: 33417 - protein, 114 aa, Artificial Sequence
  Description of Artificial Sequence: Synthetic polypeptide
  VL of XENP023616
DVLMTQSPDSLAVSLGERATINCKSSQSIVHSNGNTYLEWYQQKPGQAPKLLIYKVSNRFSGVPDRFSGSGSGTDFTLTISSLQAEDVAVYYCFQGSHVPNTFGGGTKVEIKGS

SEQ ID NO: 33418 - protein, 5 aa, Artificial Sequence
  Description of Artificial Sequence: Synthetic peptide
  XENP023616 vhCDR1
HYGMN

SEQ ID NO: 33419 - protein, 17 aa, Artificial Sequence
  Description of Artificial Sequence: Synthetic peptide
  XENP023616 vhCDR2
WINTYTGEPTYADGFTG

SEQ ID NO: 33420 - protein, 8 aa, Artificial Sequence
  Description of Artificial Sequence: Synthetic peptide
  XENP023616 vhCDR3
DYYGSSPY

SEQ ID NO: 33421 - protein, 16 aa, Artificial Sequence
  Description of Artificial Sequence: Synthetic peptide
  XENP023616 vlCDR1
KSSQSIVHSNGNTYLE

SEQ ID NO: 33422 - protein, 7 aa, Artificial Sequence
  Description of Artificial Sequence: Synthetic peptide
  XENP023616 vlCDR2
KVSNRFS

SEQ ID NO: 33423 - protein, 9 aa, Artificial Sequence
  Description of Artificial Sequence: Synthetic peptide
  XENP023616 vlCDR3
FQGSHVPNT

SEQ ID NO: 33424 - protein, 251 aa, Artificial Sequence
  Description of Artificial Sequence: Synthetic polypeptide
  XENP023617 1C11_H3_L3.49_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYGVSNRFSGVPDRFSGSGSGTDFTLTISSLQAEDVAVYYCFQGSHVPNTFGGGTKVEIKGS

SEQ ID NO: 33425 - protein, 117 aa, Artificial Sequence; identical to SEQ ID NO: 33034
  Description of Artificial Sequence: Synthetic polypeptide
  VH of XENP023617

SEQ ID NO: 33426 - protein, 114 aa, Artificial Sequence
  Description of Artificial Sequence: Synthetic polypeptide
  VL of XENP023617
DVLMTQSPDSLAVSLGERATINCKSSQSIVHSNGNTYLEWYQQKPGQSPKLLIYGVSNRFSGVPDRFSGSGSGTDFTLTISSLQAEDVAVYYCFQGSHVPNTFGGGTKVEIKGS

SEQ ID NO: 33427 - protein, 5 aa, Artificial Sequence
  Description of Artificial Sequence: Synthetic peptide
  XENP023617 vhCDR1
HYGMN

SEQ ID NO: 33428 - protein, 17 aa, Artificial Sequence
  Description of Artificial Sequence: Synthetic peptide
  XENP023617 vhCDR2
WINTYTGEPTYADGFTG

SEQ ID NO: 33429 - protein, 8 aa, Artificial Sequence
  Description of Artificial Sequence: Synthetic peptide
  XENP023617 vhCDR3
DYYGSSPY

SEQ ID NO: 33430 - protein, 16 aa, Artificial Sequence
  Description of Artificial Sequence: Synthetic peptide
  XENP023617 vlCDR1
KSSQSIVHSNGNTYLE

SEQ ID NO: 33431 - protein, 7 aa, Artificial Sequence
  Description of Artificial Sequence: Synthetic peptide
  XENP023617 vlCDR2
GVSNRFS

SEQ ID NO: 33432 - protein, 9 aa, Artificial Sequence
  Description of Artificial Sequence: Synthetic peptide
  XENP023617 vlCDR3
FQGSHVPNT

SEQ ID NO: 33433 - protein, 251 aa, Artificial Sequence
  Description of Artificial Sequence: Synthetic polypeptide
  XENP023618 1C11_H3_L3.50_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYSVSNRFSGVPDRFSGSGSGTDFTLTISSLQAEDVAVYYCFQGSHVPNTFGGGTKVEIKGS

SEQ ID NO: 33434 - protein, 117 aa, Artificial Sequence; identical to SEQ ID NO: 33034
  Description of Artificial Sequence: Synthetic polypeptide
  VH of XENP023618

SEQ ID NO: 33435 - protein, 114 aa, Artificial Sequence
  Description of Artificial Sequence: Synthetic polypeptide
  VL of XENP023618
DVLMTQSPDSLAVSLGERATINCKSSQSIVHSNGNTYLEWYQQKPGQSPKLLIYSVSNRFSGVPDRFSGSGSGTDFTLTISSLQAEDVAVYYCFQGSHVPNTFGGGTKVEIKGS

SEQ ID NO: 33436 - protein, 5 aa, Artificial Sequence
  Description of Artificial Sequence: Synthetic peptide
  XENP023618 vhCDR1
HYGMN

SEQ ID NO: 33437 - protein, 17 aa, Artificial Sequence
  Description of Artificial Sequence: Synthetic peptide
  XENP023618 vhCDR2
WINTYTGEPTYADGFTG

SEQ ID NO: 33438 - protein, 8 aa, Artificial Sequence
  Description of Artificial Sequence: Synthetic peptide
  XENP023618 vhCDR3
DYYGSSPY

SEQ ID NO: 33439 - protein, 16 aa, Artificial Sequence
  Description of Artificial Sequence: Synthetic peptide
  XENP023618 vlCDR1
KSSQSIVHSNGNTYLE

SEQ ID NO: 33440 - protein, 7 aa, Artificial Sequence
  Description of Artificial Sequence: Synthetic peptide
  XENP023618 vlCDR2
SVSNRFS

SEQ ID NO: 33441 - protein, 9 aa, Artificial Sequence
  Description of Artificial Sequence: Synthetic peptide
  XENP023618 vlCDR3
FQGSHVPNT

SEQ ID NO: 33442 - protein, 251 aa, Artificial Sequence
  Description of Artificial Sequence: Synthetic polypeptide
  XENP023619 1C11_H3_L3.51_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKASNRFSGVPDRFSGSGSGTDFTLTISSLQAEDVAVYYCFQGSHVPNTFGGGTKVEIKGS

SEQ ID NO: 33443 - protein, 117 aa, Artificial Sequence; identical to SEQ ID NO: 33034
  Description of Artificial Sequence: Synthetic polypeptide
  VH of XENP023619

SEQ ID NO: 33444 - protein, 114 aa, Artificial Sequence
  Description of Artificial Sequence: Synthetic polypeptide
  VL of XENP023619
DVLMTQSPDSLAVSLGERATINCKSSQSIVHSNGNTYLEWYQQKPGQSPKLLIYKASNRFSGVPDRFSGSGSGTDFTLTISSLQAEDVAVYYCFQGSHVPNTFGGGTKVEIKGS

SEQ ID NO: 33445 - protein, 5 aa, Artificial Sequence
  Description of Artificial Sequence: Synthetic peptide
  XENP023619 vhCDR1
HYGMN

SEQ ID NO: 33446 - protein, 17 aa, Artificial Sequence
  Description of Artificial Sequence: Synthetic peptide
  XENP023619 vhCDR2
WINTYTGEPTYADGFTG

SEQ ID NO: 33447 - protein, 8 aa, Artificial Sequence
  Description of Artificial Sequence: Synthetic peptide
  XENP023619 vhCDR3
DYYGSSPY

SEQ ID NO: 33448 - protein, 16 aa, Artificial Sequence
  Description of Artificial Sequence: Synthetic peptide
  XENP023619 vlCDR1
KSSQSIVHSNGNTYLE

SEQ ID NO: 33449 - protein, 7 aa, Artificial Sequence
  Description of Artificial Sequence: Synthetic peptide
  XENP023619 vlCDR2
KASNRFS

SEQ ID NO: 33450 - protein, 9 aa, Artificial Sequence
  Description of Artificial Sequence: Synthetic peptide
  XENP023619 vlCDR3
FQGSHVPNT

SEQ ID NO: 33451 - protein, 251 aa, Artificial Sequence
  Description of Artificial Sequence: Synthetic polypeptide
  XENP023620 1C11_H3_L3.52_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKTSNRFSGVPDRFSGSGSGTDFTLTISSLQAEDVAVYYCFQGSHVPNTFGGGTKVEIKGS

SEQ ID NO: 33452 - protein, 117 aa, Artificial Sequence; identical to SEQ ID NO: 33034
  Description of Artificial Sequence: Synthetic polypeptide
  VH of XENP023620

SEQ ID NO: 33453 - protein, 114 aa, Artificial Sequence
  Description of Artificial Sequence: Synthetic polypeptide
  VL of XENP023620
DVLMTQSPDSLAVSLGERATINCKSSQSIVHSNGNTYLEWYQQKPGQSPKLLIYKTSNRFSGVPDRFSGSGSGTDFTLTISSLQAEDVAVYYCFQGSHVPNTFGGGTKVEIKGS

SEQ ID NO: 33454 - protein, 5 aa, Artificial Sequence
  Description of Artificial Sequence: Synthetic peptide
  XENP023620 vhCDR1
HYGMN

SEQ ID NO: 33455 - protein, 17 aa, Artificial Sequence
  Description of Artificial Sequence: Synthetic peptide
  XENP023620 vhCDR2
WINTYTGEPTYADGFTG

SEQ ID NO: 33456 - protein, 8 aa, Artificial Sequence
  Description of Artificial Sequence: Synthetic peptide
  XENP023620 vhCDR3
DYYGSSPY

SEQ ID NO: 33457 - protein, 16 aa, Artificial Sequence
  Description of Artificial Sequence: Synthetic peptide
  XENP023620 vlCDR1
KSSQSIVHSNGNTYLE

SEQ ID NO: 33458 - protein, 7 aa, Artificial Sequence
  Description of Artificial Sequence: Synthetic peptide
  XENP023620 vlCDR2
KTSNRFS

SEQ ID NO: 33459 - protein, 9 aa, Artificial Sequence
  Description of Artificial Sequence: Synthetic peptide
  XENP023620 vlCDR3
FQGSHVPNT

SEQ ID NO: 33460 - protein, 251 aa, Artificial Sequence
  Description of Artificial Sequence: Synthetic polypeptide
  XENP023621 1C11_H3_L3.53_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKGSNRFSGVPDRFSGSGSGTDFTLTISSLQAEDVAVYYCFQGSHVPNTFGGGTKVEIKGS

SEQ ID NO: 33461 - protein, 117 aa, Artificial Sequence; identical to SEQ ID NO: 33034
  Description of Artificial Sequence: Synthetic polypeptide
  VH of XENP023621

SEQ ID NO: 33462 - protein, 114 aa, Artificial Sequence
  Description of Artificial Sequence: Synthetic polypeptide
  VL of XENP023621
DVLMTQSPDSLAVSLGERATINCKSSQSIVHSNGNTYLEWYQQKPGQSPKLLIYKGSNRFSGVPDRFSGSGSGTDFTLTISSLQAEDVAVYYCFQGSHVPNTFGGGTKVEIKGS

SEQ ID NO: 33463 - protein, 5 aa, Artificial Sequence
  Description of Artificial Sequence: Synthetic peptide
  XENP023621 vhCDR1
HYGMN

SEQ ID NO: 33464 - protein, 17 aa, Artificial Sequence
  Description of Artificial Sequence: Synthetic peptide
  XENP023621 vhCDR2
WINTYTGEPTYADGFTG

SEQ ID NO: 33465 - protein, 8 aa, Artificial Sequence
  Description of Artificial Sequence: Synthetic peptide
  XENP023621 vhCDR3
DYYGSSPY

SEQ ID NO: 33466 - protein, 16 aa, Artificial Sequence
  Description of Artificial Sequence: Synthetic peptide
  XENP023621 vlCDR1
KSSQSIVHSNGNTYLE

SEQ ID NO: 33467 - protein, 7 aa, Artificial Sequence
  Description of Artificial Sequence: Synthetic peptide
  XENP023621 vlCDR2
KGSNRFS

SEQ ID NO: 33468 - protein, 9 aa, Artificial Sequence
  Description of Artificial Sequence: Synthetic peptide
  XENP023621 vlCDR3
FQGSHVPNT

SEQ ID NO: 33469 - protein, 251 aa, Artificial Sequence
  Description of Artificial Sequence: Synthetic polypeptide
  XENP023622 1C11_H3_L3.54_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKMSNRFSGVPDRFSGSGSGTDFTLTISSLQAEDVAVYYCFQGSHVPNTFGGGTKVEIKGS

SEQ ID NO: 33470 - protein, 117 aa, Artificial Sequence; identical to SEQ ID NO: 33034
  Description of Artificial Sequence: Synthetic polypeptide
  VH of XENP023622

SEQ ID NO: 33471 - protein, 114 aa, Artificial Sequence
  Description of Artificial Sequence: Synthetic polypeptide
  VL of XENP023622
DVLMTQSPDSLAVSLGERATINCKSSQSIVHSNGNTYLEWYQQKPGQSPKLLIYKMSNRFSGVPDRFSGSGSGTDFTLTISSLQAEDVAVYYCFQGSHVPNTFGGGTKVEIKGS

SEQ ID NO: 33472 - protein, 5 aa, Artificial Sequence
  Description of Artificial Sequence: Synthetic peptide
  XENP023622 vhCDR1
HYGMN

SEQ ID NO: 33473 - protein, 17 aa, Artificial Sequence
  Description of Artificial Sequence: Synthetic peptide
  XENP023622 vhCDR2
WINTYTGEPTYADGFTG

SEQ ID NO: 33474 - protein, 8 aa, Artificial Sequence
  Description of Artificial Sequence: Synthetic peptide
  XENP023622 vhCDR3
DYYGSSPY

SEQ ID NO: 33475 - protein, 16 aa, Artificial Sequence
  Description of Artificial Sequence: Synthetic peptide
  XENP023622 vlCDR1
KSSQSIVHSNGNTYLE

SEQ ID NO: 33476 - protein, 7 aa, Artificial Sequence
  Description of Artificial Sequence: Synthetic peptide
  XENP023622 vlCDR2
KMSNRFS

SEQ ID NO: 33477 - protein, 9 aa, Artificial Sequence
  Description of Artificial Sequence: Synthetic peptide
  XENP023622 vlCDR3
FQGSHVPNT

SEQ ID NO: 33478 - protein, 251 aa, Artificial Sequence
  Description of Artificial Sequence: Synthetic polypeptide
  XENP023623 1C11_H3_L3.56_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRASGVPDRFSGSGSGTDFTLTISSLQAEDVAVYYCFQGSHVPNTFGGGTKVEIKGS

SEQ ID NO: 33479 - protein, 117 aa, Artificial Sequence; identical to SEQ ID NO: 33034
  Description of Artificial Sequence: Synthetic polypeptide
  VH of XENP023623

SEQ ID NO: 33480 - protein, 114 aa, Artificial Sequence
  Description of Artificial Sequence: Synthetic polypeptide
  VL of XENP023623
DVLMTQSPDSLAVSLGERATINCKSSQSIVHSNGNTYLEWYQQKPGQSPKLLIYKVSNRASGVPDRFSGSGSGTDFTLTISSLQAEDVAVYYCFQGSHVPNTFGGGTKVEIKGS

SEQ ID NO: 33481 - protein, 5 aa, Artificial Sequence
  Description of Artificial Sequence: Synthetic peptide
  XENP023623 vhCDR1
HYGMN

SEQ ID NO: 33482 - protein, 17 aa, Artificial Sequence
  Description of Artificial Sequence: Synthetic peptide
  XENP023623 vhCDR2
WINTYTGEPTYADGFTG

SEQ ID NO: 33483 - protein, 8 aa, Artificial Sequence
  Description of Artificial Sequence: Synthetic peptide
  XENP023623 vhCDR3
DYYGSSPY

SEQ ID NO: 33484 - protein, 16 aa, Artificial Sequence
  Description of Artificial Sequence: Synthetic peptide
  XENP023623 vlCDR1
KSSQSIVHSNGNTYLE

SEQ ID NO: 33485 - protein, 7 aa, Artificial Sequence
  Description of Artificial Sequence: Synthetic peptide
  XENP023623 vlCDR2
KVSNRAS

SEQ ID NO: 33486 - protein, 9 aa, Artificial Sequence
  Description of Artificial Sequence: Synthetic peptide
  XENP023623 vlCDR3
FQGSHVPNT

SEQ ID NO: 33487 - protein, 251 aa, Artificial Sequence
  Description of Artificial Sequence: Synthetic polypeptide
  XENP023624 1C11_H3_L3.57_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFTGVPDRFSGSGSGTDFTLTISSLQAEDVAVYYCFQGSHVPNTFGGGTKVEIKGS

SEQ ID NO: 33488 - protein, 117 aa, Artificial Sequence; identical to SEQ ID NO: 33034
  Description of Artificial Sequence: Synthetic polypeptide
  VH of XENP023624

SEQ ID NO: 33489 - protein, 114 aa, Artificial Sequence
  Description of Artificial Sequence: Synthetic polypeptide
  VL of XENP023624
DVLMTQSPDSLAVSLGERATINCKSSQSIVHSNGNTYLEWYQQKPGQSPKLLIYKVSNRFTGVPDRFSGSGSGTDFTLTISSLQAEDVAVYYCFQGSHVPNTFGGGTKVEIKGS

SEQ ID NO: 33490 - protein, 5 aa, Artificial Sequence
  Description of Artificial Sequence: Synthetic peptide
  XENP023624 vhCDR1
HYGMN

SEQ ID NO: 33491 - protein, 17 aa, Artificial Sequence
  Description of Artificial Sequence: Synthetic peptide
  XENP023624 vhCDR2
WINTYTGEPTYADGFTG

SEQ ID NO: 33492 - protein, 8 aa, Artificial Sequence
  Description of Artificial Sequence: Synthetic peptide
  XENP023624 vhCDR3
DYYGSSPY

SEQ ID NO: 33493 - protein, 16 aa, Artificial Sequence
  Description of Artificial Sequence: Synthetic peptide
  XENP023624 vlCDR1
KSSQSIVHSNGNTYLE

SEQ ID NO: 33494 - protein, 7 aa, Artificial Sequence
  Description of Artificial Sequence: Synthetic peptide
  XENP023624 vlCDR2
KVSNRFT

SEQ ID NO: 33495 - protein, 9 aa, Artificial Sequence
  Description of Artificial Sequence: Synthetic peptide
  XENP023624 vlCDR3
FQGSHVPNT

SEQ ID NO: 33496 - protein, 251 aa, Artificial Sequence
  Description of Artificial Sequence: Synthetic polypeptide
  XENP023625 1C11_H3_L3.58_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISGLQAEDVAVYYCFQGSHVPNTFGGGTKVEIKGS

SEQ ID NO: 33497 - protein, 117 aa, Artificial Sequence; identical to SEQ ID NO: 33034
  Description of Artificial Sequence: Synthetic polypeptide
  VH of XENP023625

SEQ ID NO: 33498 - protein, 114 aa, Artificial Sequence
  Description of Artificial Sequence: Synthetic polypeptide
  VL of XENP023625
DVLMTQSPDSLAVSLGERATINCKSSQSIVHSNGNTYLEWYQQKPGQSPKLLIYKVSNRFSGVPDRFSGSGSGTDFTLTISGLQAEDVAVYYCFQGSHVPNTFGGGTKVEIKGS

SEQ ID NO: 33499 - protein, 5 aa, Artificial Sequence
  Description of Artificial Sequence: Synthetic peptide
  XENP023625 vhCDR1
HYGMN

SEQ ID NO: 33500 - protein, 17 aa, Artificial Sequence
  Description of Artificial Sequence: Synthetic peptide
  XENP023625 vhCDR2
WINTYTGEPTYADGFTG

SEQ ID NO: 33501 - protein, 8 aa, Artificial Sequence
  Description of Artificial Sequence: Synthetic peptide
  XENP023625 vhCDR3
DYYGSSPY

SEQ ID NO: 33502 - protein, 16 aa, Artificial Sequence
  Description of Artificial Sequence: Synthetic peptide
  XENP023625 vlCDR1
KSSQSIVHSNGNTYLE

SEQ ID NO: 33503 - protein, 7 aa, Artificial Sequence
  Description of Artificial Sequence: Synthetic peptide
  XENP023625 vlCDR2
KVSNRFS

SEQ ID NO: 33504 - protein, 9 aa, Artificial Sequence
  Description of Artificial Sequence: Synthetic peptide
  XENP023625 vlCDR3
FQGSHVPNT

SEQ ID NO: 33505 - protein, 251 aa, Artificial Sequence
  Description of Artificial Sequence: Synthetic polypeptide
  XENP023626 1C11_H3_L3.59_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIKGS

SEQ ID NO: 33506 - protein, 117 aa, Artificial Sequence; identical to SEQ ID NO: 33034
  Description of Artificial Sequence: Synthetic polypeptide
  VH of XENP023626

SEQ ID NO: 33507 - protein, 114 aa, Artificial Sequence
  Description of Artificial Sequence: Synthetic polypeptide
  VL of XENP023626
DVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIKGS

SEQ ID NO: 33508 - protein, 5 aa, Artificial Sequence
  Description of Artificial Sequence: Synthetic peptide
  XENP023626 vhCDR1
HYGMN

SEQ ID NO: 33509 - protein, 17 aa, Artificial Sequence
  Description of Artificial Sequence: Synthetic peptide
  XENP023626 vhCDR2
WINTYTGEPTYADGFTG

SEQ ID NO: 33510 - protein, 8 aa, Artificial Sequence
  Description of Artificial Sequence: Synthetic peptide
  XENP023626 vhCDR3
DYYGSSPY

SEQ ID NO: 33511 - protein, 16 aa, Artificial Sequence
  Description of Artificial Sequence: Synthetic peptide
  XENP023626 vlCDR1
KSSQSIVHSNGNTYLE

SEQ ID NO: 33512 - protein, 7 aa, Artificial Sequence
  Description of Artificial Sequence: Synthetic peptide
  XENP023626 vlCDR2
KVSNRFS

SEQ ID NO: 33513 - protein, 9 aa, Artificial Sequence
  Description of Artificial Sequence: Synthetic peptide
  XENP023626 vlCDR3
FQGSHVPNT

SEQ ID NO: 33514 - protein, 251 aa, Artificial Sequence
  Description of Artificial Sequence: Synthetic polypeptide
  XENP023627 1C11_H3_L3.60_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISNLQAEDVAVYYCFQGSHVPNTFGGGTKVEIKGS

SEQ ID NO: 33515 - protein, 117 aa, Artificial Sequence; identical to SEQ ID NO: 33034
  Description of Artificial Sequence: Synthetic polypeptide
  VH of XENP023627

SEQ ID NO: 33516 - protein, 114 aa, Artificial Sequence
  Description of Artificial Sequence: Synthetic polypeptide
  VL of XENP023627
DVLMTQSPDSLAVSLGERATINCKSSQSIVHSNGNTYLEWYQQKPGQSPKLLIYKVSNRFSGVPDRFSGSGSGTDFTLTISNLQAEDVAVYYCFQGSHVPNTFGGGTKVEIKGS

SEQ ID NO: 33517 - protein, 5 aa, Artificial Sequence
  Description of Artificial Sequence: Synthetic peptide
  XENP023627 vhCDR1
HYGMN

SEQ ID NO: 33518 - protein, 17 aa, Artificial Sequence
  Description of Artificial Sequence: Synthetic peptide
  XENP023627 vhCDR2
WINTYTGEPTYADGFTG

SEQ ID NO: 33519 - protein, 8 aa, Artificial Sequence
  Description of Artificial Sequence: Synthetic peptide
  XENP023627 vhCDR3
DYYGSSPY

SEQ ID NO: 33520 - protein, 16 aa, Artificial Sequence
  Description of Artificial Sequence: Synthetic peptide
  XENP023627 vlCDR1
KSSQSIVHSNGNTYLE

SEQ ID NO: 33521 - protein, 7 aa, Artificial Sequence
  Description of Artificial Sequence: Synthetic peptide
  XENP023627 vlCDR2
KVSNRFS

SEQ ID NO: 33522 - protein, 9 aa, Artificial Sequence
  Description of Artificial Sequence: Synthetic peptide
  XENP023627 vlCDR3
FQGSHVPNT

SEQ ID NO: 33523 - protein, 251 aa, Artificial Sequence
  Description of Artificial Sequence: Synthetic polypeptide
  XENP023628 1C11_H3_L3.62_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSMQAEDVAVYYCFQGSHVPNTFGGGTKVEIKGS

SEQ ID NO: 33524 - protein, 117 aa, Artificial Sequence; identical to SEQ ID NO: 33034
  Description of Artificial Sequence: Synthetic polypeptide
  VH of XENP023628

SEQ ID NO: 33525 - protein, 114 aa, Artificial Sequence
  Description of Artificial Sequence: Synthetic polypeptide
  VL of XENP023628
DVLMTQSPDSLAVSLGERATINCKSSQSIVHSNGNTYLEWYQQKPGQSPKLLIYKVSNRFSGVPDRFSGSGSGTDFTLTISSMQAEDVAVYYCFQGSHVPNTFGGGTKVEIKGS

SEQ ID NO: 33526 - protein, 5 aa, Artificial Sequence
  Description of Artificial Sequence: Synthetic peptide
  XENP023628 vhCDR1
HYGMN

SEQ ID NO: 33527 - protein, 17 aa, Artificial Sequence
  Description of Artificial Sequence: Synthetic peptide
  XENP023628 vhCDR2
WINTYTGEPTYADGFTG

SEQ ID NO: 33528 - protein, 8 aa, Artificial Sequence
  Description of Artificial Sequence: Synthetic peptide
  XENP023628 vhCDR3
DYYGSSPY

SEQ ID NO: 33529 - protein, 16 aa, Artificial Sequence
  Description of Artificial Sequence: Synthetic peptide
  XENP023628 vlCDR1
KSSQSIVHSNGNTYLE

SEQ ID NO: 33530 - protein, 7 aa, Artificial Sequence
  Description of Artificial Sequence: Synthetic peptide
  XENP023628 vlCDR2
KVSNRFS

SEQ ID NO: 33531 - protein, 9 aa, Artificial Sequence
  Description of Artificial Sequence: Synthetic peptide
  XENP023628 vlCDR3
FQGSHVPNT

SEQ ID NO: 33532 - protein, 251 aa, Artificial Sequence
  Description of Artificial Sequence: Synthetic polypeptide
  XENP023629 1C11_H3_L3.63_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVQAEDVAVYYCFQGSHVPNTFGGGTKVEIKGS

SEQ ID NO: 33533 - protein, 117 aa, Artificial Sequence; identical to SEQ ID NO: 33034
  Description of Artificial Sequence: Synthetic polypeptide
  VH of XENP023629

SEQ ID NO: 33534 - protein, 114 aa, Artificial Sequence
  Description of Artificial Sequence: Synthetic polypeptide
  VL of XENP023629
DVLMTQSPDSLAVSLGERATINCKSSQSIVHSNGNTYLEWYQQKPGQSPKLLIYKVSNRFSGVPDRFSGSGSGTDFTLTISSVQAEDVAVYYCFQGSHVPNTFGGGTKVEIKGS

SEQ ID NO: 33535 - protein, 5 aa, Artificial Sequence
  Description of Artificial Sequence: Synthetic peptide
  XENP023629 vhCDR1
HYGMN

SEQ ID NO: 33536 - protein, 17 aa, Artificial Sequence
  Description of Artificial Sequence: Synthetic peptide
  XENP023629 vhCDR2
WINTYTGEPTYADGFTG

SEQ ID NO: 33537 - protein, 8 aa, Artificial Sequence
  Description of Artificial Sequence: Synthetic peptide
  XENP023629 vhCDR3
DYYGSSPY

SEQ ID NO: 33538 - protein, 16 aa, Artificial Sequence
  Description of Artificial Sequence: Synthetic peptide
  XENP023629 vlCDR1
KSSQSIVHSNGNTYLE

SEQ ID NO: 33539 - protein, 7 aa, Artificial Sequence
  Description of Artificial Sequence: Synthetic peptide
  XENP023629 vlCDR2
KVSNRFS

SEQ ID NO: 33540 - protein, 9 aa, Artificial Sequence
  Description of Artificial Sequence: Synthetic peptide
  XENP023629 vlCDR3
FQGSHVPNT

SEQ ID NO: 33541 - protein, 251 aa, Artificial Sequence
  Description of Artificial Sequence: Synthetic polypeptide
  XENP023630 1C11_H3_L3.64_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSAQAEDVAVYYCFQGSHVPNTFGGGTKVEIKGS

SEQ ID NO: 33542 - protein, 117 aa, Artificial Sequence; identical to SEQ ID NO: 33034
  Description of Artificial Sequence: Synthetic polypeptide
  VH of XENP023630

SEQ ID NO: 33543 - protein, 114 aa, Artificial Sequence
  Description of Artificial Sequence: Synthetic polypeptide
  VL of XENP023630
DVLMTQSPDSLAVSLGERATINCKSSQSIVHSNGNTYLEWYQQKPGQSPKLLIYKVSNRFSGVPDRFSGSGSGTDFTLTISSAQAEDVAVYYCFQGSHVPNTFGGGTKVEIKGS

SEQ ID NO: 33544 - protein, 5 aa, Artificial Sequence
  Description of Artificial Sequence: Synthetic peptide
  XENP023630 vhCDR1
HYGMN

SEQ ID NO: 33545 - protein, 17 aa, Artificial Sequence
  Description of Artificial Sequence: Synthetic peptide
  XENP023630 vhCDR2
WINTYTGEPTYADGFTG

SEQ ID NO: 33546 - protein, 8 aa, Artificial Sequence
  Description of Artificial Sequence: Synthetic peptide
  XENP023630 vhCDR3
DYYGSSPY

SEQ ID NO: 33547 - protein, 16 aa, Artificial Sequence
  Description of Artificial Sequence: Synthetic peptide
  XENP023630 vlCDR1
KSSQSIVHSNGNTYLE

SEQ ID NO: 33548 - protein, 7 aa, Artificial Sequence
  Description of Artificial Sequence: Synthetic peptide
  XENP023630 vlCDR2
KVSNRFS

SEQ ID NO: 33549 - protein, 9 aa, Artificial Sequence
  Description of Artificial Sequence: Synthetic peptide
  XENP023630 vlCDR3
FQGSHVPNT

SEQ ID NO: 33550 - protein, 251 aa, Artificial Sequence
  Description of Artificial Sequence: Synthetic polypeptide
  XENP023631 1C11_H3_L3.65_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLEAEDVAVYYCFQGSHVPNTFGGGTKVEIKGS

SEQ ID NO: 33551 - protein, 117 aa, Artificial Sequence; identical to SEQ ID NO: 33034
  Description of Artificial Sequence: Synthetic polypeptide
  VH of XENP023631

SEQ ID NO: 33552 - protein, 114 aa, Artificial Sequence
  Description of Artificial Sequence: Synthetic polypeptide
  VL of XENP023631
DVLMTQSPDSLAVSLGERATINCKSSQSIVHSNGNTYLEWYQQKPGQSPKLLIYKVSNRFSGVPDRFSGSGSGTDFTLTISSLEAEDVAVYYCFQGSHVPNTFGGGTKVEIKGS

SEQ ID NO: 33553 - protein, 5 aa, Artificial Sequence
  Description of Artificial Sequence: Synthetic peptide
  XENP023631 vhCDR1
HYGMN

SEQ ID NO: 33554 - protein, 17 aa, Artificial Sequence
  Description of Artificial Sequence: Synthetic peptide
  XENP023631 vhCDR2
WINTYTGEPTYADGFTG

SEQ ID NO: 33555 - protein, 8 aa, Artificial Sequence
  Description of Artificial Sequence: Synthetic peptide
  XENP023631 vhCDR3
DYYGSSPY

SEQ ID NO: 33556 - protein, 16 aa, Artificial Sequence
  Description of Artificial Sequence: Synthetic peptide
  XENP023631 vlCDR1
KSSQSIVHSNGNTYLE

SEQ ID NO: 33557 - protein, 7 aa, Artificial Sequence
  Description of Artificial Sequence: Synthetic peptide
  XENP023631 vlCDR2
KVSNRFS

SEQ ID NO: 33558 - protein, 9 aa, Artificial Sequence
  Description of Artificial Sequence: Synthetic peptide
  XENP023631 vlCDR3
FQGSHVPNT

SEQ ID NO: 33559 - protein, 251 aa, Artificial Sequence
  Description of Artificial Sequence: Synthetic polypeptide
  XENP023632 1C11_H3_L3.66_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQPEDVAVYYCFQGSHVPNTFGGGTKVEIKGS

SEQ ID NO: 33560 - protein, 117 aa, Artificial Sequence; identical to SEQ ID NO: 33034
  Description of Artificial Sequence: Synthetic polypeptide
  VH of XENP023632

SEQ ID NO: 33561 - protein, 114 aa, Artificial Sequence
  Description of Artificial Sequence: Synthetic polypeptide
  VL of XENP023632
DVLMTQSPDSLAVSLGERATINCKSSQSIVHSNGNTYLEWYQQKPGQSPKLLIYKVSNRFSGVPDRFSGSGSGTDFTLTISSLQPEDVAVYYCFQGSHVPNTFGGGTKVEIKGS

SEQ ID NO: 33562 - protein, 5 aa, Artificial Sequence
  Description of Artificial Sequence: Synthetic peptide
  XENP023632 vhCDR1
HYGMN

SEQ ID NO: 33563 - protein, 17 aa, Artificial Sequence
  Description of Artificial Sequence: Synthetic peptide
  XENP023632 vhCDR2
WINTYTGEPTYADGFTG

SEQ ID NO: 33564 - protein, 8 aa, Artificial Sequence
  Description of Artificial Sequence: Synthetic peptide
  XENP023632 vhCDR3
DYYGSSPY

SEQ ID NO: 33565 - protein, 16 aa, Artificial Sequence
  Description of Artificial Sequence: Synthetic peptide
  XENP023632 vlCDR1
KSSQSIVHSNGNTYLE

SEQ ID NO: 33566 - protein, 7 aa, Artificial Sequence
  Description of Artificial Sequence: Synthetic peptide
  XENP023632 vlCDR2
KVSNRFS

SEQ ID NO: 33567 - protein, 9 aa, Artificial Sequence
  Description of Artificial Sequence: Synthetic peptide
  XENP023632 vlCDR3
FQGSHVPNT

SEQ ID NO: 33568 - protein, 251 aa, Artificial Sequence
  Description of Artificial Sequence: Synthetic polypeptide
  XENP023633 1C11_H3_L3.69_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDAAVYYCFQGSHVPNTFGGGTKVEIKGS

SEQ ID NO: 33569 - protein, 117 aa, Artificial Sequence; identical to SEQ ID NO: 33034
  Description of Artificial Sequence: Synthetic polypeptide
  VH of XENP023633

SEQ ID NO: 33570 - protein, 114 aa, Artificial Sequence
  Description of Artificial Sequence: Synthetic polypeptide
  VL of XENP023633
DVLMTQSPDSLAVSLGERATINCKSSQSIVHSNGNTYLEWYQQKPGQSPKLLIYKVSNRFSGVPDRFSGSGSGTDFTLTISSLQAEDAAVYYCFQGSHVPNTFGGGTKVEIKGS

SEQ ID NO: 33571 - protein, 5 aa, Artificial Sequence
  Description of Artificial Sequence: Synthetic peptide
  XENP023633 vhCDR1
HYGMN

SEQ ID NO: 33572 - protein, 17 aa, Artificial Sequence
  Description of Artificial Sequence: Synthetic peptide
  XENP023633 vhCDR2
WINTYTGEPTYADGFTG

SEQ ID NO: 33573 - protein, 8 aa, Artificial Sequence
  Description of Artificial Sequence: Synthetic peptide
  XENP023633 vhCDR3
DYYGSSPY

SEQ ID NO: 33574 - protein, 16 aa, Artificial Sequence
  Description of Artificial Sequence: Synthetic peptide
  XENP023633 vlCDR1
KSSQSIVHSNGNTYLE

SEQ ID NO: 33575 - protein, 7 aa, Artificial Sequence
  Description of Artificial Sequence: Synthetic peptide
  XENP023633 vlCDR2
KVSNRFS

SEQ ID NO: 33576 - protein, 9 aa, Artificial Sequence
  Description of Artificial Sequence: Synthetic peptide
  XENP023633 vlCDR3
FQGSHVPNT

SEQ ID NO: 33577 - protein, 251 aa, Artificial Sequence
  Description of Artificial Sequence: Synthetic polypeptide
  XENP023634 1C11_H3_L3.70_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDFAVYYCFQGSHVPNTFGGGTKVEIKGS

SEQ ID NO: 33578 - protein, 117 aa, Artificial Sequence; identical to SEQ ID NO: 33034
  Description of Artificial Sequence: Synthetic polypeptide
  VH of XENP023634

SEQ ID NO: 33579 - protein, 114 aa, Artificial Sequence
  Description of Artificial Sequence: Synthetic polypeptide
  VL of XENP023634
DVLMTQSPDSLAVSLGERATINCKSSQSIVHSNGNTYLEWYQQKPGQSPKLLIYKVSNRFSGVPDRFSGSGSGTDFTLTISSLQAEDFAVYYCFQGSHVPNTFGGGTKVEIKGS

SEQ ID NO: 33580 - protein, 5 aa, Artificial Sequence
  Description of Artificial Sequence: Synthetic peptide
  XENP023634 vhCDR1
HYGMN

SEQ ID NO: 33581 - protein, 17 aa, Artificial Sequence
  Description of Artificial Sequence: Synthetic peptide
  XENP023634 vhCDR2
WINTYTGEPTYADGFTG

SEQ ID NO: 33582 - protein, 8 aa, Artificial Sequence
  Description of Artificial Sequence: Synthetic peptide
  XENP023634 vhCDR3
DYYGSSPY

SEQ ID NO: 33583 - protein, 16 aa, Artificial Sequence
  Description of Artificial Sequence: Synthetic peptide
  XENP023634 vlCDR1
KSSQSIVHSNGNTYLE

SEQ ID NO: 33584 - protein, 7 aa, Artificial Sequence
  Description of Artificial Sequence: Synthetic peptide
  XENP023634 vlCDR2
KVSNRFS

SEQ ID NO: 33585 - protein, 9 aa, Artificial Sequence
  Description of Artificial Sequence: Synthetic peptide
  XENP023634 vlCDR3
FQGSHVPNT

SEQ ID NO: 33586 - protein, 251 aa, Artificial Sequence
  Description of Artificial Sequence: Synthetic polypeptide
  XENP023635 1C11_H3_L3.72_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVADYYCFQGSHVPNTFGGGTKVEIKGS

SEQ ID NO: 33587 - protein, 117 aa, Artificial Sequence; identical to SEQ ID NO: 33034
  Description of Artificial Sequence: Synthetic polypeptide
  VH of XENP023635

SEQ ID NO: 33588 - protein, 114 aa, Artificial Sequence
  Description of Artificial Sequence: Synthetic polypeptide
  VL of XENP023635
DVLMTQSPDSLAVSLGERATINCKSSQSIVHSNGNTYLEWYQQKPGQSPKLLIYKVSNRFSGVPDRFSGSGSGTDFTLTISSLQAEDVADYYCFQGSHVPNTFGGGTKVEIKGS

SEQ ID NO: 33589 - protein, 5 aa, Artificial Sequence
  Description of Artificial Sequence: Synthetic peptide
  XENP023635 vhCDR1
HYGMN

SEQ ID NO: 33590 - protein, 17 aa, Artificial Sequence
  Description of Artificial Sequence: Synthetic peptide
  XENP023635 vhCDR2
WINTYTGEPTYADGFTG

SEQ ID NO: 33591 - protein, 8 aa, Artificial Sequence
  Description of Artificial Sequence: Synthetic peptide
  XENP023635 vhCDR3
DYYGSSPY

SEQ ID NO: 33592 - protein, 16 aa, Artificial Sequence
  Description of Artificial Sequence: Synthetic peptide
  XENP023635 vlCDR1
KSSQSIVHSNGNTYLE

SEQ ID NO: 33593 - protein, 7 aa, Artificial Sequence
  Description of Artificial Sequence: Synthetic peptide
  XENP023635 vlCDR2
KVSNRFS

SEQ ID NO: 33594 - protein, 9 aa, Artificial Sequence
  Description of Artificial Sequence: Synthetic peptide
  XENP023635 vlCDR3
FQGSHVPNT

SEQ ID NO: 33595 - protein, 251 aa, Artificial Sequence
  Description of Artificial Sequence: Synthetic polypeptide
  XENP023636 1C11_H3_L3.73_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIKGS

SEQ ID NO: 33596 - protein, 117 aa, Artificial Sequence; identical to SEQ ID NO: 33034
  Description of Artificial Sequence: Synthetic polypeptide
  VH of XENP023636

SEQ ID NO: 33597 - protein, 114 aa, Artificial Sequence
  Description of Artificial Sequence: Synthetic polypeptide
  VL of XENP023636
DVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIKGS

SEQ ID NO: 33598 - protein, 5 aa, Artificial Sequence
  Description of Artificial Sequence: Synthetic peptide
  XENP023636 vhCDR1
HYGMN

SEQ ID NO: 33599 - protein, 17 aa, Artificial Sequence
  Description of Artificial Sequence: Synthetic peptide
  XENP023636 vhCDR2
WINTYTGEPTYADGFTG

SEQ ID NO: 33600 - protein, 8 aa, Artificial Sequence
  Description of Artificial Sequence: Synthetic peptide
  XENP023636 vhCDR3
DYYGSSPY

SEQ ID NO: 33601 - protein, 16 aa, Artificial Sequence
  Description of Artificial Sequence: Synthetic peptide
  XENP023636 vlCDR1
KSSQSIVHSNGNTYLE

SEQ ID NO: 33602 - protein, 7 aa, Artificial Sequence
  Description of Artificial Sequence: Synthetic peptide
  XENP023636 vlCDR2
KVSNRFS

SEQ ID NO: 33603 - protein, 9 aa, Artificial Sequence
  Description of Artificial Sequence: Synthetic peptide
  XENP023636 vlCDR3
FQGSHVPNT

SEQ ID NO: 33604 - protein, 251 aa, Artificial Sequence
  Description of Artificial Sequence: Synthetic polypeptide
  XENP023637 1C11_H3_L3.75_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCLQGSHVPNTFGGGTKVEIKGS

SEQ ID NO: 33605 - protein, 117 aa, Artificial Sequence; identical to SEQ ID NO: 33034
  Description of Artificial Sequence: Synthetic polypeptide
  VH of XENP023637

SEQ ID NO: 33606 - protein, 114 aa, Artificial Sequence
  Description of Artificial Sequence: Synthetic polypeptide
  VL of XENP023637
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCLQGSHVPNTFGGGTKVEIKGS

SEQ ID NO: 33607 - protein, 5 aa, Artificial Sequence
  Description of Artificial Sequence: Synthetic peptide
  XENP023637 vhCDR1
HYGMN

SEQ ID NO: 33608 - protein, 17 aa, Artificial Sequence
  Description of Artificial Sequence: Synthetic peptide
  XENP023637 vhCDR2
WINTYTGEPTYADGFTG

SEQ ID NO: 33609 - protein, 8 aa, Artificial Sequence
  Description of Artificial Sequence: Synthetic peptide
  XENP023637 vhCDR3
DYYGSSPY

SEQ ID NO: 33610 - protein, 16 aa, Artificial Sequence
  Description of Artificial Sequence: Synthetic peptide
  XENP023637 vlCDR1
KSSQSIVHSNGNTYLE

SEQ ID NO: 33611 - protein, 7 aa, Artificial Sequence
  Description of Artificial Sequence: Synthetic peptide
  XENP023637 vlCDR2
KVSNRFS

SEQ ID NO: 33612 - protein, 9 aa, Artificial Sequence
  Description of Artificial Sequence: Synthetic peptide
  XENP023637 vlCDR3
LQGSHVPNT

SEQ ID NO: 33613 - protein, 251 aa, Artificial Sequence
  Description of Artificial Sequence: Synthetic polypeptide
  XENP023638 1C11_H3_L3.78_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVGNTFGGGTKVEIKGS

SEQ ID NO: 33614 - protein, 117 aa, Artificial Sequence; identical to SEQ ID NO: 33034
  Description of Artificial Sequence: Synthetic polypeptide
  VH of XENP023638

SEQ ID NO: 33615 - protein, 114 aa, Artificial Sequence
  Description of Artificial Sequence: Synthetic polypeptide
  VL of XENP023638
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVGNTFGGGTKVEIKGS

SEQ ID NO: 33616 - protein, 5 aa, Artificial Sequence
  Description of Artificial Sequence: Synthetic peptide
  XENP023638 vhCDR1
HYGMN

SEQ ID NO: 33617 - protein, 17 aa, Artificial Sequence
  Description of Artificial Sequence: Synthetic peptide
  XENP023638 vhCDR2
WINTYTGEPTYADGFTG

SEQ ID NO: 33618 - protein, 8 aa, Artificial Sequence
  Description of Artificial Sequence: Synthetic peptide
  XENP023638 vhCDR3
DYYGSSPY

SEQ ID NO: 33619 - protein, 16 aa, Artificial Sequence
  Description of Artificial Sequence: Synthetic peptide
  XENP023638 vlCDR1
KSSQSIVHSNGNTYLE

SEQ ID NO: 33620 - protein, 7 aa, Artificial Sequence
  Description of Artificial Sequence: Synthetic peptide
  XENP023638 vlCDR2
KVSNRFS

SEQ ID NO: 33621 - protein, 9 aa, Artificial Sequence
  Description of Artificial Sequence: Synthetic peptide
  XENP023638 vlCDR3
FQGSHVGNT

SEQ ID NO: 33622 - protein, 251 aa, Artificial Sequence
  Description of Artificial Sequence: Synthetic polypeptide
  XENP023639 1C11_H3_L3.79_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVHNTFGGGTKVEIKGS

SEQ ID NO: 33623 - protein, 117 aa, Artificial Sequence; identical to SEQ ID NO: 33034
  Description of Artificial Sequence: Synthetic polypeptide
  VH of XENP023639

SEQ ID NO: 33624 - protein, 114 aa, Artificial Sequence
  Description of Artificial Sequence: Synthetic polypeptide
  VL of XENP023639
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVHNTFGGGTKVEIKGS

SEQ ID NO: 33625 - protein, 5 aa, Artificial Sequence
  Description of Artificial Sequence: Synthetic peptide
  XENP023639 vhCDR1
HYGMN

SEQ ID NO: 33626 - protein, 17 aa, Artificial Sequence
  Description of Artificial Sequence: Synthetic peptide
  XENP023639 vhCDR2
WINTYTGEPTYADGFTG

SEQ ID NO: 33627 - protein, 8 aa, Artificial Sequence
  Description of Artificial Sequence: Synthetic peptide
  XENP023639 vhCDR3
DYYGSSPY

SEQ ID NO: 33628 - protein, 16 aa, Artificial Sequence
  Description of Artificial Sequence: Synthetic peptide
  XENP023639 vlCDR1
KSSQSIVHSNGNTYLE

SEQ ID NO: 33629 - protein, 7 aa, Artificial Sequence
  Description of Artificial Sequence: Synthetic peptide
  XENP023639 vlCDR2
KVSNRFS

SEQ ID NO: 33630 - protein, 9 aa, Artificial Sequence
  Description of Artificial Sequence: Synthetic peptide
  XENP023639 vlCDR3
FQGSHVHNT

SEQ ID NO: 33631 - protein, 251 aa, Artificial Sequence
  Description of Artificial Sequence: Synthetic polypeptide
  XENP023640 1C11_H3_L3.81_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGQGTKVEIKGS

SEQ ID NO: 33632 - protein, 117 aa, Artificial Sequence; identical to SEQ ID NO: 33034
  Description of Artificial Sequence: Synthetic polypeptide
  VH of XENP023640

SEQ ID NO: 33633 - protein, 114 aa, Artificial Sequence
  Description of Artificial Sequence: Synthetic polypeptide
  VL of XENP023640
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGQGTKVEIKGS

SEQ ID NO: 33634 - protein, 5 aa, Artificial Sequence
  Description of Artificial Sequence: Synthetic peptide
  XENP023640 vhCDR1
HYGMN

SEQ ID NO: 33635 - protein, 17 aa, Artificial Sequence
  Description of Artificial Sequence: Synthetic peptide
  XENP023640 vhCDR2
WINTYTGEPTYADGFTG

SEQ ID NO: 33636 - protein, 8 aa, Artificial Sequence
  Description of Artificial Sequence: Synthetic peptide
  XENP023640 vhCDR3
DYYGSSPY

SEQ ID NO: 33637 - protein, 16 aa, Artificial Sequence
  Description of Artificial Sequence: Synthetic peptide
  XENP023640 vlCDR1
KSSQSIVHSNGNTYLE

SEQ ID NO: 33638 - protein, 7 aa, Artificial Sequence
  Description of Artificial Sequence: Synthetic peptide
  XENP023640 vlCDR2
KVSNRFS

SEQ ID NO: 33639 - protein, 9 aa, Artificial Sequence
  Description of Artificial Sequence: Synthetic peptide
  XENP023640 vlCDR3
FQGSHVPNT

SEQ ID NO: 33640 - protein, 251 aa, Artificial Sequence
  Description of Artificial Sequence: Synthetic polypeptide
  XENP023641 1C11_H3_L3.82_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKLEIKGS

SEQ ID NO: 33641 - protein, 117 aa, Artificial Sequence; identical to SEQ ID NO: 33034
  Description of Artificial Sequence: Synthetic polypeptide
  VH of XENP023641

SEQ ID NO: 33642 - protein, 114 aa, Artificial Sequence
  Description of Artificial Sequence: Synthetic polypeptide
  VL of XENP023641
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKLEIKGS

SEQ ID NO: 33643 - protein, 5 aa, Artificial Sequence
  Description of Artificial Sequence: Synthetic peptide
  XENP023641 vhCDR1
HYGMN

SEQ ID NO: 33644 - protein, 17 aa, Artificial Sequence
  Description of Artificial Sequence: Synthetic peptide
  XENP023641 vhCDR2
WINTYTGEPTYADGFTG

SEQ ID NO: 33645 - protein, 8 aa, Artificial Sequence
  Description of Artificial Sequence: Synthetic peptide
  XENP023641 vhCDR3
DYYGSSPY

SEQ ID NO: 33646 - protein, 16 aa, Artificial Sequence
  Description of Artificial Sequence: Synthetic peptide
  XENP023641 vlCDR1
KSSQSIVHSNGNTYLE

SEQ ID NO: 33647 - protein, 7 aa, Artificial Sequence
  Description of Artificial Sequence: Synthetic peptide
  XENP023641 vlCDR2
KVSNRFS

SEQ ID NO: 33648 - protein, 9 aa, Artificial Sequence
  Description of Artificial Sequence: Synthetic peptide
  XENP023641 vlCDR3
FQGSHVPNT

SEQ ID NO: 33649 - protein, 251 aa, Artificial Sequence
  Description of Artificial Sequence: Synthetic polypeptide
  XENP023755 1C11_H3.1_L3_scFv
QVQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33650 - protein, 117 aa, Artificial Sequence
  Description of Artificial Sequence: Synthetic polypeptide
  VH of XENP023755
QVQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33651 - protein, 114 aa, Artificial Sequence
  Description of Artificial Sequence: Synthetic polypeptide
  VL of XENP023755
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33652 - protein, 5 aa, Artificial Sequence
  Description of Artificial Sequence: Synthetic peptide
  XENP023755 vhCDR1
HYGMN

SEQ ID NO: 33653 - protein, 17 aa, Artificial Sequence
  Description of Artificial Sequence: Synthetic peptide
  XENP023755 vhCDR2
WINTYTGEPTYADGFTG

SEQ ID NO: 33654 - protein, 8 aa, Artificial Sequence
  Description of Artificial Sequence: Synthetic peptide
  XENP023755 vhCDR3
DYYGSSPY

SEQ ID NO: 33655 - protein, 16 aa, Artificial Sequence
  Description of Artificial Sequence: Synthetic peptide
  XENP023755 vlCDR1
KSSQSIVHSNGNTYLE

SEQ ID NO: 33656 - protein, 7 aa, Artificial Sequence
  Description of Artificial Sequence: Synthetic peptide
  XENP023755 vlCDR2
KVSNRFS

SEQ ID NO: 33657 - protein, 9 aa, Artificial Sequence
  Description of Artificial Sequence: Synthetic peptide
  XENP023755 vlCDR3
FQGSHVPNT

SEQ ID NO: 33658 - protein, 251 aa, Artificial Sequence
  Description of Artificial Sequence: Synthetic polypeptide
  XENP023756 1C11_H3.2_L3_scFv
QMQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33659 - protein, 117 aa, Artificial Sequence
  Description of Artificial Sequence: Synthetic polypeptide
  VH of XENP023756
QMQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33660 - protein, 114 aa, Artificial Sequence; identical to SEQ ID NO: 33651
  Description of Artificial Sequence: Synthetic polypeptide
  VL of XENP023756

SEQ ID NO: 33661 - protein, 5 aa, Artificial Sequence
  Description of Artificial Sequence: Synthetic peptide
  XENP023756 vhCDR1
HYGMN

SEQ ID NO: 33662 - protein, 17 aa, Artificial Sequence
  Description of Artificial Sequence: Synthetic peptide
  XENP023756 vhCDR2
WINTYTGEPTYADGFTG

SEQ ID NO: 33663 - protein, 8 aa, Artificial Sequence
  Description of Artificial Sequence: Synthetic peptide
  XENP023756 vhCDR3
DYYGSSPY

SEQ ID NO: 33664 - protein, 16 aa, Artificial Sequence
  Description of Artificial Sequence: Synthetic peptide
  XENP023756 vlCDR1
KSSQSIVHSNGNTYLE

SEQ ID NO: 33665 - protein, 7 aa, Artificial Sequence
  Description of Artificial Sequence: Synthetic peptide
  XENP023756 vlCDR2
KVSNRFS

SEQ ID NO: 33666 - protein, 9 aa, Artificial Sequence
  Description of Artificial Sequence: Synthetic peptide
  XENP023756 vlCDR3
FQGSHVPNT

SEQ ID NO: 33667 - protein, 251 aa, Artificial Sequence
  Description of Artificial Sequence: Synthetic polypeptide
  XENP023757 1C11_H3.4_L3_scFv
QIQLQQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33668 - protein, 117 aa, Artificial Sequence
  Description of Artificial Sequence: Synthetic polypeptide
  VH of XENP023757
QIQLQQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33669 - protein, 114 aa, Artificial Sequence; identical to SEQ ID NO: 33651
  Description of Artificial Sequence: Synthetic polypeptide
  VL of XENP023757

SEQ ID NO: 33670 - protein, 5 aa, Artificial Sequence
  Description of Artificial Sequence: Synthetic peptide
  XENP023757 vhCDR1
HYGMN

SEQ ID NO: 33671 - protein, 17 aa, Artificial Sequence
  Description of Artificial Sequence: Synthetic peptide
  XENP023757 vhCDR2
WINTYTGEPTYADGFTG

SEQ ID NO: 33672 - protein, 8 aa, Artificial Sequence
  Description of Artificial Sequence: Synthetic peptide
  XENP023757 vhCDR3
DYYGSSPY

SEQ ID NO: 33673 - protein, 16 aa, Artificial Sequence
  Description of Artificial Sequence: Synthetic peptide
  XENP023757 vlCDR1
KSSQSIVHSNGNTYLE

SEQ ID NO: 33674 - protein, 7 aa, Artificial Sequence
  Description of Artificial Sequence: Synthetic peptide
  XENP023757 vlCDR2
KVSNRFS

SEQ ID NO: 33675 - protein, 9 aa, Artificial Sequence
  Description of Artificial Sequence: Synthetic peptide
  XENP023757 vlCDR3
FQGSHVPNT

SEQ ID NO: 33676 - protein, 251 aa, Artificial Sequence
  Description of Artificial Sequence: Synthetic polypeptide
  XENP023758 1C11_H3.5_L3_scFv
QIQLVQSGAELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33677 - protein, 117 aa, Artificial Sequence
  Description of Artificial Sequence: Synthetic polypeptide
  VH of XENP023758
QIQLVQSGAELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33678 - protein, 114 aa, Artificial Sequence; identical to SEQ ID NO: 33651
  Description of Artificial Sequence: Synthetic polypeptide
  VL of XENP023758

SEQ ID NO: 33679 - protein, 5 aa, Artificial Sequence
  Description of Artificial Sequence: Synthetic peptide
  XENP023758 vhCDR1
HYGMN

SEQ ID NO: 33680 - protein, 17 aa, Artificial Sequence
  Description of Artificial Sequence: Synthetic peptide
  XENP023758 vhCDR2
WINTYTGEPTYADGFTG

SEQ ID NO: 33681 - protein, 8 aa, Artificial Sequence
  Description of Artificial Sequence: Synthetic peptide
  XENP023758 vhCDR3
DYYGSSPY

SEQ ID NO: 33682 - protein, 16 aa, Artificial Sequence
  Description of Artificial Sequence: Synthetic peptide
  XENP023758 vlCDR1
KSSQSIVHSNGNTYLE

SEQ ID NO: 33683 - protein, 7 aa, Artificial Sequence
  Description of Artificial Sequence: Synthetic peptide
  XENP023758 vlCDR2
KVSNRFS

SEQ ID NO: 33684 - protein, 9 aa, Artificial Sequence
  Description of Artificial Sequence: Synthetic peptide
  XENP023758 vlCDR3
FQGSHVPNT

SEQ ID NO: 33685 - protein, 251 aa, Artificial Sequence
  Description of Artificial Sequence: Synthetic polypeptide
  XENP023759 1C11_H3.6_L3_scFv
QIQLVQSGGELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33686 - protein, 117 aa, Artificial Sequence
  Description of Artificial Sequence: Synthetic polypeptide
  VH of XENP023759
QIQLVQSGGELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33687 - protein, 114 aa, Artificial Sequence; identical to SEQ ID NO: 33651
  Description of Artificial Sequence: Synthetic polypeptide
  VL of XENP023759

SEQ ID NO: 33688 - protein, 5 aa, Artificial Sequence
  Description of Artificial Sequence: Synthetic peptide
  XENP023759 vhCDR1
HYGMN

SEQ ID NO: 33689 - protein, 17 aa, Artificial Sequence
  Description of Artificial Sequence: Synthetic peptide
  XENP023759 vhCDR2
WINTYTGEPTYADGFTG

SEQ ID NO: 33690 - protein, 8 aa, Artificial Sequence
  Description of Artificial Sequence: Synthetic peptide
  XENP023759 vhCDR3
DYYGSSPY

SEQ ID NO: 33691 - protein, 16 aa, Artificial Sequence
  Description of Artificial Sequence: Synthetic peptide
  XENP023759 vlCDR1
KSSQSIVHSNGNTYLE

SEQ ID NO: 33692 - protein, 7 aa, Artificial Sequence
  Description of Artificial Sequence: Synthetic peptide
  XENP023759 vlCDR2
KVSNRFS

SEQ ID NO: 33693 - protein, 9 aa, Artificial Sequence
  Description of Artificial Sequence: Synthetic peptide
  XENP023759 vlCDR3
FQGSHVPNT

SEQ ID NO: 33694 - protein, 251 aa, Artificial Sequence
  Description of Artificial Sequence: Synthetic polypeptide
  XENP023760 1C11_H3.7_L3_scFv
QIQLVQSGPELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33695 - protein, 117 aa, Artificial Sequence
  Description of Artificial Sequence: Synthetic polypeptide
  VH of XENP023760
QIQLVQSGPELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33696 - protein, 114 aa, Artificial Sequence; identical to SEQ ID NO: 33651
  Description of Artificial Sequence: Synthetic polypeptide
  VL of XENP023760

SEQ ID NO: 33697 - protein, 5 aa, Artificial Sequence
  Description of Artificial Sequence: Synthetic peptide
  XENP023760 vhCDR1
HYGMN

SEQ ID NO: 33698 - protein, 17 aa, Artificial Sequence
  Description of Artificial Sequence: Synthetic peptide
  XENP023760 vhCDR2
WINTYTGEPTYADGFTG

SEQ ID NO: 33699 - protein, 8 aa, Artificial Sequence
  Description of Artificial Sequence: Synthetic peptide
  XENP023760 vhCDR3
DYYGSSPY

SEQ ID NO: 33700 - protein, 16 aa, Artificial Sequence
  Description of Artificial Sequence: Synthetic peptide
  XENP023760 vlCDR1
KSSQSIVHSNGNTYLE

SEQ ID NO: 33701 - protein, 7 aa, Artificial Sequence
  Description of Artificial Sequence: Synthetic peptide
  XENP023760 vlCDR2
KVSNRFS

SEQ ID NO: 33702 - protein, 9 aa, Artificial Sequence
  Description of Artificial Sequence: Synthetic peptide
  XENP023760 vlCDR3
FQGSHVPNT

SEQ ID NO: 33703 - protein, 251 aa, Artificial Sequence
  Description of Artificial Sequence: Synthetic polypeptide
  XENP023761 1C11_H3.8_L3_scFv
QIQLVQSGHELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33704 - protein, 117 aa, Artificial Sequence
  Description of Artificial Sequence: Synthetic polypeptide
  VH of XENP023761
QIQLVQSGHELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33705 - protein, 114 aa, Artificial Sequence; identical to SEQ ID NO: 33651
  Description of Artificial Sequence: Synthetic polypeptide
  VL of XENP023761

SEQ ID NO: 33706 - protein, 5 aa, Artificial Sequence
  Description of Artificial Sequence: Synthetic peptide
  XENP023761 vhCDR1
HYGMN

SEQ ID NO: 33707 - protein, 17 aa, Artificial Sequence
  Description of Artificial Sequence: Synthetic peptide
  XENP023761 vhCDR2
WINTYTGEPTYADGFTG

SEQ ID NO: 33708 - protein, 8 aa, Artificial Sequence
  Description of Artificial Sequence: Synthetic peptide
  XENP023761 vhCDR3
DYYGSSPY

SEQ ID NO: 33709 - protein, 16 aa, Artificial Sequence
  Description of Artificial Sequence: Synthetic peptide
  XENP023761 vlCDR1
KSSQSIVHSNGNTYLE

SEQ ID NO: 33710 - protein, 7 aa, Artificial Sequence
  Description of Artificial Sequence: Synthetic peptide
  XENP023761 vlCDR2
KVSNRFS

SEQ ID NO: 33711 - protein, 9 aa, Artificial Sequence
  Description of Artificial Sequence: Synthetic peptide
  XENP023761 vlCDR3
FQGSHVPNT

SEQ ID NO: 33712 - protein, 251 aa, Artificial Sequence
  Description of Artificial Sequence: Synthetic polypeptide
  XENP023762 1C11_H3.11_L3_scFv
QIQLVQSGSELKKPGASVKLSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33713 - protein, 117 aa, Artificial Sequence
  Description of Artificial Sequence: Synthetic polypeptide
  VH of XENP023762
QIQLVQSGSELKKPGASVKLSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33714 - protein, 114 aa, Artificial Sequence; identical to SEQ ID NO: 33651
  Description of Artificial Sequence: Synthetic polypeptide
  VL of XENP023762

SEQ ID NO: 33715 - protein, 5 aa, Artificial Sequence
  Description of Artificial Sequence: Synthetic peptide
  XENP023762 vhCDR1
HYGMN

SEQ ID NO: 33716 - protein, 17 aa, Artificial Sequence
  Description of Artificial Sequence: Synthetic peptide
  XENP023762 vhCDR2
WINTYTGEPTYADGFTG

SEQ ID NO: 33717 - protein, 8 aa, Artificial Sequence
  Description of Artificial Sequence: Synthetic peptide
  XENP023762 vhCDR3
DYYGSSPY

SEQ ID NO: 33718 - protein, 16 aa, Artificial Sequence
  Description of Artificial Sequence: Synthetic peptide
  XENP023762 vlCDR1
KSSQSIVHSNGNTYLE

SEQ ID NO: 33719 - protein, 7 aa, Artificial Sequence
  Description of Artificial Sequence: Synthetic peptide
  XENP023762 vlCDR2
KVSNRFS

SEQ ID NO: 33720 - protein, 9 aa, Artificial Sequence
  Description of Artificial Sequence: Synthetic peptide
  XENP023762 vlCDR3
FQGSHVPNT

SEQ ID NO: 33721 - protein, 251 aa, Artificial Sequence
  Description of Artificial Sequence: Synthetic polypeptide
  XENP023763 1C11_H3.12_L3_scFv
QIQLVQSGSELKKPGASVKMSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33722 - protein, 117 aa, Artificial Sequence
  Description of Artificial Sequence: Synthetic polypeptide
  VH of XENP023763
QIQLVQSGSELKKPGASVKMSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33723 - protein, 114 aa, Artificial Sequence; identical to SEQ ID NO: 33651
  Description of Artificial Sequence: Synthetic polypeptide
  VL of XENP023763

SEQ ID NO: 33724 - protein, 5 aa, Artificial Sequence
  Description of Artificial Sequence: Synthetic peptide
  XENP023763 vhCDR1
HYGMN

SEQ ID NO: 33725 - protein, 17 aa, Artificial Sequence
  Description of Artificial Sequence: Synthetic peptide
  XENP023763 vhCDR2
WINTYTGEPTYADGFTG

SEQ ID NO: 33726 - protein, 8 aa, Artificial Sequence
  Description of Artificial Sequence: Synthetic peptide
  XENP023763 vhCDR3
DYYGSSPY

SEQ ID NO: 33727 - protein, 16 aa, Artificial Sequence
  Description of Artificial Sequence: Synthetic peptide
  XENP023763 vlCDR1
KSSQSIVHSNGNTYLE

SEQ ID NO: 33728 - protein, 7 aa, Artificial Sequence
  Description of Artificial Sequence: Synthetic peptide
  XENP023763 vlCDR2
KVSNRFS

SEQ ID NO: 33729 - protein, 9 aa, Artificial Sequence
  Description of Artificial Sequence: Synthetic peptide
  XENP023763 vlCDR3
FQGSHVPNT

SEQ ID NO: 33730 - protein, 251 aa, Artificial Sequence
  Description of Artificial Sequence: Synthetic polypeptide
  XENP023764 1C11_H3.16_L3_scFv
QIQLVQSGSELKKPGASVKVSCKASGYTFTHYAMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33731 - protein, 117 aa, Artificial Sequence
  Description of Artificial Sequence: Synthetic polypeptide
  VH of XENP023764
QIQLVQSGSELKKPGASVKVSCKASGYTFTHYAMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33732 - protein, 114 aa, Artificial Sequence; identical to SEQ ID NO: 33651
  Description of Artificial Sequence: Synthetic polypeptide
  VL of XENP023764

SEQ ID NO: 33733 - protein, 5 aa, Artificial Sequence
  Description of Artificial Sequence: Synthetic peptide
  XENP023764 vhCDR1
HYAMN

SEQ ID NO: 33734 - protein, 17 aa, Artificial Sequence
  Description of Artificial Sequence: Synthetic peptide
  XENP023764 vhCDR2
WINTYTGEPTYADGFTG

SEQ ID NO: 33735 - protein, 8 aa, Artificial Sequence
  Description of Artificial Sequence: Synthetic peptide
  XENP023764 vhCDR3
DYYGSSPY

SEQ ID NO: 33736 - protein, 16 aa, Artificial Sequence
  Description of Artificial Sequence: Synthetic peptide
  XENP023764 vlCDR1
KSSQSIVHSNGNTYLE

SEQ ID NO: 33737 - protein, 7 aa, Artificial Sequence
  Description of Artificial Sequence: Synthetic peptide
  XENP023764 vlCDR2
KVSNRFS

SEQ ID NO: 33738 - protein, 9 aa, Artificial Sequence
  Description of Artificial Sequence: Synthetic peptide
  XENP023764 vlCDR3
FQGSHVPNT

SEQ ID NO: 33739 - protein, 251 aa, Artificial Sequence
  Description of Artificial Sequence: Synthetic polypeptide
  XENP023765 1C11_H3.18_L3_scFv
QIQLVQSGSELKKPGASVKVSCKASGYTFTHYGMNWVKQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33740 - protein, 117 aa, Artificial Sequence
  Description of Artificial Sequence: Synthetic polypeptide
  VH of XENP023765
QIQLVQSGSELKKPGASVKVSCKASGYTFTHYGMNWVKQAPGQGLEWMGWINTYTGEPTYADGFTGRFVFSLDTSVSTAYLQISSLKAEDTAVYFCARDYYGSSPYWGQGTLVTVSS

SEQ ID NO: 33741 - protein, 114 aa, Artificial Sequence; identical to SEQ ID NO: 33651
  Description of Artificial Sequence: Synthetic polypeptide
  VL of XENP023765

SEQ ID NO: 33742 - protein, 5 aa, Artificial Sequence
  Description of Artificial Sequence: Synthetic peptide
  XENP023765 vhCDR1
HYGMN

SEQ ID NO: 33743 - protein, 17 aa, Artificial Sequence
  Description of Artificial Sequence: Synthetic peptide
  XENP023765 vhCDR2
WINTYTGEPTYADGFTG

SEQ ID NO: 33744 - protein, 8 aa, Artificial Sequence
  Description of Artificial Sequence: Synthetic peptide
  XENP023765 vhCDR3
DYYGSSPY

SEQ ID NO: 33745 - protein, 16 aa, Artificial Sequence
  Description of Artificial Sequence: Synthetic peptide
  XENP023765 vlCDR1
KSSQSIVHSNGNTYLE

SEQ ID NO: 33746 - protein, 7 aa, Artificial Sequence
  Description of Artificial Sequence: Synthetic peptide
  XENP023765 vlCDR2
KVSNRFS

SEQ ID NO: 33747 - protein, 9 aa, Artificial Sequence
  Description of Artificial Sequence: Synthetic peptide
  XENP023765 vlCDR3
FQGSHVPNT

SEQ ID NO: 33748 - protein, 251 aa, Artificial Sequence
  Description of Artificial Sequence: Synthetic polypeptide
  XENP023766 1C11_H3.19_L3_scFv
QIQLVQSGSELKKPGASVKVSCKASGYTFTHYGMNWVRQAPGKGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33749 - protein, 117 aa, Artificial Sequence
  Description of Artificial Sequence: Synthetic polypeptide
  VH of XENP023766
QIQLVQSGSELKKPGASVKVSCKASGYTFTHYGMNWVRQAPGKGLEWMGWINTYTGEPTYADGFTGRFVFSLDTSVSTAYLQISSLKAEDTAVYFCARDYYGSSPYWGQGTLVTVSS

SEQ ID NO: 33750 - protein, 114 aa, Artificial Sequence; identical to SEQ ID NO: 33651
  Description of Artificial Sequence: Synthetic polypeptide
  VL of XENP023766

SEQ ID NO: 33751 - protein, 5 aa, Artificial Sequence
  Description of Artificial Sequence: Synthetic peptide
  XENP023766 vhCDR1
HYGMN

SEQ ID NO: 33752 - protein, 17 aa, Artificial Sequence
  Description of Artificial Sequence: Synthetic peptide
  XENP023766 vhCDR2
WINTYTGEPTYADGFTG

SEQ ID NO: 33753 - protein, 8 aa, Artificial Sequence
  Description of Artificial Sequence: Synthetic peptide
  XENP023766 vhCDR3
DYYGSSPY

SEQ ID NO: 33754 - protein, 16 aa, Artificial Sequence
  Description of Artificial Sequence: Synthetic peptide
  XENP023766 vlCDR1
KSSQSIVHSNGNTYLE

SEQ ID NO: 33755 - protein, 7 aa, Artificial Sequence
  Description of Artificial Sequence: Synthetic peptide
  XENP023766 vlCDR2
KVSNRFS

SEQ ID NO: 33756 - protein, 9 aa, Artificial Sequence
  Description of Artificial Sequence: Synthetic peptide
  XENP023766 vlCDR3
FQGSHVPNT

SEQ ID NO: 33757 - protein, 251 aa, Artificial Sequence
  Description of Artificial Sequence: Synthetic polypeptide
  XENP023767 1C11_H3.20_L3_scFv
QIQLVQSGSELKKPGASVKVSCKASGYTFTHYGMNWVRQAPGRGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33758 - protein, 117 aa, Artificial Sequence
  Description of Artificial Sequence: Synthetic polypeptide
  VH of XENP023767
QIQLVQSGSELKKPGASVKVSCKASGYTFTHYGMNWVRQAPGRGLEWMGWINTYTGEPTYADGFTGRFVFSLDTSVSTAYLQISSLKAEDTAVYFCARDYYGSSPYWGQGTLVTVSS

SEQ ID NO: 33759 - protein, 114 aa, Artificial Sequence; identical to SEQ ID NO: 33651
  Description of Artificial Sequence: Synthetic polypeptide
  VL of XENP023767

SEQ ID NO: 33760 - protein, 5 aa, Artificial Sequence
  Description of Artificial Sequence: Synthetic peptide
  XENP023767 vhCDR1
HYGMN

SEQ ID NO: 33761 - protein, 17 aa, Artificial Sequence
  Description of Artificial Sequence: Synthetic peptide
  XENP023767 vhCDR2
WINTYTGEPTYADGFTG

SEQ ID NO: 33762 - protein, 8 aa, Artificial Sequence
  Description of Artificial Sequence: Synthetic peptide
  XENP023767 vhCDR3
DYYGSSPY

SEQ ID NO: 33763 - protein, 16 aa, Artificial Sequence
  Description of Artificial Sequence: Synthetic peptide
  XENP023767 vlCDR1
KSSQSIVHSNGNTYLE

SEQ ID NO: 33764 - protein, 7 aa, Artificial Sequence
  Description of Artificial Sequence: Synthetic peptide
  XENP023767 vlCDR2
KVSNRFS

SEQ ID NO: 33765 - protein, 9 aa, Artificial Sequence
  Description of Artificial Sequence: Synthetic peptide
  XENP023767 vlCDR3
FQGSHVPNT

SEQ ID NO: 33766 - protein, 251 aa, Artificial Sequence
  Description of Artificial Sequence: Synthetic polypeptide
  XENP023768 1C11_H3.21_L3_scFv
QIQLVQSGSELKKPGASVKVSCKASGYTFTHYGMNWVRQAPGHGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33767 - protein, 117 aa, Artificial Sequence
  Description of Artificial Sequence: Synthetic polypeptide
  VH of XENP023768
QIQLVQSGSELKKPGASVKVSCKASGYTFTHYGMNWVRQAPGHGLEWMGWINTYTGEPTYADGFTGRFVFSLDTSVSTAYLQISSLKAEDTAVYFCARDYYGSSPYWGQGTLVTVSS

SEQ ID NO: 33768 - protein, 114 aa, Artificial Sequence; identical to SEQ ID NO: 33651
  Description of Artificial Sequence: Synthetic polypeptide
  VL of XENP023768

SEQ ID NO: 33769 - protein, 5 aa, Artificial Sequence
  Description of Artificial Sequence: Synthetic peptide
  XENP023768 vhCDR1
HYGMN

SEQ ID NO: 33770 - protein, 17 aa, Artificial Sequence
  Description of Artificial Sequence: Synthetic peptide
  XENP023768 vhCDR2
WINTYTGEPTYADGFTG

SEQ ID NO: 33771 - protein, 8 aa, Artificial Sequence
  Description of Artificial Sequence: Synthetic peptide
  XENP023768 vhCDR3
DYYGSSPY

SEQ ID NO: 33772 - protein, 16 aa, Artificial Sequence
  Description of Artificial Sequence: Synthetic peptide
  XENP023768 vlCDR1
KSSQSIVHSNGNTYLE

SEQ ID NO: 33773 - protein, 7 aa, Artificial Sequence
  Description of Artificial Sequence: Synthetic peptide
  XENP023768 vlCDR2
KVSNRFS

SEQ ID NO: 33774 - protein, 9 aa, Artificial Sequence
  Description of Artificial Sequence: Synthetic peptide
  XENP023768 vlCDR3
FQGSHVPNT

SEQ ID NO: 33775 - protein, 251 aa, Artificial Sequence
  Description of Artificial Sequence: Synthetic polypeptide
  XENP023769 1C11_H3.22_L3_scFv
QIQLVQSGSELKKPGASVKVSCKASGYTFTHYGMNWVRQAPGEGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33776 - protein, 117 aa, Artificial Sequence
  Description of Artificial Sequence: Synthetic polypeptide
  VH of XENP023769
QIQLVQSGSELKKPGASVKVSCKASGYTFTHYGMNWVRQAPGEGLEWMGWINTYTGEPTYADGFTGRFVFSLDTSVSTAYLQISSLKAEDTAVYFCARDYYGSSPYWGQGTLVTVSS

SEQ ID NO: 33777 - protein, 114 aa, Artificial Sequence; identical to SEQ ID NO: 33651
  Description of Artificial Sequence: Synthetic polypeptide
  VL of XENP023769

SEQ ID NO: 33778 - protein, 5 aa, Artificial Sequence
  Description of Artificial Sequence: Synthetic peptide
  XENP023769 vhCDR1
HYGMN

SEQ ID NO: 33779 - protein, 17 aa, Artificial Sequence
  Description of Artificial Sequence: Synthetic peptide
  XENP023769 vhCDR2
WINTYTGEPTYADGFTG

SEQ ID NO: 33780 - protein, 8 aa, Artificial Sequence
  Description of Artificial Sequence: Synthetic peptide
  XENP023769 vhCDR3
DYYGSSPY

SEQ ID NO: 33781 - protein, 16 aa, Artificial Sequence
  Description of Artificial Sequence: Synthetic peptide
  XENP023769 vlCDR1
KSSQSIVHSNGNTYLE

SEQ ID NO: 33782 - protein, 7 aa, Artificial Sequence
  Description of Artificial Sequence: Synthetic peptide
  XENP023769 vlCDR2
KVSNRFS

SEQ ID NO: 33783 - protein, 9 aa, Artificial Sequence
  Description of Artificial Sequence: Synthetic peptide
  XENP023769 vlCDR3
FQGSHVPNT

SEQ ID NO: 33784 - protein, 251 aa, Artificial Sequence
  Description of Artificial Sequence: Synthetic polypeptide
  XENP023770 1C11_H3.25_L3_scFv
QIQLVQSGSELKKPGASVKVSCKASGYTFTHYGMNWVRQAPGQGLEWMGWINTNTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33785 - protein, 117 aa, Artificial Sequence
  Description of Artificial Sequence: Synthetic polypeptide
  VH of XENP023770
QIQLVQSGSELKKPGASVKVSCKASGYTFTHYGMNWVRQAPGQGLEWMGWINTNTGEPTYADGFTGRFVFSLDTSVSTAYLQISSLKAEDTAVYFCARDYYGSSPYWGQGTLVTVSS

SEQ ID NO: 33786 - protein, 114 aa, Artificial Sequence; identical to SEQ ID NO: 33651
  Description of Artificial Sequence: Synthetic polypeptide
  VL of XENP023770

SEQ ID NO: 33787 - protein, 5 aa, Artificial Sequence
  Description of Artificial Sequence: Synthetic peptide
  XENP023770 vhCDR1
HYGMN

SEQ ID NO: 33788 - protein, 17 aa, Artificial Sequence
  Description of Artificial Sequence: Synthetic peptide
  XENP023770 vhCDR2
WINTNTGEPTYADGFTG

SEQ ID NO: 33789 - protein, 8 aa, Artificial Sequence
  Description of Artificial Sequence: Synthetic peptide
  XENP023770 vhCDR3
DYYGSSPY

SEQ ID NO: 33790 - protein, 16 aa, Artificial Sequence
  Description of Artificial Sequence: Synthetic peptide
  XENP023770 vlCDR1
KSSQSIVHSNGNTYLE

SEQ ID NO: 33791 - protein, 7 aa, Artificial Sequence
  Description of Artificial Sequence: Synthetic peptide
  XENP023770 vlCDR2
KVSNRFS

SEQ ID NO: 33792 - protein, 9 aa, Artificial Sequence
  Description of Artificial Sequence: Synthetic peptide
  XENP023770 vlCDR3
FQGSHVPNT

SEQ ID NO: 33793 - protein, 251 aa, Artificial Sequence
  Description of Artificial Sequence: Synthetic polypeptide
  XENP023771 1C11_H3.26_L3_scFv
QIQLVQSGSELKKPGASVKVSCKASGYTFTHYGMNWVRQAPGQGLEWMGWINTYTGHPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33794 - protein, 117 aa, Artificial Sequence
  Description of Artificial Sequence: Synthetic polypeptide
  VH of XENP023771
QIQLVQSGSELKKPGASVKVSCKASGYTFTHYGMNWVRQAPGQGLEWMGWINTYTGHPTYADGFTGRFVFSLDTSVSTAYLQISSLKAEDTAVYFCARDYYGSSPYWGQGTLVTVSS

SEQ ID NO: 33795 - protein, 114 aa, Artificial Sequence; identical to SEQ ID NO: 33651
  Description of Artificial Sequence: Synthetic polypeptide
  VL of XENP023771

SEQ ID NO: 33796 - protein, 5 aa, Artificial Sequence
  Description of Artificial Sequence: Synthetic peptide
  XENP023771 vhCDR1
HYGMN

SEQ ID NO: 33797 - protein, 17 aa, Artificial Sequence
  Description of Artificial Sequence: Synthetic peptide
  XENP023771 vhCDR2
WINTYTGHPTYADGFTG

SEQ ID NO: 33798 - protein, 8 aa, Artificial Sequence
  Description of Artificial Sequence: Synthetic peptide
  XENP023771 vhCDR3
DYYGSSPY

SEQ ID NO: 33799 - protein, 16 aa, Artificial Sequence
  Description of Artificial Sequence: Synthetic peptide
  XENP023771 vlCDR1
KSSQSIVHSNGNTYLE

SEQ ID NO: 33800 - protein, 7 aa, Artificial Sequence
  Description of Artificial Sequence: Synthetic peptide
  XENP023771 vlCDR2
KVSNRFS

SEQ ID NO: 33801 - protein, 9 aa, Artificial Sequence
  Description of Artificial Sequence: Synthetic peptide
  XENP023771 vlCDR3
FQGSHVPNT

SEQ ID NO: 33802 - protein, 251 aa, Artificial Sequence
  Description of Artificial Sequence: Synthetic polypeptide
  XENP023772 1C11_H3.30_L3_scFv
QIQLVQSGSELKKPGASVKVSCKASGYTFTHYGMNWVRQAPGQGLEWMGWINTYTGEPEYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33803 - protein, 117 aa, Artificial Sequence
  Description of Artificial Sequence: Synthetic polypeptide
  VH of XENP023772
QIQLVQSGSELKKPGASVKVSCKASGYTFTHYGMNWVRQAPGQGLEWMGWINTYTGEPEYADGFTGRFVFSLDTSVSTAYLQISSLKAEDTAVYFCARDYYGSSPYWGQGTLVTVSS

SEQ ID NO: 33804 - protein, 114 aa, Artificial Sequence; identical to SEQ ID NO: 33651
  Description of Artificial Sequence: Synthetic polypeptide
  VL of XENP023772

SEQ ID NO: 33805 - protein, 5 aa, Artificial Sequence
  Description of Artificial Sequence: Synthetic peptide
  XENP023772 vhCDR1
HYGMN

SEQ ID NO: 33806 - protein, 17 aa, Artificial Sequence
  Description of Artificial Sequence: Synthetic peptide
  XENP023772 vhCDR2
WINTYTGEPEYADGFTG

SEQ ID NO: 33807 - protein, 8 aa, Artificial Sequence
  Description of Artificial Sequence: Synthetic peptide
  XENP023772 vhCDR3
DYYGSSPY

SEQ ID NO: 33808 - protein, 16 aa, Artificial Sequence
  Description of Artificial Sequence: Synthetic peptide
  XENP023772 vlCDR1
KSSQSIVHSNGNTYLE

SEQ ID NO: 33809 - protein, 7 aa, Artificial Sequence
  Description of Artificial Sequence: Synthetic peptide
  XENP023772 vlCDR2
KVSNRFS

SEQ ID NO: 33810 - protein, 9 aa, Artificial Sequence
  Description of Artificial Sequence: Synthetic peptide
  XENP023772 vlCDR3
FQGSHVPNT

SEQ ID NO: 33811 - protein, 251 aa, Artificial Sequence
  Description of Artificial Sequence: Synthetic polypeptide
  XENP023773 1C11_H3.32_L3_scFv
QIQLVQSGSELKKPGASVKVSCKASGYTFTHYGMNWVRQAPGQGLEWMGWINTYTGEPTYNDGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33812 - protein, 117 aa, Artificial Sequence
  Description of Artificial Sequence: Synthetic polypeptide
  VH of XENP023773
QIQLVQSGSELKKPGASVKVSCKASGYTFTHYGMNWVRQAPGQGLEWMGWINTYTGEPTYNDGFTGRFVFSLDTSVSTAYLQISSLKAEDTAVYFCARDYYGSSPYWGQGTLVTVSS

SEQ ID NO: 33813 - protein, 114 aa, Artificial Sequence; identical to SEQ ID NO: 33651
  Description of Artificial Sequence: Synthetic polypeptide
  VL of XENP023773

SEQ ID NO: 33814 - protein, 5 aa, Artificial Sequence
  Description of Artificial Sequence: Synthetic peptide
  XENP023773 vhCDR1
HYGMN

SEQ ID NO: 33815 - protein, 17 aa, Artificial Sequence
  Description of Artificial Sequence: Synthetic peptide
  XENP023773 vhCDR2
WINTYTGEPTYNDGFTG

SEQ ID NO: 33816 - protein, 8 aa, Artificial Sequence
  Description of Artificial Sequence: Synthetic peptide
  XENP023773 vhCDR3
DYYGSSPY

SEQ ID NO: 33817 - protein, 16 aa, Artificial Sequence
  Description of Artificial Sequence: Synthetic peptide
  XENP023773 vlCDR1
KSSQSIVHSNGNTYLE

SEQ ID NO: 33818 - protein, 7 aa, Artificial Sequence
  Description of Artificial Sequence: Synthetic peptide
  XENP023773 vlCDR2
KVSNRFS

SEQ ID NO: 33819 - protein, 9 aa, Artificial Sequence
  Description of Artificial Sequence: Synthetic peptide
  XENP023773 vlCDR3
FQGSHVPNT

SEQ ID NO: 33820 - protein, 251 aa, Artificial Sequence
  Description of Artificial Sequence: Synthetic polypeptide
  XENP023774 1C11_H3.33_L3_scFv
QIQLVQSGSELKKPGASVKVSCKASGYTFTHYGMNWVRQAPGQGLEWMGWINTYTGEPTYAQGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33821 - protein, 117 aa, Artificial Sequence
  Description of Artificial Sequence: Synthetic polypeptide
  VH of XENP023774
QIQLVQSGSELKKPGASVKVSCKASGYTFTHYGMNWVRQAPGQGLEWMGWINTYTGEPTYAQGFTGRFVFSLDTSVSTAYLQISSLKAEDTAVYFCARDYYGSSPYWGQGTLVTVSS

SEQ ID NO: 33822 - protein, 114 aa, Artificial Sequence; identical to SEQ ID NO: 33651
  Description of Artificial Sequence: Synthetic polypeptide
  VL of XENP023774

SEQ ID NO: 33823 - protein, 5 aa, Artificial Sequence
  Description of Artificial Sequence: Synthetic peptide
  XENP023774 vhCDR1
HYGMN

SEQ ID NO: 33824 - protein, 17 aa, Artificial Sequence
  Description of Artificial Sequence: Synthetic peptide
  XENP023774 vhCDR2
WINTYTGEPTYAQGFTG

SEQ ID NO: 33825 - protein, 8 aa, Artificial Sequence
  Description of Artificial Sequence: Synthetic peptide
  XENP023774 vhCDR3
DYYGSSPY

SEQ ID NO: 33826 - protein, 16 aa, Artificial Sequence
  Description of Artificial Sequence: Synthetic peptide
  XENP023774 vlCDR1
KSSQSIVHSNGNTYLE

SEQ ID NO: 33827 - protein, 7 aa, Artificial Sequence
  Description of Artificial Sequence: Synthetic peptide
  XENP023774 vlCDR2
KVSNRFS

SEQ ID NO: 33828 - protein, 9 aa, Artificial Sequence
  Description of Artificial Sequence: Synthetic peptide
  XENP023774 vlCDR3
FQGSHVPNT

SEQ ID NO: 33829 - protein, 251 aa, Artificial Sequence
  Description of Artificial Sequence: Synthetic polypeptide
  XENP023775 1C11_H3.34_L3_scFv
QIQLVQSGSELKKPGASVKVSCKASGYTFTHYGMNWVRQAPGQGLEWMGWINTYTGEPTYAEGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33830 - protein, 117 aa, Artificial Sequence
  Description of Artificial Sequence: Synthetic polypeptide
  VH of XENP023775
QIQLVQSGSELKKPGASVKVSCKASGYTFTHYGMNWVRQAPGQGLEWMGWINTYTGEPTYAEGFTGRFVFSLDTSVSTAYLQISSLKAEDTAVYFCARDYYGSSPYWGQGTLVTVSS

SEQ ID NO: 33831 - protein, 114 aa, Artificial Sequence; identical to SEQ ID NO: 33651
  Description of Artificial Sequence: Synthetic polypeptide
  VL of XENP023775

SEQ ID NO: 33832 - protein, 5 aa, Artificial Sequence
  Description of Artificial Sequence: Synthetic peptide
  XENP023775 vhCDR1
HYGMN

SEQ ID NO: 33833 - protein, 17 aa, Artificial Sequence
  Description of Artificial Sequence: Synthetic peptide
  XENP023775 vhCDR2
WINTYTGEPTYAEGFTG

SEQ ID NO: 33834 - protein, 8 aa, Artificial Sequence
  Description of Artificial Sequence: Synthetic peptide
  XENP023775 vhCDR3
DYYGSSPY

SEQ ID NO: 33835 - protein, 16 aa, Artificial Sequence
  Description of Artificial Sequence: Synthetic peptide
  XENP023775 vlCDR1
KSSQSIVHSNGNTYLE

SEQ ID NO: 33836 - protein, 7 aa, Artificial Sequence
  Description of Artificial Sequence: Synthetic peptide
  XENP023775 vlCDR2
KVSNRFS

SEQ ID NO: 33837 - protein, 9 aa, Artificial Sequence
  Description of Artificial Sequence: Synthetic peptide
  XENP023775 vlCDR3
FQGSHVPNT

SEQ ID NO: 33838 - protein, 251 aa, Artificial Sequence
  Description of Artificial Sequence: Synthetic polypeptide
  XENP023776 1C11_H3.35_L3_scFv
QIQLVQSGSELKKPGASVKVSCKASGYTFTHYGMNWVRQAPGQGLEWMGWINTYTGEPTYADKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33839 - protein, 117 aa, Artificial Sequence
  Description of Artificial Sequence: Synthetic polypeptide
  VH of XENP023776
QIQLVQSGSELKKPGASVKVSCKASGYTFTHYGMNWVRQAPGQGLEWMGWINTYTGEPTYADKFTGRFVFSLDTSVSTAYLQISSLKAEDTAVYFCARDYYGSSPYWGQGTLVTVSS

SEQ ID NO: 33840 - protein, 114 aa, Artificial Sequence; identical to SEQ ID NO: 33651
  Description of Artificial Sequence: Synthetic polypeptide
  VL of XENP023776

SEQ ID NO: 33841 - protein, 5 aa, Artificial Sequence
  Description of Artificial Sequence: Synthetic peptide
  XENP023776 vhCDR1
HYGMN

SEQ ID NO: 33842 - protein, 17 aa, Artificial Sequence
  Description of Artificial Sequence: Synthetic peptide
  XENP023776 vhCDR2
WINTYTGEPTYADKFTG

SEQ ID NO: 33843 - protein, 8 aa, Artificial Sequence
  Description of Artificial Sequence: Synthetic peptide
  XENP023776 vhCDR3
DYYGSSPY

SEQ ID NO: 33844 - protein, 16 aa, Artificial Sequence
  Description of Artificial Sequence: Synthetic peptide
  XENP023776 vlCDR1
KSSQSIVHSNGNTYLE

SEQ ID NO: 33845 - protein, 7 aa, Artificial Sequence
  Description of Artificial Sequence: Synthetic peptide
  XENP023776 vlCDR2
KVSNRFS

SEQ ID NO: 33846 - protein, 9 aa, Artificial Sequence
  Description of Artificial Sequence: Synthetic peptide
  XENP023776 vlCDR3
FQGSHVPNT

SEQ ID NO: 33847 - protein, 251 aa, Artificial Sequence
  Description of Artificial Sequence: Synthetic polypeptide
  XENP023777 1C11_H3.38_L3_scFv
QIQLVQSGSELKKPGASVKVSCKASGYTFTHYGMNWVRQAPGQGLEWMGWINTYTGEPTYADGITGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33848 - protein, 117 aa, Artificial Sequence
  Description of Artificial Sequence: Synthetic polypeptide
  VH of XENP023777
QIQLVQSGSELKKPGASVKVSCKASGYTFTHYGMNWVRQAPGQGLEWMGWINTYTGEPTYADGITGRFVFSLDTSVSTAYLQISSLKAEDTAVYFCARDYYGSSPYWGQGTLVTVSS

SEQ ID NO: 33849 - protein, 114 aa, Artificial Sequence; identical to SEQ ID NO: 33651
  Description of Artificial Sequence: Synthetic polypeptide
  VL of XENP023777

SEQ ID NO: 33850 - protein, 5 aa, Artificial Sequence
  Description of Artificial Sequence: Synthetic peptide
  XENP023777 vhCDR1
HYGMN

SEQ ID NO: 33851 - protein, 17 aa, Artificial Sequence
  Description of Artificial Sequence: Synthetic peptide
  XENP023777 vhCDR2
WINTYTGEPTYADGITG

SEQ ID NO: 33852 - protein, 8 aa, Artificial Sequence
  Description of Artificial Sequence: Synthetic peptide
  XENP023777 vhCDR3
DYYGSSPY

SEQ ID NO: 33853 - protein, 16 aa, Artificial Sequence
  Description of Artificial Sequence: Synthetic peptide
  XENP023777 vlCDR1
KSSQSIVHSNGNTYLE

SEQ ID NO: 33854 - protein, 7 aa, Artificial Sequence
  Description of Artificial Sequence: Synthetic peptide
  XENP023777 vlCDR2
KVSNRFS

SEQ ID NO: 33855 - protein, 9 aa, Artificial Sequence
  Description of Artificial Sequence: Synthetic peptide
  XENP023777 vlCDR3
FQGSHVPNT

SEQ ID NO: 33856 - protein, 251 aa, Artificial Sequence
  Description of Artificial Sequence: Synthetic polypeptide
  XENP023778 1C11_H3.39_L3_scFv
QIQLVQSGSELKKPGASVKVSCKASGYTFTHYGMNWVRQAPGQGLEWMGWINTYTGEPTYADGLTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33857 - protein, 117 aa, Artificial Sequence
  Description of Artificial Sequence: Synthetic polypeptide
  VH of XENP023778
QIQLVQSGSELKKPGASVKVSCKASGYTFTHYGMNWVRQAPGQGLEWMGWINTYTGEPTYADGLTGRFVFSLDTSVSTAYLQISSLKAEDTAVYFCARDYYGSSPYWGQGTLVTVSS

SEQ ID NO: 33858 - protein, 114 aa, Artificial Sequence; identical to SEQ ID NO: 33651
  Description of Artificial Sequence: Synthetic polypeptide
  VL of XENP023778

SEQ ID NO: 33859 - protein, 5 aa, Artificial Sequence
  Description of Artificial Sequence: Synthetic peptide
  XENP023778 vhCDR1
HYGMN

SEQ ID NO: 33860 - protein, 17 aa, Artificial Sequence
  Description of Artificial Sequence: Synthetic peptide
  XENP023778 vhCDR2
WINTYTGEPTYADGLTG

SEQ ID NO: 33861 - protein, 8 aa, Artificial Sequence
  Description of Artificial Sequence: Synthetic peptide
  XENP023778 vhCDR3
DYYGSSPY

SEQ ID NO: 33862 - protein, 16 aa, Artificial Sequence
  Description of Artificial Sequence: Synthetic peptide
  XENP023778 vlCDR1
KSSQSIVHSNGNTYLE

SEQ ID NO: 33863 - protein, 7 aa, Artificial Sequence
  Description of Artificial Sequence: Synthetic peptide
  XENP023778 vlCDR2
KVSNRFS

SEQ ID NO: 33864 - protein, 9 aa, Artificial Sequence
  Description of Artificial Sequence: Synthetic peptide
  XENP023778 vlCDR3
FQGSHVPNT

SEQ ID NO: 33865 - protein, 251 aa, Artificial Sequence
  Description of Artificial Sequence: Synthetic polypeptide
  XENP023779 1C11_H3.41_L3_scFv
QIQLVQSGSELKKPGASVKVSCKASGYTFTHYGMNWVRQAPGQGLEWMGWINTYTGEPTYADGFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33866 - protein, 117 aa, Artificial Sequence
  Description of Artificial Sequence: Synthetic polypeptide
  VH of XENP023779
QIQLVQSGSELKKPGASVKVSCKASGYTFTHYGMNWVRQAPGQGLEWMGWINTYTGEPTYADGFKGRFVFSLDTSVSTAYLQISSLKAEDTAVYFCARDYYGSSPYWGQGTLVTVSS

SEQ ID NO: 33867 - protein, 114 aa, Artificial Sequence; identical to SEQ ID NO: 33651
  Description of Artificial Sequence: Synthetic polypeptide
  VL of XENP023779

SEQ ID NO: 33868 - protein, 5 aa, Artificial Sequence
  Description of Artificial Sequence: Synthetic peptide
  XENP023779 vhCDR1
HYGMN

SEQ ID NO: 33869 - protein, 17 aa, Artificial Sequence
  Description of Artificial Sequence: Synthetic peptide
  XENP023779 vhCDR2
WINTYTGEPTYADGFKG

SEQ ID NO: 33870 - protein, 8 aa, Artificial Sequence
  Description of Artificial Sequence: Synthetic peptide
  XENP023779 vhCDR3
DYYGSSPY

SEQ ID NO: 33871 - protein, 16 aa, Artificial Sequence
  Description of Artificial Sequence: Synthetic peptide
  XENP023779 vlCDR1
KSSQSIVHSNGNTYLE

SEQ ID NO: 33872 - protein, 7 aa, Artificial Sequence
  Description of Artificial Sequence: Synthetic peptide
  XENP023779 vlCDR2
KVSNRFS

SEQ ID NO: 33873 - protein, 9 aa, Artificial Sequence
  Description of Artificial Sequence: Synthetic peptide
  XENP023779 vlCDR3
FQGSHVPNT

SEQ ID NO: 33874 - protein, 251 aa, Artificial Sequence
  Description of Artificial Sequence: Synthetic polypeptide
  XENP023780 1C11_H3.42_L3_scFv
QIQLVQSGSELKKPGASVKVSCKASGYTFTHYGMNWVRQAPGQGLEWMGWINTYTGEPTYADGFQGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33875 - protein, 117 aa, Artificial Sequence
  Description of Artificial Sequence: Synthetic polypeptide
  VH of XENP023780
QIQLVQSGSELKKPGASVKVSCKASGYTFTHYGMNWVRQAPGQGLEWMGWINTYTGEPTYADGFQGRFVFSLDTSVSTAYLQISSLKAEDTAVYFCARDYYGSSPYWGQGTLVTVSS

SEQ ID NO: 33876 - protein, 114 aa, Artificial Sequence; identical to SEQ ID NO: 33651
  Description of Artificial Sequence: Synthetic polypeptide
  VL of XENP023780

SEQ ID NO: 33877 - protein, 5 aa, Artificial Sequence
  Description of Artificial Sequence: Synthetic peptide
  XENP023780 vhCDR1
HYGMN

SEQ ID NO: 33878 - protein, 17 aa, Artificial Sequence
  Description of Artificial Sequence: Synthetic peptide
  XENP023780 vhCDR2
WINTYTGEPTYADGFQG

SEQ ID NO: 33879 - protein, 8 aa, Artificial Sequence
  Description of Artificial Sequence: Synthetic peptide
  XENP023780 vhCDR3
DYYGSSPY

SEQ ID NO: 33880 - protein, 16 aa, Artificial Sequence
  Description of Artificial Sequence: Synthetic peptide
  XENP023780 vlCDR1
KSSQSIVHSNGNTYLE

SEQ ID NO: 33881 - protein, 7 aa, Artificial Sequence
  Description of Artificial Sequence: Synthetic peptide
  XENP023780 vlCDR2
KVSNRFS

SEQ ID NO: 33882 - protein, 9 aa, Artificial Sequence
  Description of Artificial Sequence: Synthetic peptide
  XENP023780 vlCDR3
FQGSHVPNT

SEQ ID NO: 33883 - protein, 251 aa, Artificial Sequence
  Description of Artificial Sequence: Synthetic polypeptide
  XENP023781 1C11_H3.43_L3_scFv
QIQLVQSGSELKKPGASVKVSCKASGYTFTHYGMNWVRQAPGQGLEWMGWINTYTGEPTYADGFTGRVVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33884 - protein, 117 aa, Artificial Sequence
  Description of Artificial Sequence: Synthetic polypeptide
  VH of XENP023781
QIQLVQSGSELKKPGASVKVSCKASGYTFTHYGMNWVRQAPGQGLEWMGWINTYTGEPTYADGFTGRVVFSLDTSVSTAYLQISSLKAEDTAVYFCARDYYGSSPYWGQGTLVTVSS

SEQ ID NO: 33885 - protein, 114 aa, Artificial Sequence; identical to SEQ ID NO: 33651
  Description of Artificial Sequence: Synthetic polypeptide
  VL of XENP023781

SEQ ID NO: 33886 - protein, 5 aa, Artificial Sequence
  Description of Artificial Sequence: Synthetic peptide
  XENP023781 vhCDR1
HYGMN

SEQ ID NO: 33887 - protein, 17 aa, Artificial Sequence
  Description of Artificial Sequence: Synthetic peptide
  XENP023781 vhCDR2
WINTYTGEPTYADGFTG

SEQ ID NO: 33888 - protein, 8 aa, Artificial Sequence
  Description of Artificial Sequence: Synthetic peptide
  XENP023781 vhCDR3
DYYGSSPY

SEQ ID NO: 33889 - protein, 16 aa, Artificial Sequence
  Description of Artificial Sequence: Synthetic peptide
  XENP023781 vlCDR1
KSSQSIVHSNGNTYLE

SEQ ID NO: 33890 - protein, 7 aa, Artificial Sequence
  Description of Artificial Sequence: Synthetic peptide
  XENP023781 vlCDR2
KVSNRFS

SEQ ID NO: 33891 - protein, 9 aa, Artificial Sequence
  Description of Artificial Sequence: Synthetic peptide
  XENP023781 vlCDR3
FQGSHVPNT

SEQ ID NO: 33892 - protein, 251 aa, Artificial Sequence
  Description of Artificial Sequence: Synthetic polypeptide
  XENP023782 1C11_H3.44_L3_scFv
QIQLVQSGSELKKPGASVKVSCKASGYTFTHYGMNWVRQAPGQGLEWMGWINTYTGEPTYADGFTGRFIFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33893 - protein, 117 aa, Artificial Sequence
  Description of Artificial Sequence: Synthetic polypeptide
  VH of XENP023782
QIQLVQSGSELKKPGASVKVSCKASGYTFTHYGMNWVRQAPGQGLEWMGWINTYTGEPTYADGFTGRFIFSLDTSVSTAYLQISSLKAEDTAVYFCARDYYGSSPYWGQGTLVTVSS

SEQ ID NO: 33894 - protein, 114 aa, Artificial Sequence; identical to SEQ ID NO: 33651
  Description of Artificial Sequence: Synthetic polypeptide
  VL of XENP023782

SEQ ID NO: 33895 - protein, 5 aa, Artificial Sequence
  Description of Artificial Sequence: Synthetic peptide
  XENP023782 vhCDR1
HYGMN

SEQ ID NO: 33896 - protein, 17 aa, Artificial Sequence
  Description of Artificial Sequence: Synthetic peptide
  XENP023782 vhCDR2
WINTYTGEPTYADGFTG

SEQ ID NO: 33897 - protein, 8 aa, Artificial Sequence
  Description of Artificial Sequence: Synthetic peptide
  XENP023782 vhCDR3
DYYGSSPY

SEQ ID NO: 33898 - protein, 16 aa, Artificial Sequence
  Description of Artificial Sequence: Synthetic peptide
  XENP023782 vlCDR1
KSSQSIVHSNGNTYLE

SEQ ID NO: 33899 - protein, 7 aa, Artificial Sequence
  Description of Artificial Sequence: Synthetic peptide
  XENP023782 vlCDR2
KVSNRFS

SEQ ID NO: 33900 - protein, 9 aa, Artificial Sequence
  Description of Artificial Sequence: Synthetic peptide
  XENP023782 vlCDR3
FQGSHVPNT

SEQ ID NO: 33901 - protein, 251 aa, Artificial Sequence
  Description of Artificial Sequence: Synthetic polypeptide
  XENP023783 1C11_H3.45_L3_scFv
QIQLVQSGSELKKPGASVKVSCKASGYTFTHYGMNWVRQAPGQGLEWMGWINTYTGEPTYADGFTGRFSFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33902 - protein, 117 aa, Artificial Sequence
  Description of Artificial Sequence: Synthetic polypeptide
  VH of XENP023783
QIQLVQSGSELKKPGASVKVSCKASGYTFTHYGMNWVRQAPGQGLEWMGWINTYTGEPTYADGFTGRFSFSLDTSVSTAYLQISSLKAEDTAVYFCARDYYGSSPYWGQGTLVTVSS

SEQ ID NO: 33903 - protein, 114 aa, Artificial Sequence; identical to SEQ ID NO: 33651
  Description of Artificial Sequence: Synthetic polypeptide
  VL of XENP023783

SEQ ID NO: 33904 - protein, 5 aa, Artificial Sequence
  Description of Artificial Sequence: Synthetic peptide
  XENP023783 vhCDR1
HYGMN

SEQ ID NO: 33905 - protein, 17 aa, Artificial Sequence
  Description of Artificial Sequence: Synthetic peptide
  XENP023783 vhCDR2
WINTYTGEPTYADGFTG

SEQ ID NO: 33906 - protein, 8 aa, Artificial Sequence
  Description of Artificial Sequence: Synthetic peptide
  XENP023783 vhCDR3
DYYGSSPY

SEQ ID NO: 33907 - protein, 16 aa, Artificial Sequence
  Description of Artificial Sequence: Synthetic peptide
  XENP023783 vlCDR1
KSSQSIVHSNGNTYLE

SEQ ID NO: 33908 - protein, 7 aa, Artificial Sequence
  Description of Artificial Sequence: Synthetic peptide
  XENP023783 vlCDR2
KVSNRFS

SEQ ID NO: 33909 - protein, 9 aa, Artificial Sequence
  Description of Artificial Sequence: Synthetic peptide
  XENP023783 vlCDR3
FQGSHVPNT

SEQ ID NO: 33910 - protein, 251 aa, Artificial Sequence
  Description of Artificial Sequence: Synthetic polypeptide
  XENP023784 1C11_H3.46_L3_scFv
QIQLVQSGSELKKPGASVKVSCKASGYTFTHYGMNWVRQAPGQGLEWMGWINTYTGEPTYADGFTGRFTFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33911 - protein, 117 aa, Artificial Sequence
  Description of Artificial Sequence: Synthetic polypeptide
  VH of XENP023784
QIQLVQSGSELKKPGASVKVSCKASGYTFTHYGMNWVRQAPGQGLEWMGWINTYTGEPTYADGFTGRFTFSLDTSVSTAYLQISSLKAEDTAVYFCARDYYGSSPYWGQGTLVTVSS

SEQ ID NO: 33912 - protein, 114 aa, Artificial Sequence; identical to SEQ ID NO: 33651
  Description of Artificial Sequence: Synthetic polypeptide
  VL of XENP023784

SEQ ID NO: 33913 - protein, 5 aa, Artificial Sequence
  Description of Artificial Sequence: Synthetic peptide
  XENP023784 vhCDR1
HYGMN

SEQ ID NO: 33914 - protein, 17 aa, Artificial Sequence
  Description of Artificial Sequence: Synthetic peptide
  XENP023784 vhCDR2
WINTYTGEPTYADGFTG

SEQ ID NO: 33915 - protein, 8 aa, Artificial Sequence
  Description of Artificial Sequence: Synthetic peptide
  XENP023784 vhCDR3
DYYGSSPY

SEQ ID NO: 33916 - protein, 16 aa, Artificial Sequence
  Description of Artificial Sequence: Synthetic peptide
  XENP023784 vlCDR1
KSSQSIVHSNGNTYLE

SEQ ID NO: 33917 - protein, 7 aa, Artificial Sequence
  Description of Artificial Sequence: Synthetic peptide
  XENP023784 vlCDR2
KVSNRFS

SEQ ID NO: 33918 - protein, 9 aa, Artificial Sequence
  Description of Artificial Sequence: Synthetic peptide
  XENP023784 vlCDR3
FQGSHVPNT

SEQ ID NO: 33919 - protein, 251 aa, Artificial Sequence
  Description of Artificial Sequence: Synthetic polypeptide
  XENP023785 1C11_H3.49_L3_scFv
QIQLVQSGSELKKPGASVKVSCKASGYTFTHYGMNWVRQAPGQGLEWMGWINTYTGEPTYADGFTGRFVMSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33920 - protein, 117 aa, Artificial Sequence
  Description of Artificial Sequence: Synthetic polypeptide
  VH of XENP023785
QIQLVQSGSELKKPGASVKVSCKASGYTFTHYGMNWVRQAPGQGLEWMGWINTYTGEPTYADGFTGRFVMSLDTSVSTAYLQISSLKAEDTAVYFCARDYYGSSPYWGQGTLVTVSS

SEQ ID NO: 33921 - protein, 114 aa, Artificial Sequence; identical to SEQ ID NO: 33651
  Description of Artificial Sequence: Synthetic polypeptide
  VL of XENP023785

SEQ ID NO: 33922 - protein, 5 aa, Artificial Sequence
  Description of Artificial Sequence: Synthetic peptide
  XENP023785 vhCDR1
HYGMN

SEQ ID NO: 33923 - protein, 17 aa, Artificial Sequence
  Description of Artificial Sequence: Synthetic peptide
  XENP023785 vhCDR2
WINTYTGEPTYADGFTG

SEQ ID NO: 33924 - protein, 8 aa, Artificial Sequence
  Description of Artificial Sequence: Synthetic peptide
  XENP023785 vhCDR3
DYYGSSPY

SEQ ID NO: 33925 - protein, 16 aa, Artificial Sequence
  Description of Artificial Sequence: Synthetic peptide
  XENP023785 vlCDR1
KSSQSIVHSNGNTYLE

SEQ ID NO: 33926 - protein, 7 aa, Artificial Sequence
  Description of Artificial Sequence: Synthetic peptide
  XENP023785 vlCDR2
KVSNRFS

SEQ ID NO: 33927 - protein, 9 aa, Artificial Sequence
  Description of Artificial Sequence: Synthetic peptide
  XENP023785 vlCDR3
FQGSHVPNT

SEQ ID NO: 33928 - protein, 251 aa, Artificial Sequence
  Description of Artificial Sequence: Synthetic polypeptide
  XENP023786 1C11_H3.50_L3_scFv
QIQLVQSGSELKKPGASVKVSCKASGYTFTHYGMNWVRQAPGQGLEWMGWINTYTGEPTYADGFTGRFVFSADTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33929 - protein, 117 aa, Artificial Sequence
  Description of Artificial Sequence: Synthetic polypeptide
  VH of XENP023786
QIQLVQSGSELKKPGASVKVSCKASGYTFTHYGMNWVRQAPGQGLEWMGWINTYTGEPTYADGFTGRFVFSADTSVSTAYLQISSLKAEDTAVYFCARDYYGSSPYWGQGTLVTVSS

SEQ ID NO: 33930 - protein, 114 aa, Artificial Sequence; identical to SEQ ID NO: 33651
  Description of Artificial Sequence: Synthetic polypeptide
  VL of XENP023786

SEQ ID NO: 33931 - protein, 5 aa, Artificial Sequence
  Description of Artificial Sequence: Synthetic peptide
  XENP023786 vhCDR1
HYGMN

SEQ ID NO: 33932 - protein, 17 aa, Artificial Sequence
  Description of Artificial Sequence: Synthetic peptide
  XENP023786 vhCDR2
WINTYTGEPTYADGFTG

SEQ ID NO: 33933 - protein, 8 aa, Artificial Sequence
  Description of Artificial Sequence: Synthetic peptide
  XENP023786 vhCDR3
DYYGSSPY

SEQ ID NO: 33934 - protein, 16 aa, Artificial Sequence
  Description of Artificial Sequence: Synthetic peptide
  XENP023786 vlCDR1
KSSQSIVHSNGNTYLE

SEQ ID NO: 33935 - protein, 7 aa, Artificial Sequence
  Description of Artificial Sequence: Synthetic peptide
  XENP023786 vlCDR2
KVSNRFS

SEQ ID NO: 33936 - protein, 9 aa, Artificial Sequence
  Description of Artificial Sequence: Synthetic peptide
  XENP023786 vlCDR3
FQGSHVPNT

SEQ ID NO: 33937 - protein, 251 aa, Artificial Sequence
  Description of Artificial Sequence: Synthetic polypeptide
  XENP023787 1C11_H3.51_L3_scFv
QIQLVQSGSELKKPGASVKVSCKASGYTFTHYGMNWVRQAPGQGLEWMGWINTYTGEPTYADGFTGRFVFSVDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33938 - protein, 117 aa, Artificial Sequence
  Description of Artificial Sequence: Synthetic polypeptide
  VH of XENP023787
QIQLVQSGSELKKPGASVKVSCKASGYTFTHYGMNWVRQAPGQGLEWMGWINTYTGEPTYADGFTGRFVFSVDTSVSTAYLQISSLKAEDTAVYFCARDYYGSSPYWGQGTLVTVSS

SEQ ID NO: 33939 - protein, 114 aa, Artificial Sequence; identical to SEQ ID NO: 33651
  Description of Artificial Sequence: Synthetic polypeptide
  VL of XENP023787

SEQ ID NO: 33940 - protein, 5 aa, Artificial Sequence
  Description of Artificial Sequence: Synthetic peptide
  XENP023787 vhCDR1
HYGMN

SEQ ID NO: 33941 - protein, 17 aa, Artificial Sequence
  Description of Artificial Sequence: Synthetic peptide
  XENP023787 vhCDR2
WINTYTGEPTYADGFTG

SEQ ID NO: 33942 - protein, 8 aa, Artificial Sequence
  Description of Artificial Sequence: Synthetic peptide
  XENP023787 vhCDR3
DYYGSSPY

SEQ ID NO: 33943 - protein, 16 aa, Artificial Sequence
  Description of Artificial Sequence: Synthetic peptide
  XENP023787 vlCDR1
KSSQSIVHSNGNTYLE

SEQ ID NO: 33944 - protein, 7 aa, Artificial Sequence
  Description of Artificial Sequence: Synthetic peptide
  XENP023787 vlCDR2
KVSNRFS

SEQ ID NO: 33945 - protein, 9 aa, Artificial Sequence
  Description of Artificial Sequence: Synthetic peptide
  XENP023787 vlCDR3
FQGSHVPNT

SEQ ID NO: 33946 - protein, 251 aa, Artificial Sequence
  Description of Artificial Sequence: Synthetic polypeptide
  XENP023788 1C11_H3.54_L3_scFv
QIQLVQSGSELKKPGASVKVSCKASGYTFTHYGMNWVRQAPGQGLEWMGWINTYTGEPTYADGFTGRVTMTADTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33947 - protein, 117 aa, Artificial Sequence
  Description of Artificial Sequence: Synthetic polypeptide
  VH of XENP023788
QIQLVQSGSELKKPGASVKVSCKASGYTFTHYGMNWVRQAPGQGLEWMGWINTYTGEPTYADGFTGRVTMTADTSVSTAYLQISSLKAEDTAVYFCARDYYGSSPYWGQGTLVTVSS

SEQ ID NO: 33948 - protein, 114 aa, Artificial Sequence; identical to SEQ ID NO: 33651
  Description of Artificial Sequence: Synthetic polypeptide
  VL of XENP023788

SEQ ID NO: 33949 - protein, 5 aa, Artificial Sequence
  Description of Artificial Sequence: Synthetic peptide
  XENP023788 vhCDR1
HYGMN

SEQ ID NO: 33950 - protein, 17 aa, Artificial Sequence
  Description of Artificial Sequence: Synthetic peptide
  XENP023788 vhCDR2
WINTYTGEPTYADGFTG

SEQ ID NO: 33951 - protein, 8 aa, Artificial Sequence
  Description of Artificial Sequence: Synthetic peptide
  XENP023788 vhCDR3
DYYGSSPY

SEQ ID NO: 33952 - protein, 16 aa, Artificial Sequence
  Description of Artificial Sequence: Synthetic peptide
  XENP023788 vlCDR1
KSSQSIVHSNGNTYLE

SEQ ID NO: 33953 - protein, 7 aa, Artificial Sequence
  Description of Artificial Sequence: Synthetic peptide
  XENP023788 vlCDR2
KVSNRFS

SEQ ID NO: 33954 - protein, 9 aa, Artificial Sequence
  Description of Artificial Sequence: Synthetic peptide
  XENP023788 vlCDR3
FQGSHVPNT

SEQ ID NO: 33955 - protein, 251 aa, Artificial Sequence
  Description of Artificial Sequence: Synthetic polypeptide
  XENP023789 1C11_H3.55_L3_scFv
QIQLVQSGSELKKPGASVKVSCKASGYTFTHYGMNWVRQAPGQGLEWMGWINTYTGEPTYADGFTGRFVFSLDKSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33956 - protein, 117 aa, Artificial Sequence
  Description of Artificial Sequence: Synthetic polypeptide
  VH of XENP023789
QIQLVQSGSELKKPGASVKVSCKASGYTFTHYGMNWVRQAPGQGLEWMGWINTYTGEPTYADGFTGRFVFSLDKSVSTAYLQISSLKAEDTAVYFCARDYYGSSPYWGQGTLVTVSS

SEQ ID NO: 33957 - protein, 114 aa, Artificial Sequence; identical to SEQ ID NO: 33651
  Description of Artificial Sequence: Synthetic polypeptide
  VL of XENP023789

SEQ ID NO: 33958 - protein, 5 aa, Artificial Sequence
  Description of Artificial Sequence: Synthetic peptide
  XENP023789 vhCDR1
HYGMN

SEQ ID NO: 33959 - protein, 17 aa, Artificial Sequence
  Description of Artificial Sequence: Synthetic peptide
  XENP023789 vhCDR2
WINTYTGEPTYADGFTG

SEQ ID NO: 33960 - protein, 8 aa, Artificial Sequence
  Description of Artificial Sequence: Synthetic peptide
  XENP023789 vhCDR3
DYYGSSPY

SEQ ID NO: 33961 - protein, 16 aa, Artificial Sequence
  Description of Artificial Sequence: Synthetic peptide
  XENP023789 vlCDR1
KSSQSIVHSNGNTYLE

SEQ ID NO: 33962 - protein, 7 aa, Artificial Sequence
  Description of Artificial Sequence: Synthetic peptide
  XENP023789 vlCDR2
KVSNRFS

SEQ ID NO: 33963 - protein, 9 aa, Artificial Sequence
  Description of Artificial Sequence: Synthetic peptide
  XENP023789 vlCDR3
FQGSHVPNT

SEQ ID NO: 33964 - protein, 251 aa, Artificial Sequence
  Description of Artificial Sequence: Synthetic polypeptide
  XENP023790 1C11_H3.56_L3_scFv
QIQLVQSGSELKKPGASVKVSCKASGYTFTHYGMNWVRQAPGQGLEWMGWINTYTGEPTYADGFTGRFVFSLDTSASTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33965 - protein, 117 aa, Artificial Sequence
  Description of Artificial Sequence: Synthetic polypeptide
  VH of XENP023790
QIQLVQSGSELKKPGASVKVSCKASGYTFTHYGMNWVRQAPGQGLEWMGWINTYTGEPTYADGFTGRFVFSLDTSASTAYLQISSLKAEDTAVYFCARDYYGSSPYWGQGTLVTVSS

SEQ ID NO: 33966 - protein, 114 aa, Artificial Sequence; identical to SEQ ID NO: 33651
  Description of Artificial Sequence: Synthetic polypeptide
  VL of XENP023790

SEQ ID NO: 33967 - protein, 5 aa, Artificial Sequence
  Description of Artificial Sequence: Synthetic peptide
  XENP023790 vhCDR1
HYGMN

SEQ ID NO: 33968 - protein, 17 aa, Artificial Sequence
  Description of Artificial Sequence: Synthetic peptide
  XENP023790 vhCDR2
WINTYTGEPTYADGFTG

SEQ ID NO: 33969 - protein, 8 aa, Artificial Sequence
  Description of Artificial Sequence: Synthetic peptide
  XENP023790 vhCDR3
DYYGSSPY

SEQ ID NO: 33970 - protein, 16 aa, Artificial Sequence
  Description of Artificial Sequence: Synthetic peptide
  XENP023790 vlCDR1
KSSQSIVHSNGNTYLE

SEQ ID NO: 33971 - protein, 7 aa, Artificial Sequence
  Description of Artificial Sequence: Synthetic peptide
  XENP023790 vlCDR2
KVSNRFS

SEQ ID NO: 33972 - protein, 9 aa, Artificial Sequence
  Description of Artificial Sequence: Synthetic peptide
  XENP023790 vlCDR3
FQGSHVPNT

SEQ ID NO: 33973 - protein, 251 aa, Artificial Sequence
  Description of Artificial Sequence: Synthetic polypeptide
  XENP023791 1C11_H3.57_L3_scFv
QIQLVQSGSELKKPGASVKVSCKASGYTFTHYGMNWVRQAPGQGLEWMGWINTYTGEPTYADGFTGRFVFSLDTSISTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33974 - protein, 117 aa, Artificial Sequence
  Description of Artificial Sequence: Synthetic polypeptide
  VH of XENP023791
QIQLVQSGSELKKPGASVKVSCKASGYTFTHYGMNWVRQAPGQGLEWMGWINTYTGEPTYADGFTGRFVFSLDTSISTAYLQISSLKAEDTAVYFCARDYYGSSPYWGQGTLVTVSS

SEQ ID NO: 33975 - protein, 114 aa, Artificial Sequence; identical to SEQ ID NO: 33651
  Description of Artificial Sequence: Synthetic polypeptide
  VL of XENP023791

SEQ ID NO: 33976 - protein, 5 aa, Artificial Sequence
  Description of Artificial Sequence: Synthetic peptide
  XENP023791 vhCDR1
HYGMN

SEQ ID NO: 33977 - protein, 17 aa, Artificial Sequence
  Description of Artificial Sequence: Synthetic peptide
  XENP023791 vhCDR2
WINTYTGEPTYADGFTG

SEQ ID NO: 33978 - protein, 8 aa, Artificial Sequence
  Description of Artificial Sequence: Synthetic peptide
  XENP023791 vhCDR3
DYYGSSPY

SEQ ID NO: 33979 - protein, 16 aa, Artificial Sequence
  Description of Artificial Sequence: Synthetic peptide
  XENP023791 vlCDR1
KSSQSIVHSNGNTYLE

SEQ ID NO: 33980 - protein, 7 aa, Artificial Sequence
  Description of Artificial Sequence: Synthetic peptide
  XENP023791 vlCDR2
KVSNRFS

SEQ ID NO: 33981 - protein, 9 aa, Artificial Sequence
  Description of Artificial Sequence: Synthetic peptide
  XENP023791 vlCDR3
FQGSHVPNT

SEQ ID NO: 33982 - protein, 251 aa, Artificial Sequence
  Description of Artificial Sequence: Synthetic polypeptide
  XENP023792 1C11_H3.58_L3_scFv
QIQLVQSGSELKKPGASVKVSCKASGYTFTHYGMNWVRQAPGQGLEWMGWINTYTGEPTYADGFTGRFVFSLDTSKSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33983 - protein, 117 aa, Artificial Sequence
  Description of Artificial Sequence: Synthetic polypeptide
  VH of XENP023792
QIQLVQSGSELKKPGASVKVSCKASGYTFTHYGMNWVRQAPGQGLEWMGWINTYTGEPTYADGFTGRFVFSLDTSKSTAYLQISSLKAEDTAVYFCARDYYGSSPYWGQGTLVTVSS

SEQ ID NO: 33984 - protein, 114 aa, Artificial Sequence; identical to SEQ ID NO: 33651
  Description of Artificial Sequence: Synthetic polypeptide
  VL of XENP023792

SEQ ID NO: 33985 - protein, 5 aa, Artificial Sequence
  Description of Artificial Sequence: Synthetic peptide
  XENP023792 vhCDR1
HYGMN

SEQ ID NO: 33986 - protein, 17 aa, Artificial Sequence
  Description of Artificial Sequence: Synthetic peptide
  XENP023792 vhCDR2
WINTYTGEPTYADGFTG

SEQ ID NO: 33987 - protein, 8 aa, Artificial Sequence
  Description of Artificial Sequence: Synthetic peptide
  XENP023792 vhCDR3
DYYGSSPY

SEQ ID NO: 33988 - protein, 16 aa, Artificial Sequence
  Description of Artificial Sequence: Synthetic peptide
  XENP023792 vlCDR1
KSSQSIVHSNGNTYLE

SEQ ID NO: 33989 - protein, 7 aa, Artificial Sequence
  Description of Artificial Sequence: Synthetic peptide
  XENP023792 vlCDR2
KVSNRFS

SEQ ID NO: 33990 - protein, 9 aa, Artificial Sequence
  Description of Artificial Sequence: Synthetic peptide
  XENP023792 vlCDR3
FQGSHVPNT

SEQ ID NO: 33991 - protein, 251 aa, Artificial Sequence
  Description of Artificial Sequence: Synthetic polypeptide
  XENP023793 1C11_H3.59_L3_scFv
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33992 - protein, 117 aa, Artificial Sequence
  Description of Artificial Sequence: Synthetic polypeptide
  VH of XENP023793
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYYGSSPYWGQGTLVTVSS

SEQ ID NO: 33993 - protein, 114 aa, Artificial Sequence; identical to SEQ ID NO: 33651
  Description of Artificial Sequence: Synthetic polypeptide
  VL of XENP023793

SEQ ID NO: 33994 - protein, 5 aa, Artificial Sequence
  Description of Artificial Sequence: Synthetic peptide
  XENP023793 vhCDR1
HYGMN

SEQ ID NO: 33995 - protein, 17 aa, Artificial Sequence
  Description of Artificial Sequence: Synthetic peptide
  XENP023793 vhCDR2
WINTYTGEPTYADGFTG

SEQ ID NO: 33996 - protein, 8 aa, Artificial Sequence
  Description of Artificial Sequence: Synthetic peptide
  XENP023793 vhCDR3
DYYGSSPY

SEQ ID NO: 33997 - protein, 16 aa, Artificial Sequence
  Description of Artificial Sequence: Synthetic peptide
  XENP023793 vlCDR1
KSSQSIVHSNGNTYLE

SEQ ID NO: 33998 - protein, 7 aa, Artificial Sequence
  Description of Artificial Sequence: Synthetic peptide
  XENP023793 vlCDR2
KVSNRFS

SEQ ID NO: 33999 - protein, 9 aa, Artificial Sequence
  Description of Artificial Sequence: Synthetic peptide
  XENP023793 vlCDR3
FQGSHVPNT

SEQ ID NO: 34000 - protein, 251 aa, Artificial Sequence
  Description of Artificial Sequence: Synthetic polypeptide
  XENP023794 1C11_H3.60_L3_scFv
QIQLVQSGSELKKPGASVKVSCKASGYTFTHYGMNWVRQAPGQGLEWMGWINTYTGEPTYADGFTGRFVFSLDTSTSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34001 - protein, 117 aa, Artificial Sequence
  Description of Artificial Sequence: Synthetic polypeptide
  VH of XENP023794
QIQLVQSGSELKKPGASVKVSCKASGYTFTHYGMNWVRQAPGQGLEWMGWINTYTGEPTYADGFTGRFVFSLDTSTSTAYLQISSLKAEDTAVYFCARDYYGSSPYWGQGTLVTVSS

SEQ ID NO: 34002 - protein, 114 aa, Artificial Sequence; identical to SEQ ID NO: 33651
  Description of Artificial Sequence: Synthetic polypeptide
  VL of XENP023794

SEQ ID NO: 34003 - protein, 5 aa, Artificial Sequence
  Description of Artificial Sequence: Synthetic peptide
  XENP023794 vhCDR1
HYGMN

SEQ ID NO: 34004 - protein, 17 aa, Artificial Sequence
  Description of Artificial Sequence: Synthetic peptide
  XENP023794 vhCDR2
WINTYTGEPTYADGFTG

SEQ ID NO: 34005 - protein, 8 aa, Artificial Sequence
  Description of Artificial Sequence: Synthetic peptide
  XENP023794 vhCDR3
DYYGSSPY

SEQ ID NO: 34006 - protein, 16 aa, Artificial Sequence
  Description of Artificial Sequence: Synthetic peptide
  XENP023794 vlCDR1
KSSQSIVHSNGNTYLE

SEQ ID NO: 34007 - protein, 7 aa, Artificial Sequence
  Description of Artificial Sequence: Synthetic peptide
  XENP023794 vlCDR2
KVSNRFS

SEQ ID NO: 34008 - protein, 9 aa, Artificial Sequence
  Description of Artificial Sequence: Synthetic peptide
  XENP023794 vlCDR3
FQGSHVPNT

SEQ ID NO: 34009 - protein, 251 aa, Artificial Sequence
  Description of Artificial Sequence: Synthetic polypeptide
  XENP023795 1C11_H3.61_L3_scFv
QIQLVQSGSELKKPGASVKVSCKASGYTFTHYGMNWVRQAPGQGLEWMGWINTYTGEPTYADGFTGRFVFSLDTSSSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34010 - protein, 117 aa, Artificial Sequence
  Description of Artificial Sequence: Synthetic polypeptide
  VH of XENP023795
QIQLVQSGSELKKPGASVKVSCKASGYTFTHYGMNWVRQAPGQGLEWMGWINTYTGEPTYADGFTGRFVFSLDTSSSTAYLQISSLKAEDTAVYFCARDYYGSSPYWGQGTLVTVSS

SEQ ID NO: 34011 - protein, 114 aa, Artificial Sequence; identical to SEQ ID NO: 33651
  Description of Artificial Sequence: Synthetic polypeptide
  VL of XENP023795

SEQ ID NO: 34012 - protein, 5 aa, Artificial Sequence
  Description of Artificial Sequence: Synthetic peptide
  XENP023795 vhCDR1
HYGMN

SEQ ID NO: 34013 - protein, 17 aa, Artificial Sequence
  Description of Artificial Sequence: Synthetic peptide
  XENP023795 vhCDR2
WINTYTGEPTYADGFTG

SEQ ID NO: 34014 - protein, 8 aa, Artificial Sequence
  Description of Artificial Sequence: Synthetic peptide
  XENP023795 vhCDR3
DYYGSSPY

SEQ ID NO: 34015 - protein, 16 aa, Artificial Sequence
  Description of Artificial Sequence: Synthetic peptide
  XENP023795 vlCDR1
KSSQSIVHSNGNTYLE

SEQ ID NO: 34016 - protein, 7 aa, Artificial Sequence
  Description of Artificial Sequence: Synthetic peptide
  XENP023795 vlCDR2
KVSNRFS

SEQ ID NO: 34017 - protein, 9 aa, Artificial Sequence
  Description of Artificial Sequence: Synthetic peptide
  XENP023795 vlCDR3
FQGSHVPNT

SEQ ID NO: 34018 - protein, 251 aa, Artificial Sequence
  Description of Artificial Sequence: Synthetic polypeptide
  XENP023796 1C11_H3.62_L3_scFv
QIQLVQSGSELKKPGASVKVSCKASGYTFTHYGMNWVRQAPGQGLEWMGWINTYTGEPTYADGFTGRFVFSLDTSVSTIYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34019 - protein, 117 aa, Artificial Sequence
  Description of Artificial Sequence: Synthetic polypeptide
  VH of XENP023796
QIQLVQSGSELKKPGASVKVSCKASGYTFTHYGMNWVRQAPGQGLEWMGWINTYTGEPTYADGFTGRFVFSLDTSVSTIYLQISSLKAEDTAVYFCARDYYGSSPYWGQGTLVTVSS

SEQ ID NO: 34020 - protein, 114 aa, Artificial Sequence; identical to SEQ ID NO: 33651
  Description of Artificial Sequence: Synthetic polypeptide
  VL of XENP023796

SEQ ID NO: 34021 - protein, 5 aa, Artificial Sequence
  Description of Artificial Sequence: Synthetic peptide
  XENP023796 vhCDR1
HYGMN

SEQ ID NO: 34022 - protein, 17 aa, Artificial Sequence
  Description of Artificial Sequence: Synthetic peptide
  XENP023796 vhCDR2
WINTYTGEPTYADGFTG

SEQ ID NO: 34023 - protein, 8 aa, Artificial Sequence
  Description of Artificial Sequence: Synthetic peptide
  XENP023796 vhCDR3
DYYGSSPY

SEQ ID NO: 34024 - protein, 16 aa, Artificial Sequence
  Description of Artificial Sequence: Synthetic peptide
  XENP023796 vlCDR1
KSSQSIVHSNGNTYLE

SEQ ID NO: 34025 - protein, 7 aa, Artificial Sequence
  Description of Artificial Sequence: Synthetic peptide
  XENP023796 vlCDR2
KVSNRFS

SEQ ID NO: 34026 - protein, 9 aa, Artificial Sequence
  Description of Artificial Sequence: Synthetic peptide
  XENP023796 vlCDR3
FQGSHVPNT

SEQ ID NO: 34027 - protein, 251 aa, Artificial Sequence
  Description of Artificial Sequence: Synthetic polypeptide
  XENP023801 1C11_H3.64_L3_scFv
QIQLVQSGSELKKPGASVKVSCKASGYTFTHYGMNWVRQAPGQGLEWMGWINTYTGEPTYADGFTGRFVFSLDTSVSTVYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34028 - protein, 117 aa, Artificial Sequence
  Description of Artificial Sequence: Synthetic polypeptide
  VH of XENP023801
QIQLVQSGSELKKPGASVKVSCKASGYTFTHYGMNWVRQAPGQGLEWMGWINTYTGEPTYADGFTGRFVFSLDTSVSTVYLQISSLKAEDTAVYFCARDYYGSSPYWGQGTLVTVSS

SEQ ID NO: 34029 - protein, 114 aa, Artificial Sequence; identical to SEQ ID NO: 33651
  Description of Artificial Sequence: Synthetic polypeptide
  VL of XENP023801

SEQ ID NO: 34030 - protein, 5 aa, Artificial Sequence
  Description of Artificial Sequence: Synthetic peptide
  XENP023801 vhCDR1
HYGMN

SEQ ID NO: 34031 - protein, 17 aa, Artificial Sequence
  Description of Artificial Sequence: Synthetic peptide
  XENP023801 vhCDR2
WINTYTGEPTYADGFTG

SEQ ID NO: 34032 - protein, 8 aa, Artificial Sequence
  Description of Artificial Sequence: Synthetic peptide
  XENP023801 vhCDR3
DYYGSSPY

SEQ ID NO: 34033 - protein, 16 aa, Artificial Sequence
  Description of Artificial Sequence: Synthetic peptide
  XENP023801 vlCDR1
KSSQSIVHSNGNTYLE

SEQ ID NO: 34034 - protein, 7 aa, Artificial Sequence
  Description of Artificial Sequence: Synthetic peptide
  XENP023801 vlCDR2
KVSNRFS

SEQ ID NO: 34035 - protein, 9 aa, Artificial Sequence
  Description of Artificial Sequence: Synthetic peptide
  XENP023801 vlCDR3
FQGSHVPNT

SEQ ID NO: 34036 - protein, 251 aa, Artificial Sequence
  Description of Artificial Sequence: Synthetic polypeptide
  XENP023802 1C11_H3.65_L3_scFv
QIQLVQSGSELKKPGASVKVSCKASGYTFTHYGMNWVRQAPGQGLEWMGWINTYTGEPTYADGFTGRFVFSLDTSVSTAYMQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34037 - protein, 117 aa, Artificial Sequence
  Description of Artificial Sequence: Synthetic polypeptide
  VH of XENP023802
QIQLVQSGSELKKPGASVKVSCKASGYTFTHYGMNWVRQAPGQGLEWMGWINTYTGEPTYADGFTGRFVFSLDTSVSTAYMQISSLKAEDTAVYFCARDYYGSSPYWGQGTLVTVSS

SEQ ID NO: 34038 - protein, 114 aa, Artificial Sequence; identical to SEQ ID NO: 33651
  Description of Artificial Sequence: Synthetic polypeptide
  VL of XENP023802

SEQ ID NO: 34039 - protein, 5 aa, Artificial Sequence
  Description of Artificial Sequence: Synthetic peptide
  XENP023802 vhCDR1
HYGMN

SEQ ID NO: 34040 - protein, 17 aa, Artificial Sequence
  Description of Artificial Sequence: Synthetic peptide
  XENP023802 vhCDR2
WINTYTGEPTYADGFTG

SEQ ID NO: 34041 - protein, 8 aa, Artificial Sequence
  Description of Artificial Sequence: Synthetic peptide
  XENP023802 vhCDR3
DYYGSSPY

SEQ ID NO: 34042 - protein, 16 aa, Artificial Sequence
  Description of Artificial Sequence: Synthetic peptide
  XENP023802 vlCDR1
KSSQSIVHSNGNTYLE

SEQ ID NO: 34043 - protein, 7 aa, Artificial Sequence
  Description of Artificial Sequence: Synthetic peptide
  XENP023802 vlCDR2
KVSNRFS

SEQ ID NO: 34044 - protein, 9 aa, Artificial Sequence
  Description of Artificial Sequence: Synthetic peptide
  XENP023802 vlCDR3
FQGSHVPNT

SEQ ID NO: 34045 - protein, 251 aa, Artificial Sequence
  Description of Artificial Sequence: Synthetic polypeptide
  XENP023803 1C11_H3.66_L3_scFv
QIQLVQSGSELKKPGASVKVSCKASGYTFTHYGMNWVRQAPGQGLEWMGWINTYTGEPTYADGFTGRFVFSLDTSVSTAYMELSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34046 - protein, 117 aa, Artificial Sequence
  Description of Artificial Sequence: Synthetic polypeptide
  VH of XENP023803
QIQLVQSGSELKKPGASVKVSCKASGYTFTHYGMNWVRQAPGQGLEWMGWINTYTGEPTYADGFTGRFVFSLDTSVSTAYMELSSLKAEDTAVYFCARDYYGSSPYWGQGTLVTVSS

SEQ ID NO: 34047 - protein, 114 aa, Artificial Sequence; identical to SEQ ID NO: 33651
  Description of Artificial Sequence: Synthetic polypeptide
  VL of XENP023803

SEQ ID NO: 34048 - protein, 5 aa, Artificial Sequence
  Description of Artificial Sequence: Synthetic peptide
  XENP023803 vhCDR1
HYGMN

SEQ ID NO: 34049 - protein, 17 aa, Artificial Sequence
  Description of Artificial Sequence: Synthetic peptide
  XENP023803 vhCDR2
WINTYTGEPTYADGFTG

SEQ ID NO: 34050 - protein, 8 aa, Artificial Sequence
  Description of Artificial Sequence: Synthetic peptide
  XENP023803 vhCDR3
DYYGSSPY

SEQ ID NO: 34051 - protein, 16 aa, Artificial Sequence
  Description of Artificial Sequence: Synthetic peptide
  XENP023803 vlCDR1
KSSQSIVHSNGNTYLE

SEQ ID NO: 34052 - protein, 7 aa, Artificial Sequence
  Description of Artificial Sequence: Synthetic peptide
  XENP023803 vlCDR2
KVSNRFS

SEQ ID NO: 34053 - protein, 9 aa, Artificial Sequence
  Description of Artificial Sequence: Synthetic peptide
  XENP023803 vlCDR3
FQGSHVPNT

SEQ ID NO: 34054 - protein, 251 aa, Artificial Sequence
  Description of Artificial Sequence: Synthetic polypeptide
  XENP023804 1C11_H3.67_L3_scFv
QIQLVQSGSELKKPGASVKVSCKASGYTFTHYGMNWVRQAPGQGLEWMGWINTYTGEPTYADGFTGRFVFSLDTSVSTAYLQLSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34055 - protein, 117 aa, Artificial Sequence
  Description of Artificial Sequence: Synthetic polypeptide
  VH of XENP023804
QIQLVQSGSELKKPGASVKVSCKASGYTFTHYGMNWVRQAPGQGLEWMGWINTYTGEPTYADGFTGRFVFSLDTSVSTAYLQLSSLKAEDTAVYFCARDYYGSSPYWGQGTLVTVSS

SEQ ID NO: 34056 - protein, 114 aa, Artificial Sequence; identical to SEQ ID NO: 33651
  Description of Artificial Sequence: Synthetic polypeptide
  VL of XENP023804

SEQ ID NO: 34057 - protein, 5 aa, Artificial Sequence
  Description of Artificial Sequence: Synthetic peptide
  XENP023804 vhCDR1
HYGMN

SEQ ID NO: 34058 - protein, 17 aa, Artificial Sequence
  Description of Artificial Sequence: Synthetic peptide
  XENP023804 vhCDR2
WINTYTGEPTYADGFTG

SEQ ID NO: 34059 - protein, 8 aa, Artificial Sequence
  Description of Artificial Sequence: Synthetic peptide
  XENP023804 vhCDR3
DYYGSSPY

SEQ ID NO: 34060 - protein, 16 aa, Artificial Sequence
  Description of Artificial Sequence: Synthetic peptide
  XENP023804 vlCDR1
KSSQSIVHSNGNTYLE

SEQ ID NO: 34061 - protein, 7 aa, Artificial Sequence
  Description of Artificial Sequence: Synthetic peptide
  XENP023804 vlCDR2
KVSNRFS

SEQ ID NO: 34062 - protein, 9 aa, Artificial Sequence
  Description of Artificial Sequence: Synthetic peptide
  XENP023804 vlCDR3
FQGSHVPNT

SEQ ID NO: 34063 - protein, 251 aa, Artificial Sequence
  Description of Artificial Sequence: Synthetic polypeptide
  XENP023805 1C11_H3.68_L3_scFv
QIQLVQSGSELKKPGASVKVSCKASGYTFTHYGMNWVRQAPGQGLEWMGWINTYTGEPTYADGFTGRFVFSLDTSVSTAYLQMSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34064 - protein, 117 aa, Artificial Sequence
  Description of Artificial Sequence: Synthetic polypeptide
  VH of XENP023805
QIQLVQSGSELKKPGASVKVSCKASGYTFTHYGMNWVRQAPGQGLEWMGWINTYTGEPTYADGFTGRFVFSLDTSVSTAYLQMSSLKAEDTAVYFCARDYYGSSPYWGQGTLVTVSS

SEQ ID NO: 34065 - protein, 114 aa, Artificial Sequence; identical to SEQ ID NO: 33651
  Description of Artificial Sequence: Synthetic polypeptide
  VL of XENP023805

SEQ ID NO: 34066 - protein, 5 aa, Artificial Sequence
  Description of Artificial Sequence: Synthetic peptide
  XENP023805 vhCDR1
HYGMN

SEQ ID NO: 34067 - protein, 17 aa, Artificial Sequence
  Description of Artificial Sequence: Synthetic peptide
  XENP023805 vhCDR2
WINTYTGEPTYADGFTG

SEQ ID NO: 34068 - protein, 8 aa, Artificial Sequence
  Description of Artificial Sequence: Synthetic peptide
  XENP023805 vhCDR3
DYYGSSPY

SEQ ID NO: 34069 - protein, 16 aa, Artificial Sequence
  Description of Artificial Sequence: Synthetic peptide
  XENP023805 vlCDR1
KSSQSIVHSNGNTYLE

SEQ ID NO: 34070 - protein, 7 aa, Artificial Sequence
  Description of Artificial Sequence: Synthetic peptide
  XENP023805 vlCDR2
KVSNRFS

SEQ ID NO: 34071 - protein, 9 aa, Artificial Sequence
  Description of Artificial Sequence: Synthetic peptide
  XENP023805 vlCDR3
FQGSHVPNT

SEQ ID NO: 34072 - protein, 251 aa, Artificial Sequence
  Description of Artificial Sequence: Synthetic polypeptide
  XENP023806 1C11_H3.69_L3_scFv
QIQLVQSGSELKKPGASVKVSCKASGYTFTHYGMNWVRQAPGQGLEWMGWINTYTGEPTYADGFTGRFVFSLDTSVSTAYLQWSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34073 - protein, 117 aa, Artificial Sequence
  Description of Artificial Sequence: Synthetic polypeptide
  VH of XENP023806
QIQLVQSGSELKKPGASVKVSCKASGYTFTHYGMNWVRQAPGQGLEWMGWINTYTGEPTYADGFTGRFVFSLDTSVSTAYLQWSSLKAEDTAVYFCARDYYGSSPYWGQGTLVTVSS

SEQ ID NO: 34074 - protein, 114 aa, Artificial Sequence; identical to SEQ ID NO: 33651
  Description of Artificial Sequence: Synthetic polypeptide
  VL of XENP023806

SEQ ID NO: 34075 - protein, 5 aa, Artificial Sequence
  Description of Artificial Sequence: Synthetic peptide
  XENP023806 vhCDR1
HYGMN

SEQ ID NO: 34076 - protein, 17 aa, Artificial Sequence
  Description of Artificial Sequence: Synthetic peptide
  XENP023806 vhCDR2
WINTYTGEPTYADGFTG

SEQ ID NO: 34077 - protein, 8 aa, Artificial Sequence
  Description of Artificial Sequence: Synthetic peptide
  XENP023806 vhCDR3
DYYGSSPY

SEQ ID NO: 34078 - protein, 16 aa, Artificial Sequence
  Description of Artificial Sequence: Synthetic peptide
  XENP023806 vlCDR1
KSSQSIVHSNGNTYLE

SEQ ID NO: 34079 - protein, 7 aa, Artificial Sequence
  Description of Artificial Sequence: Synthetic peptide
  XENP023806 vlCDR2
KVSNRFS

SEQ ID NO: 34080 - protein, 9 aa, Artificial Sequence
  Description of Artificial Sequence: Synthetic peptide
  XENP023806 vlCDR3
FQGSHVPNT

SEQ ID NO: 34081 - protein, 251 aa, Artificial Sequence
  Description of Artificial Sequence: Synthetic polypeptide
  XENP023807 1C11_H3.70_L3_scFv
QIQLVQSGSELKKPGASVKVSCKASGYTFTHYGMNWVRQAPGQGLEWMGWINTYTGEPTYADGFTGRFVFSLDTSVSTAYLQVSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34082 - protein, 117 aa, Artificial Sequence
  Description of Artificial Sequence: Synthetic polypeptide
  VH of XENP023807
QIQLVQSGSELKKPGASVKVSCKASGYTFTHYGMNWVRQAPGQGLEWMGWINTYTGEPTYADGFTGRFVFSLDTSVSTAYLQVSSLKAEDTAVYFCARDYYGSSPYWGQGTLVTVSS

SEQ ID NO: 34083 - protein, 114 aa, Artificial Sequence; identical to SEQ ID NO: 33651
  Description of Artificial Sequence: Synthetic polypeptide
  VL of XENP023807

SEQ ID NO: 34084 - protein, 5 aa, Artificial Sequence
  Description of Artificial Sequence: Synthetic peptide
  XENP023807 vhCDR1
HYGMN

SEQ ID NO: 34085 - protein, 17 aa, Artificial Sequence
  Description of Artificial Sequence: Synthetic peptide
  XENP023807 vhCDR2
WINTYTGEPTYADGFTG

SEQ ID NO: 34086 - protein, 8 aa, Artificial Sequence
  Description of Artificial Sequence: Synthetic peptide
  XENP023807 vhCDR3
DYYGSSPY

SEQ ID NO: 34087 - protein, 16 aa, Artificial Sequence
  Description of Artificial Sequence: Synthetic peptide
  XENP023807 vlCDR1
KSSQSIVHSNGNTYLE

SEQ ID NO: 34088 - protein, 7 aa, Artificial Sequence
  Description of Artificial Sequence: Synthetic peptide
  XENP023807 vlCDR2
KVSNRFS

SEQ ID NO: 34089 - protein, 9 aa, Artificial Sequence
  Description of Artificial Sequence: Synthetic peptide
  XENP023807 vlCDR3
FQGSHVPNT

SEQ ID NO: 34090 - protein, 251 aa, Artificial Sequence
  Description of Artificial Sequence: Synthetic polypeptide
  XENP023808 1C11_H3.71_L3_scFv
QIQLVQSGSELKKPGASVKVSCKASGYTFTHYGMNWVRQAPGQGLEWMGWINTYTGEPTYADGFTGRFVFSLDTSVSTAYLQISSLRAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34091 - protein, 117 aa, Artificial Sequence
  Description of Artificial Sequence: Synthetic polypeptide
  VH of XENP023808
QIQLVQSGSELKKPGASVKVSCKASGYTFTHYGMNWVRQAPGQGLEWMGWINTYTGEPTYADGFTGRFVFSLDTSVSTAYLQISSLRAEDTAVYFCARDYYGSSPYWGQGTLVTVSS

SEQ ID NO: 34092 - protein, 114 aa, Artificial Sequence; identical to SEQ ID NO: 33651
  Description of Artificial Sequence: Synthetic polypeptide
  VL of XENP023808

SEQ ID NO: 34093 - protein, 5 aa, Artificial Sequence
  Description of Artificial Sequence: Synthetic peptide
  XENP023808 vhCDR1
HYGMN

SEQ ID NO: 34094 - protein, 17 aa, Artificial Sequence
  Description of Artificial Sequence: Synthetic peptide
  XENP023808 vhCDR2
WINTYTGEPTYADGFTG

SEQ ID NO: 34095 - protein, 8 aa, Artificial Sequence
  Description of Artificial Sequence: Synthetic peptide
  XENP023808 vhCDR3
DYYGSSPY

SEQ ID NO: 34096 - protein, 16 aa, Artificial Sequence
  Description of Artificial Sequence: Synthetic peptide
  XENP023808 vlCDR1
KSSQSIVHSNGNTYLE

SEQ ID NO: 34097 - protein, 7 aa, Artificial Sequence
  Description of Artificial Sequence: Synthetic peptide
  XENP023808 vlCDR2
KVSNRFS

SEQ ID NO: 34098 - protein, 9 aa, Artificial Sequence
  Description of Artificial Sequence: Synthetic peptide
  XENP023808 vlCDR3
FQGSHVPNT

SEQ ID NO: 34099 - protein, 251 aa, Artificial Sequence
  Description of Artificial Sequence: Synthetic polypeptide
  XENP023809 1C11_H3.72_L3_scFv
QIQLVQSGSELKKPGASVKVSCKASGYTFTHYGMNWVRQAPGQGLEWMGWINTYTGEPTYADGFTGRFVFSLDTSVSTAYLQISSLTAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34100 - protein, 117 aa, Artificial Sequence
  Description of Artificial Sequence: Synthetic polypeptide
  VH of XENP023809
QIQLVQSGSELKKPGASVKVSCKASGYTFTHYGMNWVRQAPGQGLEWMGWINTYTGEPTYADGFTGRFVFSLDTSVSTAYLQISSLTAEDTAVYFCARDYYGSSPYWGQGTLVTVSS

SEQ ID NO: 34101 - protein, 114 aa, Artificial Sequence; identical to SEQ ID NO: 33651
  Description of Artificial Sequence: Synthetic polypeptide
  VL of XENP023809

SEQ ID NO: 34102 - protein, 5 aa, Artificial Sequence
  Description of Artificial Sequence: Synthetic peptide
  XENP023809 vhCDR1
HYGMN

SEQ ID NO: 34103 - protein, 17 aa, Artificial Sequence
  Description of Artificial Sequence: Synthetic peptide
  XENP023809 vhCDR2
WINTYTGEPTYADGFTG

SEQ ID NO: 34104 - protein, 8 aa, Artificial Sequence
  Description of Artificial Sequence: Synthetic peptide
  XENP023809 vhCDR3
DYYGSSPY

SEQ ID NO: 34105 - protein, 16 aa, Artificial Sequence
  Description of Artificial Sequence: Synthetic peptide
  XENP023809 vlCDR1
KSSQSIVHSNGNTYLE

SEQ ID NO: 34106 - protein, 7 aa, Artificial Sequence
  Description of Artificial Sequence: Synthetic peptide
  XENP023809 vlCDR2
KVSNRFS

SEQ ID NO: 34107 - protein, 9 aa, Artificial Sequence
  Description of Artificial Sequence: Synthetic peptide
  XENP023809 vlCDR3
FQGSHVPNT

SEQ ID NO: 34108 - protein, 251 aa, Artificial Sequence
  Description of Artificial Sequence: Synthetic polypeptide
  XENP023810 1C11_H3.73_L3_scFv
QIQLVQSGSELKKPGASVKVSCKASGYTFTHYGMNWVRQAPGQGLEWMGWINTYTGEPTYADGFTGRFVFSLDTSVSTAYLQISSLRSEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34109 - protein, 117 aa, Artificial Sequence
  Description of Artificial Sequence: Synthetic polypeptide
  VH of XENP023810
QIQLVQSGSELKKPGASVKVSCKASGYTFTHYGMNWVRQAPGQGLEWMGWINTYTGEPTYADGFTGRFVFSLDTSVSTAYLQISSLRSEDTAVYFCARDYYGSSPYWGQGTLVTVSS

SEQ ID NO: 34110 - protein, 114 aa, Artificial Sequence; identical to SEQ ID NO: 33651
  Description of Artificial Sequence: Synthetic polypeptide
  VL of XENP023810

SEQ ID NO: 34111 - protein, 5 aa, Artificial Sequence
  Description of Artificial Sequence: Synthetic peptide
  XENP023810 vhCDR1
HYGMN

SEQ ID NO: 34112 - protein, 17 aa, Artificial Sequence
  Description of Artificial Sequence: Synthetic peptide
  XENP023810 vhCDR2
WINTYTGEPTYADGFTG

SEQ ID NO: 34113 - protein, 8 aa, Artificial Sequence
  Description of Artificial Sequence: Synthetic peptide
  XENP023810 vhCDR3
DYYGSSPY

SEQ ID NO: 34114 - protein, 16 aa, Artificial Sequence
  Description of Artificial Sequence: Synthetic peptide
  XENP023810 vlCDR1
KSSQSIVHSNGNTYLE

SEQ ID NO: 34115 - protein, 7 aa, Artificial Sequence
  Description of Artificial Sequence: Synthetic peptide
  XENP023810 vlCDR2
KVSNRFS

SEQ ID NO: 34116 - protein, 9 aa, Artificial Sequence
  Description of Artificial Sequence: Synthetic peptide
  XENP023810 vlCDR3
FQGSHVPNT

SEQ ID NO: 34117 - protein, 251 aa, Artificial Sequence
  Description of Artificial Sequence: Synthetic polypeptide
  XENP023811 1C11_H3.74_L3_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34118 - protein, 117 aa, Artificial Sequence
  Description of Artificial Sequence: Synthetic polypeptide
  VH of XENP023811
QIQLVQSGSELKKPGASVKVSCKASGYTFTHYGMNWVRQAPGQGLEWMGWINTYTGEPTYADGFTGRFVFSLDTSVSTAYLQISSLKAEDTAVYYCARDYYGSSPYWGQGTLVTVSS

SEQ ID NO: 34119 - protein, 114 aa, Artificial Sequence; identical to SEQ ID NO: 33651
  Description of Artificial Sequence: Synthetic polypeptide
  VL of XENP023811

SEQ ID NO: 34120 - protein, 5 aa, Artificial Sequence
  Description of Artificial Sequence: Synthetic peptide
  XENP023811 vhCDR1
HYGMN

SEQ ID NO: 34121 - protein, 17 aa, Artificial Sequence
  Description of Artificial Sequence: Synthetic peptide
  XENP023811 vhCDR2
WINTYTGEPTYADGFTG

SEQ ID NO: 34122 - protein, 8 aa, Artificial Sequence
  Description of Artificial Sequence: Synthetic peptide
  XENP023811 vhCDR3
DYYGSSPY

SEQ ID NO: 34123 - protein, 16 aa, Artificial Sequence
  Description of Artificial Sequence: Synthetic peptide
  XENP023811 vlCDR1
KSSQSIVHSNGNTYLE

SEQ ID NO: 34124 - protein, 7 aa, Artificial Sequence
  Description of Artificial Sequence: Synthetic peptide
  XENP023811 vlCDR2
KVSNRFS

SEQ ID NO: 34125 - protein, 9 aa, Artificial Sequence
  Description of Artificial Sequence: Synthetic peptide
  XENP023811 vlCDR3
FQGSHVPNT

SEQ ID NO: 34126 - protein, 251 aa, Artificial Sequence
  Description of Artificial Sequence: Synthetic polypeptide
  XENP023812 1C11_H3.75_L3_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCTRDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34127 - protein, 117 aa, Artificial Sequence
  Description of Artificial Sequence: Synthetic polypeptide
  VH of XENP023812
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCTRDYYGSSPYWGQGTLVTVSS

SEQ ID NO: 34128 - protein, 114 aa, Artificial Sequence; identical to SEQ ID NO: 33651
  Description of Artificial Sequence: Synthetic polypeptide
  VL of XENP023812

SEQ ID NO: 34129 - protein, 5 aa, Artificial Sequence
  Description of Artificial Sequence: Synthetic peptide
  XENP023812 vhCDR1
HYGMN

SEQ ID NO: 34130 - protein, 17 aa, Artificial Sequence
  Description of Artificial Sequence: Synthetic peptide
  XENP023812 vhCDR2
WINTYTGEPTYADGFTG

SEQ ID NO: 34131 - protein, 8 aa, Artificial Sequence
  Description of Artificial Sequence: Synthetic peptide
  XENP023812 vhCDR3
DYYGSSPY

SEQ ID NO: 34132 - protein, 16 aa, Artificial Sequence
  Description of Artificial Sequence: Synthetic peptide
  XENP023812 vlCDR1
KSSQSIVHSNGNTYLE

SEQ ID NO: 34133 - protein, 7 aa, Artificial Sequence
  Description of Artificial Sequence: Synthetic peptide
  XENP023812 vlCDR2
KVSNRFS

SEQ ID NO: 34134 - protein, 9 aa, Artificial Sequence
  Description of Artificial Sequence: Synthetic peptide
  XENP023812 vlCDR3
FQGSHVPNT

SEQ ID NO: 34135 - protein, 251 aa, Artificial Sequence
  Description of Artificial Sequence: Synthetic polypeptide
  XENP024191 1C11_H3_L3.84_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 34136 - protein, 117 aa, Artificial Sequence; identical to SEQ ID NO: 33034
  Description of Artificial Sequence: Synthetic polypeptide
  VH of XENP024191

SEQ ID NO: 34137 - protein, 114 aa, Artificial Sequence
  Description of Artificial Sequence: Synthetic polypeptide
  VL of XENP024191
DVVMTQSPDSLAVSLGERATINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 34138 - protein, 5 aa, Artificial Sequence
  Description of Artificial Sequence: Synthetic peptide
  XENP024191 vhCDR1
HYGMN

SEQ ID NO: 34139 - protein, 17 aa, Artificial Sequence
  Description of Artificial Sequence: Synthetic peptide
  XENP024191 vhCDR2
WINTYTGEPTYADGFTG

SEQ ID NO: 34140 - protein, 8 aa, Artificial Sequence
  Description of Artificial Sequence: Synthetic peptide
  XENP024191 vhCDR3
DYYGSSPY

SEQ ID NO: 34141 - protein, 16 aa, Artificial Sequence
  Description of Artificial Sequence: Synthetic peptide
  XENP024191 vlCDR1
KASQSIVHSNGNTYLE

SEQ ID NO: 34142 - protein, 7 aa, Artificial Sequence
  Description of Artificial Sequence: Synthetic peptide
  XENP024191 vlCDR2
KVSNRFS

SEQ ID NO: 34143 - protein, 9 aa, Artificial Sequence
  Description of Artificial Sequence: Synthetic peptide
  XENP024191 vlCDR3
FQGSHVPNT

SEQ ID NO: 34144 - protein, 251 aa, Artificial Sequence
  Description of Artificial Sequence: Synthetic polypeptide
  XENP024192 1C11_H3_L3.102_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34145 - protein, 117 aa, Artificial Sequence; identical to SEQ ID NO: 33034
  Description of Artificial Sequence: Synthetic polypeptide
  VH of XENP024192

SEQ ID NO: 34146 - protein, 114 aa, Artificial Sequence
  Description of Artificial Sequence: Synthetic polypeptide
  VL of XENP024192
DVLMTQSPDSLAVSVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34147 - protein, 5 aa, Artificial Sequence
  Description of Artificial Sequence: Synthetic peptide
  XENP024192 vhCDR1
HYGMN

SEQ ID NO: 34148 - protein, 17 aa, Artificial Sequence
  Description of Artificial Sequence: Synthetic peptide
  XENP024192 vhCDR2
WINTYTGEPTYADGFTG

SEQ ID NO: 34149 - protein, 8 aa, Artificial Sequence
  Description of Artificial Sequence: Synthetic peptide
  XENP024192 vhCDR3
DYYGSSPY

SEQ ID NO: 34150 - protein, 16 aa, Artificial Sequence
  Description of Artificial Sequence: Synthetic peptide
  XENP024192 vlCDR1
KSSQSIVHSNGNTYLE

SEQ ID NO: 34151 - protein, 7 aa, Artificial Sequence
  Description of Artificial Sequence: Synthetic peptide
  XENP024192 vlCDR2
KVSNRFS

SEQ ID NO: 34152 - protein, 9 aa, Artificial Sequence
  Description of Artificial Sequence: Synthetic peptide
  XENP024192 vlCDR3
FQGSHVPNT

SEQ ID NO: 34153 - protein, 251 aa, Artificial Sequence
  Description of Artificial Sequence: Synthetic polypeptide
  XENP024193 1C11_H3_L3.103_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34154 - protein, 117 aa, Artificial Sequence; identical to SEQ ID NO: 33034
  Description of Artificial Sequence: Synthetic polypeptide
  VH of XENP024193

SEQ ID NO: 34155 - protein, 114 aa, Artificial Sequence
  Description of Artificial Sequence: Synthetic polypeptide
  VL of XENP024193
DVLMTQSPDSLAVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34156 - protein, 5 aa, Artificial Sequence
  Description of Artificial Sequence: Synthetic peptide
  XENP024193 vhCDR1
HYGMN

SEQ ID NO: 34157 - protein, 17 aa, Artificial Sequence
  Description of Artificial Sequence: Synthetic peptide
  XENP024193 vhCDR2
WINTYTGEPTYADGFTG

SEQ ID NO: 34158 - protein, 8 aa, Artificial Sequence
  Description of Artificial Sequence: Synthetic peptide
  XENP024193 vhCDR3
DYYGSSPY

SEQ ID NO: 34159 - protein, 16 aa, Artificial Sequence
  Description of Artificial Sequence: Synthetic peptide
  XENP024193 vlCDR1
KSSQSIVHSNGNTYLE

SEQ ID NO: 34160 - protein, 7 aa, Artificial Sequence
  Description of Artificial Sequence: Synthetic peptide
  XENP024193 vlCDR2
KVSNRFS

SEQ ID NO: 34161 - protein, 9 aa, Artificial Sequence
  Description of Artificial Sequence: Synthetic peptide
  XENP024193 vlCDR3
FQGSHVPNT

SEQ ID NO: 34162 - protein, 251 aa, Artificial Sequence; identical to SEQ ID NO: 33235
  Description of Artificial Sequence: Synthetic polypeptide
  XENP024194 1C11_H3_L3.104_scFv

SEQ ID NO: 34163 - protein, 117 aa, Artificial Sequence; identical to SEQ ID NO: 33034
  Description of Artificial Sequence: Synthetic polypeptide
  VH of XENP024194

SEQ ID NO: 34164 - protein, 114 aa, Artificial Sequence; identical to SEQ ID NO: 33237
  Description of Artificial Sequence: Synthetic polypeptide
  VL of XENP024194

SEQ ID NO: 34165 - protein, 5 aa, Artificial Sequence
  Description of Artificial Sequence: Synthetic peptide
  XENP024194 vhCDR1
HYGMN

SEQ ID NO: 34166 - protein, 17 aa, Artificial Sequence
  Description of Artificial Sequence: Synthetic peptide
  XENP024194 vhCDR2
WINTYTGEPTYADGFTG

SEQ ID NO: 34167 - protein, 8 aa, Artificial Sequence
  Description of Artificial Sequence: Synthetic peptide
  XENP024194 vhCDR3
DYYGSSPY

SEQ ID NO: 34168 - protein, 16 aa, Artificial Sequence
  Description of Artificial Sequence: Synthetic peptide
  XENP024194 vlCDR1
KSSQSIVHSNGNTYLE

SEQ ID NO: 34169 - protein, 7 aa, Artificial Sequence
  Description of Artificial Sequence: Synthetic peptide
  XENP024194 vlCDR2
KVSNRFS

SEQ ID NO: 34170 - protein, 9 aa, Artificial Sequence
  Description of Artificial Sequence: Synthetic peptide
  XENP024194 vlCDR3
FQGSHVPNT

SEQ ID NO: 34171 - protein, 251 aa, Artificial Sequence
  Description of Artificial Sequence: Synthetic polypeptide
  XENP024195 1C11_H3_L3.111_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQGIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34172 - protein, 117 aa, Artificial Sequence; identical to SEQ ID NO: 33034
  Description of Artificial Sequence: Synthetic polypeptide
  VH of XENP024195

SEQ ID NO: 34173 - protein, 114 aa, Artificial Sequence
  Description of Artificial Sequence: Synthetic polypeptide
  VL of XENP024195
DVLMTQSPDSLAVSLGERATINCKSSQGIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34174 - protein, 5 aa, Artificial Sequence
  Description of Artificial Sequence: Synthetic peptide
  XENP024195 vhCDR1
HYGMN

SEQ ID NO: 34175 - protein, 17 aa, Artificial Sequence
  Description of Artificial Sequence: Synthetic peptide
  XENP024195 vhCDR2
WINTYTGEPTYADGFTG

SEQ ID NO: 34176 - protein, 8 aa, Artificial Sequence
  Description of Artificial Sequence: Synthetic peptide
  XENP024195 vhCDR3
DYYGSSPY

SEQ ID NO: 34177 - protein, 16 aa, Artificial Sequence
  Description of Artificial Sequence: Synthetic peptide
  XENP024195 vlCDR1
KSSQGIVHSNGNTYLE

SEQ ID NO: 34178 - protein, 7 aa, Artificial Sequence
  Description of Artificial Sequence: Synthetic peptide
  XENP024195 vlCDR2
KVSNRFS

SEQ ID NO: 34179 - protein, 9 aa, Artificial Sequence
  Description of Artificial Sequence: Synthetic peptide
  XENP024195 vlCDR3
FQGSHVPNT

SEQ ID NO: 34180 - protein, 251 aa, Artificial Sequence
  Description of Artificial Sequence: Synthetic polypeptide
  XENP024196 1C11_H3_L3.112_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSVLHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34181 - protein, 117 aa, Artificial Sequence; identical to SEQ ID NO: 33034
  Description of Artificial Sequence: Synthetic polypeptide
  VH of XENP024196

SEQ ID NO: 34182 - protein, 114 aa, Artificial Sequence
  Description of Artificial Sequence: Synthetic polypeptide
  VL of XENP024196
DVLMTQSPDSLAVSLGERATINCKSSQSVLHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34183 - protein, 5 aa, Artificial Sequence
  Description of Artificial Sequence: Synthetic peptide
  XENP024196 vhCDR1
HYGMN

SEQ ID NO: 34184 - protein, 17 aa, Artificial Sequence
  Description of Artificial Sequence: Synthetic peptide
  XENP024196 vhCDR2
WINTYTGEPTYADGFTG

SEQ ID NO: 34185 - protein, 8 aa, Artificial Sequence
  Description of Artificial Sequence: Synthetic peptide
  XENP024196 vhCDR3
DYYGSSPY

SEQ ID NO: 34186 - protein, 16 aa, Artificial Sequence
  Description of Artificial Sequence: Synthetic peptide
  XENP024196 vlCDR1
KSSQSVLHSNGNTYLE

SEQ ID NO: 34187 - protein, 7 aa, Artificial Sequence
  Description of Artificial Sequence: Synthetic peptide
  XENP024196 vlCDR2
KVSNRFS

SEQ ID NO: 34188 - protein, 9 aa, Artificial Sequence
  Description of Artificial Sequence: Synthetic peptide
  XENP024196 vlCDR3
FQGSHVPNT

SEQ ID NO: 34189 - protein, 251 aa, Artificial Sequence
  Description of Artificial Sequence: Synthetic polypeptide
  XENP024201 1C11_H3_L3.113_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGKSPKLLIYKVSNRFSGVPDRFSGSGSGTDFTLTISSLQAEDVAVYYCFQGSHVPNTFGGGTKVEIKGS

SEQ ID NO: 34190 - protein, 117 aa, Artificial Sequence; identical to SEQ ID NO: 33034
  Description of Artificial Sequence: Synthetic polypeptide
  VH of XENP024201

SEQ ID NO: 34191 - protein, 114 aa, Artificial Sequence
  Description of Artificial Sequence: Synthetic polypeptide
  VL of XENP024201
DVLMTQSPDSLAVSLGERATINCKSSQSIVHSNGNTYLEWYQQKPGKSPKLLIYKVSNRFSGVPDRFSGSGSGTDFTLTISSLQAEDVAVYYCFQGSHVPNTFGGGTKVEIKGS

SEQ ID NO: 34192 - protein, 5 aa, Artificial Sequence
  Description of Artificial Sequence: Synthetic peptide
  XENP024201 vhCDR1
HYGMN

SEQ ID NO: 34193 - protein, 17 aa, Artificial Sequence
  Description of Artificial Sequence: Synthetic peptide
  XENP024201 vhCDR2
WINTYTGEPTYADGFTG

SEQ ID NO: 34194 - protein, 8 aa, Artificial Sequence
  Description of Artificial Sequence: Synthetic peptide
  XENP024201 vhCDR3
DYYGSSPY

SEQ ID NO: 34195 - protein, 16 aa, Artificial Sequence
  Description of Artificial Sequence: Synthetic peptide
  XENP024201 vlCDR1
KSSQSIVHSNGNTYLE

SEQ ID NO: 34196 - protein, 7 aa, Artificial Sequence
  Description of Artificial Sequence: Synthetic peptide
  XENP024201 vlCDR2
KVSNRFS

SEQ ID NO: 34197 - protein, 9 aa, Artificial Sequence
  Description of Artificial Sequence: Synthetic peptide
  XENP024201 vlCDR3
FQGSHVPNT

SEQ ID NO: 34198 - protein, 251 aa, Artificial Sequence
  Description of Artificial Sequence: Synthetic polypeptide
  XENP024202 1C11_H3_L3.115_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGKVPKLLIYKVSNRFSGVPDRFSGSGSGTDFTLTISSLQAEDVAVYYCFQGSHVPNTFGGGTKVEIKGS

SEQ ID NO: 34199 - protein, 117 aa, Artificial Sequence; identical to SEQ ID NO: 33034
  Description of Artificial Sequence: Synthetic polypeptide
  VH of XENP024202

SEQ ID NO: 34200 - protein, 114 aa, Artificial Sequence
  Description of Artificial Sequence: Synthetic polypeptide
  VL of XENP024202
DVLMTQSPDSLAVSLGERATINCKSSQSIVHSNGNTYLEWYQQKPGKVPKLLIYKVSNRFSGVPDRFSGSGSGTDFTLTISSLQAEDVAVYYCFQGSHVPNTFGGGTKVEIKGS

SEQ ID NO: 34201 - protein, 5 aa, Artificial Sequence
  Description of Artificial Sequence: Synthetic peptide
  XENP024202 vhCDR1
HYGMN

SEQ ID NO: 34202 - protein, 17 aa, Artificial Sequence
  Description of Artificial Sequence: Synthetic peptide
  XENP024202 vhCDR2
WINTYTGEPTYADGFTG

SEQ ID NO: 34203 - protein, 8 aa, Artificial Sequence
  Description of Artificial Sequence: Synthetic peptide
  XENP024202 vhCDR3
DYYGSSPY

SEQ ID NO: 34204 - protein, 16 aa, Artificial Sequence
  Description of Artificial Sequence: Synthetic peptide
  XENP024202 vlCDR1
KSSQSIVHSNGNTYLE

SEQ ID NO: 34205 - protein, 7 aa, Artificial Sequence
  Description of Artificial Sequence: Synthetic peptide
  XENP024202 vlCDR2
KVSNRFS

SEQ ID NO: 34206 - protein, 9 aa, Artificial Sequence
  Description of Artificial Sequence: Synthetic peptide
  XENP024202 vlCDR3
FQGSHVPNT

SEQ ID NO: 34207 - protein, 251 aa, Artificial Sequence
  Description of Artificial Sequence: Synthetic polypeptide
  XENP024203 1C11_H3_L3.118_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSSRFSGVPDRFSGSGSGTDFTLTISSLQAEDVAVYYCFQGSHVPNTFGGGTKVEIKGS

SEQ ID NO: 34208 - protein, 117 aa, Artificial Sequence; identical to SEQ ID NO: 33034
  Description of Artificial Sequence: Synthetic polypeptide
  VH of XENP024203

SEQ ID NO: 34209 - protein, 114 aa, Artificial Sequence
  Description of Artificial Sequence: Synthetic polypeptide
  VL of XENP024203
DVLMTQSPDSLAVSLGERATINCKSSQSIVHSNGNTYLEWYQQKPGQSPKLLIYKVSSRFSGVPDRFSGSGSGTDFTLTISSLQAEDVAVYYCFQGSHVPNTFGGGTKVEIKGS

SEQ ID NO: 34210 - protein, 5 aa, Artificial Sequence
  Description of Artificial Sequence: Synthetic peptide
  XENP024203 vhCDR1
HYGMN

SEQ ID NO: 34211 - protein, 17 aa, Artificial Sequence
  Description of Artificial Sequence: Synthetic peptide
  XENP024203 vhCDR2
WINTYTGEPTYADGFTG

SEQ ID NO: 34212 - protein, 8 aa, Artificial Sequence
  Description of Artificial Sequence: Synthetic peptide
  XENP024203 vhCDR3
DYYGSSPY

SEQ ID NO: 34213 - protein, 16 aa, Artificial Sequence
  Description of Artificial Sequence: Synthetic peptide
  XENP024203 vlCDR1
KSSQSIVHSNGNTYLE

SEQ ID NO: 34214 - protein, 7 aa, Artificial Sequence
  Description of Artificial Sequence: Synthetic peptide
  XENP024203 vlCDR2
KVSSRFS

SEQ ID NO: 34215 - protein, 9 aa, Artificial Sequence
  Description of Artificial Sequence: Synthetic peptide
  XENP024203 vlCDR3
FQGSHVPNT

SEQ ID NO: 34216 - protein, 251 aa, Artificial Sequence
  Description of Artificial Sequence: Synthetic polypeptide
  XENP024204 1C11_H3_L3.119_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNLFSGVPDRFSGSGSGTDFTLTISSLQAEDVAVYYCFQGSHVPNTFGGGTKVEIKGS

SEQ ID NO: 34217 - protein, 117 aa, Artificial Sequence; identical to SEQ ID NO: 33034
  Description of Artificial Sequence: Synthetic polypeptide
  VH of XENP024204

SEQ ID NO: 34218 - protein, 114 aa, Artificial Sequence
  Description of Artificial Sequence: Synthetic polypeptide
  VL of XENP024204
DVLMTQSPDSLAVSLGERATINCKSSQSIVHSNGNTYLEWYQQKPGQSPKLLIYKVSNLFSGVPDRFSGSGSGTDFTLTISSLQAEDVAVYYCFQGSHVPNTFGGGTKVEIKGS

SEQ ID NO: 34219 - protein, 5 aa, Artificial Sequence
  Description of Artificial Sequence: Synthetic peptide
  XENP024204 vhCDR1
HYGMN

SEQ ID NO: 34220 - protein, 17 aa, Artificial Sequence
  Description of Artificial Sequence: Synthetic peptide
  XENP024204 vhCDR2
WINTYTGEPTYADGFTG

SEQ ID NO: 34221 - protein, 8 aa, Artificial Sequence
  Description of Artificial Sequence: Synthetic peptide
  XENP024204 vhCDR3
DYYGSSPY

SEQ ID NO: 34222 - protein, 16 aa, Artificial Sequence
  Description of Artificial Sequence: Synthetic peptide
  XENP024204 vlCDR1
KSSQSIVHSNGNTYLE

SEQ ID NO: 34223 - protein, 7 aa, Artificial Sequence
  Description of Artificial Sequence: Synthetic peptide
  XENP024204 vlCDR2
KVSNLFS

SEQ ID NO: 34224 - protein, 9 aa, Artificial Sequence
  Description of Artificial Sequence: Synthetic peptide
  XENP024204 vlCDR3
FQGSHVPNT

SEQ ID NO: 34225 - protein, 251 aa, Artificial Sequence
  Description of Artificial Sequence: Synthetic polypeptide
  XENP024205 1C11_H3_L3.120_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRESGVPDRFSGSGSGTDFTLTISSLQAEDVAVYYCFQGSHVPNTFGGGTKVEIKGS

SEQ ID NO: 34226 - protein, 117 aa, Artificial Sequence; identical to SEQ ID NO: 33034
  Description of Artificial Sequence: Synthetic polypeptide
  VH of XENP024205

SEQ ID NO: 34227 - protein, 114 aa, Artificial Sequence
  Description of Artificial Sequence: Synthetic polypeptide
  VL of XENP024205
DVLMTQSPDSLAVSLGERATINCKSSQSIVHSNGNTYLEWYQQKPGQSPKLLIYKVSNRESGVPDRFSGSGSGTDFTLTISSLQAEDVAVYYCFQGSHVPNTFGGGTKVEIKGS

SEQ ID NO: 34228 - protein, 5 aa, Artificial Sequence
  Description of Artificial Sequence: Synthetic peptide
  XENP024205 vhCDR1
HYGMN

SEQ ID NO: 34229 - protein, 17 aa, Artificial Sequence
  Description of Artificial Sequence: Synthetic peptide
  XENP024205 vhCDR2
WINTYTGEPTYADGFTG

SEQ ID NO: 34230 - protein, 8 aa, Artificial Sequence
  Description of Artificial Sequence: Synthetic peptide
  XENP024205 vhCDR3
DYYGSSPY

SEQ ID NO: 34231 - protein, 16 aa, Artificial Sequence
  Description of Artificial Sequence: Synthetic peptide
  XENP024205 vlCDR1
KSSQSIVHSNGNTYLE

SEQ ID NO: 34232 - protein, 7 aa, Artificial Sequence
  Description of Artificial Sequence: Synthetic peptide
  XENP024205 vlCDR2
KVSNRES

SEQ ID NO: 34233 - protein, 9 aa, Artificial Sequence
  Description of Artificial Sequence: Synthetic peptide
  XENP024205 vlCDR3
FQGSHVPNT

SEQ ID NO: 34234 - protein, 251 aa, Artificial Sequence
  Description of Artificial Sequence: Synthetic polypeptide
  XENP024206 1C11_H3_L3.121_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRQSGVPDRFSGSGSGTDFTLTISSLQAEDVAVYYCFQGSHVPNTFGGGTKVEIKGS

SEQ ID NO: 34235 - protein, 117 aa, Artificial Sequence; identical to SEQ ID NO: 33034
  Description of Artificial Sequence: Synthetic polypeptide
  VH of XENP024206

SEQ ID NO: 34236 - protein, 114 aa, Artificial Sequence
  Description of Artificial Sequence: Synthetic polypeptide
  VL of XENP024206
DVLMTQSPDSLAVSLGERATINCKSSQSIVHSNGNTYLEWYQQKPGQSPKLLIYKVSNRQSGVPDRFSGSGSGTDFTLTISSLQAEDVAVYYCFQGSHVPNTFGGGTKVEIKGS

SEQ ID NO: 34237 - protein, 5 aa, Artificial Sequence
  Description of Artificial Sequence: Synthetic peptide
  XENP024206 vhCDR1
HYGMN

SEQ ID NO: 34238 - protein, 17 aa, Artificial Sequence
  Description of Artificial Sequence: Synthetic peptide
  XENP024206 vhCDR2
WINTYTGEPTYADGFTG

SEQ ID NO: 34239 - protein, 8 aa, Artificial Sequence
  Description of Artificial Sequence: Synthetic peptide
  XENP024206 vhCDR3
DYYGSSPY

SEQ ID NO: 34240 - protein, 16 aa, Artificial Sequence
  Description of Artificial Sequence: Synthetic peptide
  XENP024206 vlCDR1
KSSQSIVHSNGNTYLE

SEQ ID NO: 34241 - protein, 7 aa, Artificial Sequence
  Description of Artificial Sequence: Synthetic peptide
  XENP024206 vlCDR2
KVSNRQS

SEQ ID NO: 34242 - protein, 9 aa, Artificial Sequence
  Description of Artificial Sequence: Synthetic peptide
  XENP024206 vlCDR3
FQGSHVPNT

SEQ ID NO: 34243 - protein, 251 aa, Artificial Sequence
  Description of Artificial Sequence: Synthetic polypeptide
  XENP024207 1C11_H3_L3.122_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGIPDRFSGSGSGTDFTLTISSLQAEDVAVYYCFQGSHVPNTFGGGTKVEIKGS

SEQ ID NO: 34244 - protein, 117 aa, Artificial Sequence; identical to SEQ ID NO: 33034
  Description of Artificial Sequence: Synthetic polypeptide
  VH of XENP024207

SEQ ID NO: 34245 - protein, 114 aa, Artificial Sequence
  Description of Artificial Sequence: Synthetic polypeptide
  VL of XENP024207
DVLMTQSPDSLAVSLGERATINCKSSQSIVHSNGNTYLEWYQQKPGQSPKLLIYKVSNRFSGIPDRFSGSGSGTDFTLTISSLQAEDVAVYYCFQGSHVPNTFGGGTKVEIKGS

SEQ ID NO: 34246 - protein, 5 aa, Artificial Sequence
  Description of Artificial Sequence: Synthetic peptide
  XENP024207 vhCDR1
HYGMN

SEQ ID NO: 34247 - protein, 17 aa, Artificial Sequence
  Description of Artificial Sequence: Synthetic peptide
  XENP024207 vhCDR2
WINTYTGEPTYADGFTG

SEQ ID NO: 34248 - protein, 8 aa, Artificial Sequence
  Description of Artificial Sequence: Synthetic peptide
  XENP024207 vhCDR3
DYYGSSPY

SEQ ID NO: 34249 - protein, 16 aa, Artificial Sequence
  Description of Artificial Sequence: Synthetic peptide
  XENP024207 vlCDR1
KSSQSIVHSNGNTYLE

SEQ ID NO: 34250 - protein, 7 aa, Artificial Sequence
  Description of Artificial Sequence: Synthetic peptide
  XENP024207 vlCDR2
KVSNRFS

SEQ ID NO: 34251 - protein, 9 aa, Artificial Sequence
  Description of Artificial Sequence: Synthetic peptide
  XENP024207 vlCDR3
FQGSHVPNT

SEQ ID NO: 34252 - protein, 251 aa, Artificial Sequence
  Description of Artificial Sequence: Synthetic polypeptide
  XENP024208 1C11_H3_L3.124_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPARFSGSGSGTDFTLTISSLQAEDVAVYYCFQGSHVPNTFGGGTKVEIKGS

SEQ ID NO: 34253 - protein, 117 aa, Artificial Sequence; identical to SEQ ID NO: 33034
  Description of Artificial Sequence: Synthetic polypeptide
  VH of XENP024208

SEQ ID NO: 34254 - protein, 114 aa, Artificial Sequence
  Description of Artificial Sequence: Synthetic polypeptide
  VL of XENP024208
DVLMTQSPDSLAVSLGERATINCKSSQSIVHSNGNTYLEWYQQKPGQSPKLLIYKVSNRFSGVPARFSGSGSGTDFTLTISSLQAEDVAVYYCFQGSHVPNTFGGGTKVEIKGS

SEQ ID NO: 34255 - protein, 5 aa, Artificial Sequence
  Description of Artificial Sequence: Synthetic peptide
  XENP024208 vhCDR1
HYGMN

SEQ ID NO: 34256 - protein, 17 aa, Artificial Sequence
  Description of Artificial Sequence: Synthetic peptide
  XENP024208 vhCDR2
WINTYTGEPTYADGFTG

SEQ ID NO: 34257 - protein, 8 aa, Artificial Sequence
  Description of Artificial Sequence: Synthetic peptide
  XENP024208 vhCDR3
DYYGSSPY

SEQ ID NO: 34258 - protein, 16 aa, Artificial Sequence
  Description of Artificial Sequence: Synthetic peptide
  XENP024208 vlCDR1
KSSQSIVHSNGNTYLE

SEQ ID NO: 34259 - protein, 7 aa, Artificial Sequence
  Description of Artificial Sequence: Synthetic peptide
  XENP024208 vlCDR2
KVSNRFS

SEQ ID NO: 34260 - protein, 9 aa, Artificial Sequence
  Description of Artificial Sequence: Synthetic peptide
  XENP024208 vlCDR3
FQGSHVPNT

SEQ ID NO: 34261 - protein, 251 aa, Artificial Sequence
  Description of Artificial Sequence: Synthetic polypeptide
  XENP024209 1C11_H3_L3.125_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIKGS

SEQ ID NO: 34262 - protein, 117 aa, Artificial Sequence; identical to SEQ ID NO: 33034
  Description of Artificial Sequence: Synthetic polypeptide
  VH of XENP024209

SEQ ID NO: 34263 - protein, 114 aa, Artificial Sequence
  Description of Artificial Sequence: Synthetic polypeptide
  VL of XENP024209
DVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIKGS

SEQ ID NO: 34264 - protein, 5 aa, Artificial Sequence
  Description of Artificial Sequence: Synthetic peptide
  XENP024209 vhCDR1
HYGMN

SEQ ID NO: 34265 - protein, 17 aa, Artificial Sequence
  Description of Artificial Sequence: Synthetic peptide
  XENP024209 vhCDR2
WINTYTGEPTYADGFTG

SEQ ID NO: 34266 - protein, 8 aa, Artificial Sequence
  Description of Artificial Sequence: Synthetic peptide
  XENP024209 vhCDR3
DYYGSSPY

SEQ ID NO: 34267 - protein, 16 aa, Artificial Sequence
  Description of Artificial Sequence: Synthetic peptide
  XENP024209 vlCDR1
KSSQSIVHSNGNTYLE

SEQ ID NO: 34268 - protein, 7 aa, Artificial Sequence
  Description of Artificial Sequence: Synthetic peptide
  XENP024209 vlCDR2
KVSNRFS

SEQ ID NO: 34269 - protein, 9 aa, Artificial Sequence
  Description of Artificial Sequence: Synthetic peptide
  XENP024209 vlCDR3
FQGSHVPNT

SEQ ID NO: 34270 - protein, 251 aa, Artificial Sequence
  Description of Artificial Sequence: Synthetic polypeptide
  XENP024210 1C11_H3_L3.132_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGPGTKVEIKGS

SEQ ID NO: 34271 - protein, 117 aa, Artificial Sequence; identical to SEQ ID NO: 33034
  Description of Artificial Sequence: Synthetic polypeptide
  VH of XENP024210

SEQ ID NO: 34272 - protein, 114 aa, Artificial Sequence
  Description of Artificial Sequence: Synthetic polypeptide
  VL of XENP024210
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGPGTKVEIKGS

SEQ ID NO: 34273 - protein, 5 aa, Artificial Sequence
  Description of Artificial Sequence: Synthetic peptide
  XENP024210 vhCDR1
HYGMN

SEQ ID NO: 34274 - protein, 17 aa, Artificial Sequence
  Description of Artificial Sequence: Synthetic peptide
  XENP024210 vhCDR2
WINTYTGEPTYADGFTG

SEQ ID NO: 34275 - protein, 8 aa, Artificial Sequence
  Description of Artificial Sequence: Synthetic peptide
  XENP024210 vhCDR3
DYYGSSPY

SEQ ID NO: 34276 - protein, 16 aa, Artificial Sequence
  Description of Artificial Sequence: Synthetic peptide
  XENP024210 vlCDR1
KSSQSIVHSNGNTYLE

SEQ ID NO: 34277 - protein, 7 aa, Artificial Sequence
  Description of Artificial Sequence: Synthetic peptide
  XENP024210 vlCDR2
KVSNRFS

SEQ ID NO: 34278 - protein, 9 aa, Artificial Sequence
  Description of Artificial Sequence: Synthetic peptide
  XENP024210 vlCDR3
FQGSHVPNT

SEQ ID NO: 34279 - protein, 251 aa, Artificial Sequence
  Description of Artificial Sequence: Synthetic polypeptide
  XENP024211 1C11_H3.78_L3_scFv
QIQLVQSGPELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34280 - protein, 117 aa, Artificial Sequence
  Description of Artificial Sequence: Synthetic polypeptide
  VH of XENP024211
QIQLVQSGPELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSS

SEQ ID NO: 34281 - protein, 114 aa, Artificial Sequence; identical to SEQ ID NO: 33651
  Description of Artificial Sequence: Synthetic polypeptide
  VL of XENP024211

SEQ ID NO: 34282 - protein, 5 aa, Artificial Sequence
  Description of Artificial Sequence: Synthetic peptide
  XENP024211 vhCDR1
HYGMN

SEQ ID NO: 34283 - protein, 17 aa, Artificial Sequence
  Description of Artificial Sequence: Synthetic peptide
  XENP024211 vhCDR2
WINTNTGEPTYADGFTG

SEQ ID NO: 34284 - protein, 8 aa, Artificial Sequence
  Description of Artificial Sequence: Synthetic peptide
  XENP024211 vhCDR3
DYYGSSPY

SEQ ID NO: 34285 - protein, 16 aa, Artificial Sequence
  Description of Artificial Sequence: Synthetic peptide
  XENP024211 vlCDR1
KSSQSIVHSNGNTYLE

SEQ ID NO: 34286 - protein, 7 aa, Artificial Sequence
  Description of Artificial Sequence: Synthetic peptide
  XENP024211 vlCDR2
KVSNRFS

SEQ ID NO: 34287 - protein, 9 aa, Artificial Sequence
  Description of Artificial Sequence: Synthetic peptide
  XENP024211 vlCDR3
FQGSHVPNT

SEQ ID NO: 34288 - protein, 251 aa, Artificial Sequence
  Description of Artificial Sequence: Synthetic polypeptide
  XENP024212 1C11_H3.80_L3_scFv
QIQLVQSGSELKKPGASVKVSCKASGYTFTHYGMNWVRQAPGQGLEWMGWINTNTGEPTYADGFTGRFVFSVDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34289 - protein, 117 aa, Artificial Sequence
  Description of Artificial Sequence: Synthetic polypeptide
  VH of XENP024212
QIQLVQSGSELKKPGASVKVSCKASGYTFTHYGMNWVRQAPGQGLEWMGWINTNTGEPTYADGFTGRFVFSVDTSQSTAYLQISSLKAEDTAVYYCARDYYGSSPYWGQGTLVTVSS

SEQ ID NO: 34290 - protein, 114 aa, Artificial Sequence; identical to SEQ ID NO: 33651
  Description of Artificial Sequence: Synthetic polypeptide
  VL of XENP024212

SEQ ID NO: 34291 - protein, 5 aa, Artificial Sequence
  Description of Artificial Sequence: Synthetic peptide
  XENP024212 vhCDR1
HYGMN

SEQ ID NO: 34292 - protein, 17 aa, Artificial Sequence
  Description of Artificial Sequence: Synthetic peptide
  XENP024212 vhCDR2
WINTNTGEPTYADGFTG

SEQ ID NO: 34293 - protein, 8 aa, Artificial Sequence
  Description of Artificial Sequence: Synthetic peptide
  XENP024212 vhCDR3
DYYGSSPY

SEQ ID NO: 34294 - protein, 16 aa, Artificial Sequence
  Description of Artificial Sequence: Synthetic peptide
  XENP024212 vlCDR1
KSSQSIVHSNGNTYLE

SEQ ID NO: 34295 - protein, 7 aa, Artificial Sequence
  Description of Artificial Sequence: Synthetic peptide
  XENP024212 vlCDR2
KVSNRFS

SEQ ID NO: 34296 - protein, 9 aa, Artificial Sequence
  Description of Artificial Sequence: Synthetic peptide
  XENP024212 vlCDR3
FQGSHVPNT

SEQ ID NO: 34297 - protein, 251 aa, Artificial Sequence
  Description of Artificial Sequence: Synthetic polypeptide
  XENP024213 1C11_H3.81_L3_scFv
QIQLVQSGSELKKPGASVKVSCKASGYTFTHYGMNWVRQAPGQGLEWMGWINTYTGEPTYADKFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34298 - protein, 117 aa, Artificial Sequence
  Description of Artificial Sequence: Synthetic polypeptide
  VH of XENP024213
QIQLVQSGSELKKPGASVKVSCKASGYTFTHYGMNWVRQAPGQGLEWMGWINTYTGEPTYADKFKGRFVFSLDTSVSTAYLQISSLKAEDTAVYFCARDYYGSSPYWGQGTLVTVSS

SEQ ID NO: 34299 - protein, 114 aa, Artificial Sequence; identical to SEQ ID NO: 33651
  Description of Artificial Sequence: Synthetic polypeptide
  VL of XENP024213

SEQ ID NO: 34300 - protein, 5 aa, Artificial Sequence
  Description of Artificial Sequence: Synthetic peptide
  XENP024213 vhCDR1
HYGMN

SEQ ID NO: 34301 - protein, 17 aa, Artificial Sequence
  Description of Artificial Sequence: Synthetic peptide
  XENP024213 vhCDR2
WINTYTGEPTYADKFKG

SEQ ID NO: 34302 - protein, 8 aa, Artificial Sequence
  Description of Artificial Sequence: Synthetic peptide
  XENP024213 vhCDR3
DYYGSSPY

SEQ ID NO: 34303 - protein, 16 aa, Artificial Sequence
  Description of Artificial Sequence: Synthetic peptide
  XENP024213 vlCDR1
KSSQSIVHSNGNTYLE

SEQ ID NO: 34304 - protein, 7 aa, Artificial Sequence
  Description of Artificial Sequence: Synthetic peptide
  XENP024213 vlCDR2
KVSNRFS

SEQ ID NO: 34305 - protein, 9 aa, Artificial Sequence
  Description of Artificial Sequence: Synthetic peptide
  XENP024213 vlCDR3
FQGSHVPNT

SEQ ID NO: 34306 - protein, 251 aa, Artificial Sequence
  Description of Artificial Sequence: Synthetic polypeptide
  XENP024214 1C11_H3.82_L3_scFv
QIQLVQSGSELKKPGASVKVSCKASGYTFTHYGMNWVRQAPGQGLEWMGWINTYTGEPTYADKFQGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34307 - protein, 117 aa, Artificial Sequence
  Description of Artificial Sequence: Synthetic polypeptide
  VH of XENP024214
QIQLVQSGSELKKPGASVKVSCKASGYTFTHYGMNWVRQAPGQGLEWMGWINTYTGEPTYADKFQGRFVFSLDTSVSTAYLQISSLKAEDTAVYFCARDYYGSSPYWGQGTLVTVSS

SEQ ID NO: 34308 - protein, 114 aa, Artificial Sequence; identical to SEQ ID NO: 33651
  Description of Artificial Sequence: Synthetic polypeptide
  VL of XENP024214

SEQ ID NO: 34309 - protein, 5 aa, Artificial Sequence
  Description of Artificial Sequence: Synthetic peptide
  XENP024214 vhCDR1
HYGMN

SEQ ID NO: 34310 - protein, 17 aa, Artificial Sequence
  Description of Artificial Sequence: Synthetic peptide
  XENP024214 vhCDR2
WINTYTGEPTYADKFQG

SEQ ID NO: 34311 - protein, 8 aa, Artificial Sequence
  Description of Artificial Sequence: Synthetic peptide
  XENP024214 vhCDR3
DYYGSSPY

SEQ ID NO: 34312 - protein, 16 aa, Artificial Sequence
  Description of Artificial Sequence: Synthetic peptide
  XENP024214 vlCDR1
KSSQSIVHSNGNTYLE

SEQ ID NO: 34313 - protein, 7 aa, Artificial Sequence
  Description of Artificial Sequence: Synthetic peptide
  XENP024214 vlCDR2
KVSNRFS

SEQ ID NO: 34314 - protein, 9 aa, Artificial Sequence
  Description of Artificial Sequence: Synthetic peptide
  XENP024214 vlCDR3
FQGSHVPNT

SEQ ID NO: 34315 - protein, 251 aa, Artificial Sequence
  Description of Artificial Sequence: Synthetic polypeptide
  XENP024215 1C11_H3.83_L3_scFv
QIQLVQSGSELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34316 - protein, 117 aa, Artificial Sequence
  Description of Artificial Sequence: Synthetic polypeptide
  VH of XENP024215
QIQLVQSGSELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSS

SEQ ID NO: 34317 - protein, 114 aa, Artificial Sequence; identical to SEQ ID NO: 33651
  Description of Artificial Sequence: Synthetic polypeptide
  VL of XENP024215

SEQ ID NO: 34318 - protein, 5 aa, Artificial Sequence
  Description of Artificial Sequence: Synthetic peptide
  XENP024215 vhCDR1
HYGMN

SEQ ID NO: 34319 - protein, 17 aa, Artificial Sequence
  Description of Artificial Sequence: Synthetic peptide
  XENP024215 vhCDR2
WINTNTGEPTYADGFTG

SEQ ID NO: 34320 - protein, 8 aa, Artificial Sequence
  Description of Artificial Sequence: Synthetic peptide
  XENP024215 vhCDR3
DYYGSSPY

SEQ ID NO: 34321 - protein, 16 aa, Artificial Sequence
  Description of Artificial Sequence: Synthetic peptide
  XENP024215 vlCDR1
KSSQSIVHSNGNTYLE

SEQ ID NO: 34322 - protein, 7 aa, Artificial Sequence
  Description of Artificial Sequence: Synthetic peptide
  XENP024215 vlCDR2
KVSNRFS

SEQ ID NO: 34323 - protein, 9 aa, Artificial Sequence
  Description of Artificial Sequence: Synthetic peptide
  XENP024215 vlCDR3
FQGSHVPNT

SEQ ID NO: 34324 - protein, 251 aa, Artificial Sequence
  Description of Artificial Sequence: Synthetic polypeptide
  XENP024216 1C11_H3.84_L3_scFv
QIQLVQSGSELKKPGASVKVSCKASGYTFTHYGMNWVRQAPGQGLEWMGWINTYTGEPTYADKFKGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34325 - protein, 117 aa, Artificial Sequence
  Description of Artificial Sequence: Synthetic polypeptide
  VH of XENP024216
QIQLVQSGSELKKPGASVKVSCKASGYTFTHYGMNWVRQAPGQGLEWMGWINTYTGEPTYADKFKGRFVFSLDTSQSTAYLQISSLKAEDTAVYFCARDYYGSSPYWGQGTLVTVSS

SEQ ID NO: 34326 - protein, 114 aa, Artificial Sequence; identical to SEQ ID NO: 33651
  Description of Artificial Sequence: Synthetic polypeptide
  VL of XENP024216

SEQ ID NO: 34327 - protein, 5 aa, Artificial Sequence
  Description of Artificial Sequence: Synthetic peptide
  XENP024216 vhCDR1
HYGMN

SEQ ID NO: 34328 - protein, 17 aa, Artificial Sequence
  Description of Artificial Sequence: Synthetic peptide
  XENP024216 vhCDR2
WINTYTGEPTYADKFKG

SEQ ID NO: 34329 - protein, 8 aa, Artificial Sequence
  Description of Artificial Sequence: Synthetic peptide
  XENP024216 vhCDR3
DYYGSSPY

SEQ ID NO: 34330 - protein, 16 aa, Artificial Sequence
  Description of Artificial Sequence: Synthetic peptide
  XENP024216 vlCDR1
KSSQSIVHSNGNTYLE

SEQ ID NO: 34331 - protein, 7 aa, Artificial Sequence
  Description of Artificial Sequence: Synthetic peptide
  XENP024216 vlCDR2
KVSNRFS

SEQ ID NO: 34332 - protein, 9 aa, Artificial Sequence
  Description of Artificial Sequence: Synthetic peptide
  XENP024216 vlCDR3
FQGSHVPNT

SEQ ID NO: 34333 - protein, 251 aa, Artificial Sequence
  Description of Artificial Sequence: Synthetic polypeptide
  XENP024217 1C11_H3.85_L3_scFv
QIQLVQSGSELKKPGASVKVSCKASGYTFTHYGMNWVRQAPGQGLEWMGWINTYTGEPTYADKFQGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34334 - protein, 117 aa, Artificial Sequence
  Description of Artificial Sequence: Synthetic polypeptide
  VH of XENP024217
QIQLVQSGSELKKPGASVKVSCKASGYTFTHYGMNWVRQAPGQGLEWMGWINTYTGEPTYADKFQGRFVFSLDTSQSTAYLQISSLKAEDTAVYFCARDYYGSSPYWGQGTLVTVSS

SEQ ID NO: 34335 - protein, 114 aa, Artificial Sequence; identical to SEQ ID NO: 33651
  Description of Artificial Sequence: Synthetic polypeptide
  VL of XENP024217

SEQ ID NO: 34336 - protein, 5 aa, Artificial Sequence
  Description of Artificial Sequence: Synthetic peptide
  XENP024217 vhCDR1
HYGMN

SEQ ID NO: 34337 - protein, 17 aa, Artificial Sequence
  Description of Artificial Sequence: Synthetic peptide
  XENP024217 vhCDR2
WINTYTGEPTYADKFQG

SEQ ID NO: 34338 - protein, 8 aa, Artificial Sequence
  Description of Artificial Sequence: Synthetic peptide
  XENP024217 vhCDR3
DYYGSSPY

SEQ ID NO: 34339 - protein, 16 aa, Artificial Sequence
  Description of Artificial Sequence: Synthetic peptide
  XENP024217 vlCDR1
KSSQSIVHSNGNTYLE

SEQ ID NO: 34340 - protein, 7 aa, Artificial Sequence
  Description of Artificial Sequence: Synthetic peptide
  XENP024217 vlCDR2
KVSNRFS

SEQ ID NO: 34341 - protein, 9 aa, Artificial Sequence
  Description of Artificial Sequence: Synthetic peptide
  XENP024217 vlCDR3
FQGSHVPNT

SEQ ID NO: 34342 - protein, 251 aa, Artificial Sequence
  Description of Artificial Sequence: Synthetic polypeptide
  XENP024218 1C11_H3.86_L3_scFv
EIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34343 - protein, 117 aa, Artificial Sequence
  Description of Artificial Sequence: Synthetic polypeptide
  VH of XENP024218
EIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34344 - protein, 114 aa, Artificial Sequence; identical to SEQ ID NO: 33651
  Description of Artificial Sequence: Synthetic polypeptide
  VL of XENP024218

SEQ ID NO: 34345 - protein, 5 aa, Artificial Sequence
  Description of Artificial Sequence: Synthetic peptide
  XENP024218 vhCDR1
HYGMN

SEQ ID NO: 34346 - protein, 17 aa, Artificial Sequence
  Description of Artificial Sequence: Synthetic peptide
  XENP024218 vhCDR2
WINTYTGEPTYADGFTG

SEQ ID NO: 34347 - protein, 8 aa, Artificial Sequence
  Description of Artificial Sequence: Synthetic peptide
  XENP024218 vhCDR3
DYYGSSPY

SEQ ID NO: 34348 - protein, 16 aa, Artificial Sequence
  Description of Artificial Sequence: Synthetic peptide
  XENP024218 vlCDR1
KSSQSIVHSNGNTYLE

SEQ ID NO: 34349 - protein, 7 aa, Artificial Sequence
  Description of Artificial Sequence: Synthetic peptide
  XENP024218 vlCDR2
KVSNRFS

SEQ ID NO: 34350 - protein, 9 aa, Artificial Sequence
  Description of Artificial Sequence: Synthetic peptide
  XENP024218 vlCDR3
FQGSHVPNT

SEQ ID NO: 34351 - protein, 251 aa, Artificial Sequence
  Description of Artificial Sequence: Synthetic polypeptide
  XENP024219 1C11_H3.88_L3_scFv
QIQLVESGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34352 - protein, 117 aa, Artificial Sequence
  Description of Artificial Sequence: Synthetic polypeptide
  VH of XENP024219
QIQLVESGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34353 - protein, 114 aa, Artificial Sequence; identical to SEQ ID NO: 33651
  Description of Artificial Sequence: Synthetic polypeptide
  VL of XENP024219

SEQ ID NO: 34354 - protein, 5 aa, Artificial Sequence
  Description of Artificial Sequence: Synthetic peptide
  XENP024219 vhCDR1
HYGMN

SEQ ID NO: 34355 - protein, 17 aa, Artificial Sequence
  Description of Artificial Sequence: Synthetic peptide
  XENP024219 vhCDR2
WINTYTGEPTYADGFTG

SEQ ID NO: 34356 - protein, 8 aa, Artificial Sequence
  Description of Artificial Sequence: Synthetic peptide
  XENP024219 vhCDR3
DYYGSSPY

SEQ ID NO: 34357 - protein, 16 aa, Artificial Sequence
  Description of Artificial Sequence: Synthetic peptide
  XENP024219 vlCDR1
KSSQSIVHSNGNTYLE

SEQ ID NO: 34358 - protein, 7 aa, Artificial Sequence
  Description of Artificial Sequence: Synthetic peptide
  XENP024219 vlCDR2
KVSNRFS

SEQ ID NO: 34359 - protein, 9 aa, Artificial Sequence
  Description of Artificial Sequence: Synthetic peptide
  XENP024219 vlCDR3
FQGSHVPNT

SEQ ID NO: 34360 - protein, 251 aa, Artificial Sequence
  Description of Artificial Sequence: Synthetic polypeptide
  XENP024220 1C11_H3.89_L3_scFv
QIQLVQSGSGLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34361 - protein, 117 aa, Artificial Sequence
  Description of Artificial Sequence: Synthetic polypeptide
  VH of XENP024220
QIQLVQSGSGLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34362 - protein, 114 aa, Artificial Sequence; identical to SEQ ID NO: 33651
  Description of Artificial Sequence: Synthetic polypeptide
  VL of XENP024220

SEQ ID NO: 34363 - protein, 5 aa, Artificial Sequence
  Description of Artificial Sequence: Synthetic peptide
  XENP024220 vhCDR1
HYGMN

SEQ ID NO: 34364 - protein, 17 aa, Artificial Sequence
  Description of Artificial Sequence: Synthetic peptide
  XENP024220 vhCDR2
WINTYTGEPTYADGFTG

SEQ ID NO: 34365 - protein, 8 aa, Artificial Sequence
  Description of Artificial Sequence: Synthetic peptide
  XENP024220 vhCDR3
DYYGSSPY

SEQ ID NO: 34366 - protein, 16 aa, Artificial Sequence
  Description of Artificial Sequence: Synthetic peptide
  XENP024220 vlCDR1
KSSQSIVHSNGNTYLE

SEQ ID NO: 34367 - protein, 7 aa, Artificial Sequence
  Description of Artificial Sequence: Synthetic peptide
  XENP024220 vlCDR2
KVSNRFS

SEQ ID NO: 34368 - protein, 9 aa, Artificial Sequence
  Description of Artificial Sequence: Synthetic peptide
  XENP024220 vlCDR3
FQGSHVPNT

SEQ ID NO: 34369 - protein, 251 aa, Artificial Sequence
  Description of Artificial Sequence: Synthetic polypeptide
  XENP024221 1C11_H3.90_L3_scFv
QIQLVQSGSVLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34370 - protein, 117 aa, Artificial Sequence
  Description of Artificial Sequence: Synthetic polypeptide
  VH of XENP024221
QIQLVQSGSVLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34371 - protein, 114 aa, Artificial Sequence; identical to SEQ ID NO: 33651
  Description of Artificial Sequence: Synthetic polypeptide
  VL of XENP024221

SEQ ID NO: 34372 - protein, 5 aa, Artificial Sequence
  Description of Artificial Sequence: Synthetic peptide
  XENP024221 vhCDR1
HYGMN

SEQ ID NO: 34373 - protein, 17 aa, Artificial Sequence
  Description of Artificial Sequence: Synthetic peptide
  XENP024221 vhCDR2
WINTYTGEPTYADGFTG

SEQ ID NO: 34374 - protein, 8 aa, Artificial Sequence
  Description of Artificial Sequence: Synthetic peptide
  XENP024221 vhCDR3
DYYGSSPY

SEQ ID NO: 34375 - protein, 16 aa, Artificial Sequence
  Description of Artificial Sequence: Synthetic peptide
  XENP024221 vlCDR1
KSSQSIVHSNGNTYLE

SEQ ID NO: 34376 - protein, 7 aa, Artificial Sequence
  Description of Artificial Sequence: Synthetic peptide
  XENP024221 vlCDR2
KVSNRFS

SEQ ID NO: 34377 - protein, 9 aa, Artificial Sequence
  Description of Artificial Sequence: Synthetic peptide
  XENP024221 vlCDR3
FQGSHVPNT

SEQ ID NO: 34378 - protein, 251 aa, Artificial Sequence
  Description of Artificial Sequence: Synthetic polypeptide
  XENP024222 1C11_H3.91_L3_scFv
QIQLVQSGSELVKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34379 - protein, 117 aa, Artificial Sequence
  Description of Artificial Sequence: Synthetic polypeptide
  VH of XENP024222
QIQLVQSGSELVKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34380 - protein, 114 aa, Artificial Sequence; identical to SEQ ID NO: 33651
  Description of Artificial Sequence: Synthetic polypeptide
  VL of XENP024222

SEQ ID NO: 34381 - protein, 5 aa, Artificial Sequence
  Description of Artificial Sequence: Synthetic peptide
  XENP024222 vhCDR1
HYGMN

SEQ ID NO: 34382 - protein, 17 aa, Artificial Sequence
  Description of Artificial Sequence: Synthetic peptide
  XENP024222 vhCDR2
WINTYTGEPTYADGFTG

SEQ ID NO: 34383 - protein, 8 aa, Artificial Sequence
  Description of Artificial Sequence: Synthetic peptide
  XENP024222 vhCDR3
DYYGSSPY

SEQ ID NO: 34384 - protein, 16 aa, Artificial Sequence
  Description of Artificial Sequence: Synthetic peptide
  XENP024222 vlCDR1
KSSQSIVHSNGNTYLE

SEQ ID NO: 34385 - protein, 7 aa, Artificial Sequence
  Description of Artificial Sequence: Synthetic peptide
  XENP024222 vlCDR2
KVSNRFS

SEQ ID NO: 34386 - protein, 9 aa, Artificial Sequence
  Description of Artificial Sequence: Synthetic peptide
  XENP024222 vlCDR3
FQGSHVPNT

SEQ ID NO: 34387 - protein, 251 aa, Artificial Sequence
  Description of Artificial Sequence: Synthetic polypeptide
  XENP024223 1C11_H3.92_L3_scFv
QIQLVQSGSELKQPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34388 - protein, 117 aa, Artificial Sequence
  Description of Artificial Sequence: Synthetic polypeptide
  VH of XENP024223
QIQLVQSGSELKQPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34389 - protein, 114 aa, Artificial Sequence; identical to SEQ ID NO: 33651
  Description of Artificial Sequence: Synthetic polypeptide
  VL of XENP024223

SEQ ID NO: 34390 - protein, 5 aa, Artificial Sequence
  Description of Artificial Sequence: Synthetic peptide
  XENP024223 vhCDR1
HYGMN

SEQ ID NO: 34391 - protein, 17 aa, Artificial Sequence
  Description of Artificial Sequence: Synthetic peptide
  XENP024223 vhCDR2
WINTYTGEPTYADGFTG

SEQ ID NO: 34392 - protein, 8 aa, Artificial Sequence
  Description of Artificial Sequence: Synthetic peptide
  XENP024223 vhCDR3
DYYGSSPY

SEQ ID NO: 34393 - protein, 16 aa, Artificial Sequence
  Description of Artificial Sequence: Synthetic peptide
  XENP024223 vlCDR1
KSSQSIVHSNGNTYLE

SEQ ID NO: 34394 - protein, 7 aa, Artificial Sequence
  Description of Artificial Sequence: Synthetic peptide
  XENP024223 vlCDR2
KVSNRFS

SEQ ID NO: 34395 - protein, 9 aa, Artificial Sequence
  Description of Artificial Sequence: Synthetic peptide
  XENP024223 vlCDR3
FQGSHVPNT

SEQ ID NO: 34396 - protein, 251 aa, Artificial Sequence
  Description of Artificial Sequence: Synthetic polypeptide
  XENP024224 1C11_H3.93_L3_scFv
QIQLVQSGSELKKPSASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34397 - protein, 117 aa, Artificial Sequence
  Description of Artificial Sequence: Synthetic polypeptide
  VH of XENP024224
QIQLVQSGSELKKPSASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34398 - protein, 114 aa, Artificial Sequence; identical to SEQ ID NO: 33651
  Description of Artificial Sequence: Synthetic polypeptide
  VL of XENP024224

SEQ ID NO: 34399 - protein, 5 aa, Artificial Sequence
  Description of Artificial Sequence: Synthetic peptide
  XENP024224 vhCDR1
HYGMN

SEQ ID NO: 34400 - protein, 17 aa, Artificial Sequence
  Description of Artificial Sequence: Synthetic peptide
  XENP024224 vhCDR2
WINTYTGEPTYADGFTG

SEQ ID NO: 34401 - protein, 8 aa, Artificial Sequence
  Description of Artificial Sequence: Synthetic peptide
  XENP024224 vhCDR3
DYYGSSPY

SEQ ID NO: 34402 - protein, 16 aa, Artificial Sequence
  Description of Artificial Sequence: Synthetic peptide
  XENP024224 vlCDR1
KSSQSIVHSNGNTYLE

SEQ ID NO: 34403 - protein, 7 aa, Artificial Sequence
  Description of Artificial Sequence: Synthetic peptide
  XENP024224 vlCDR2
KVSNRFS

SEQ ID NO: 34404 - protein, 9 aa, Artificial Sequence
  Description of Artificial Sequence: Synthetic peptide
  XENP024224 vlCDR3
FQGSHVPNT

SEQ ID NO: 34405 - protein, 251 aa, Artificial Sequence
  Description of Artificial Sequence: Synthetic polypeptide
  XENP024225 1C11_H3.94_L3_scFv
QIQLVQSGSELKKPTASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34406 - protein, 117 aa, Artificial Sequence
  Description of Artificial Sequence: Synthetic polypeptide
  VH of XENP024225
QIQLVQSGSELKKPTASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34407 - protein, 114 aa, Artificial Sequence; identical to SEQ ID NO: 33651
  Description of Artificial Sequence: Synthetic polypeptide
  VL of XENP024225

SEQ ID NO: 34408 - protein, 5 aa, Artificial Sequence
  Description of Artificial Sequence: Synthetic peptide
  XENP024225 vhCDR1
HYGMN

SEQ ID NO: 34409 - protein, 17 aa, Artificial Sequence
  Description of Artificial Sequence: Synthetic peptide
  XENP024225 vhCDR2
WINTYTGEPTYADGFTG

SEQ ID NO: 34410 - protein, 8 aa, Artificial Sequence
  Description of Artificial Sequence: Synthetic peptide
  XENP024225 vhCDR3
DYYGSSPY

SEQ ID NO: 34411 - protein, 16 aa, Artificial Sequence
  Description of Artificial Sequence: Synthetic peptide
  XENP024225 vlCDR1
KSSQSIVHSNGNTYLE

SEQ ID NO: 34412 - protein, 7 aa, Artificial Sequence
  Description of Artificial Sequence: Synthetic peptide
  XENP024225 vlCDR2
KVSNRFS

SEQ ID NO: 34413 - protein, 9 aa, Artificial Sequence
  Description of Artificial Sequence: Synthetic peptide
  XENP024225 vlCDR3
FQGSHVPNT

SEQ ID NO: 34414 - protein, 251 aa, Artificial Sequence
  Description of Artificial Sequence: Synthetic polypeptide
  XENP024226 1C11_H3.95_L3_scFv
QIQLVQSGSELKKPGGSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34415 - protein, 117 aa, Artificial Sequence
  Description of Artificial Sequence: Synthetic polypeptide
  VH of XENP024226
QIQLVQSGSELKKPGGSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34416 - protein, 114 aa, Artificial Sequence; identical to SEQ ID NO: 33651
  Description of Artificial Sequence: Synthetic polypeptide
  VL of XENP024226

SEQ ID NO: 34417 - protein, 5 aa, Artificial Sequence
  Description of Artificial Sequence: Synthetic peptide
  XENP024226 vhCDR1
HYGMN

SEQ ID NO: 34418 - protein, 17 aa, Artificial Sequence
  Description of Artificial Sequence: Synthetic peptide
  XENP024226 vhCDR2
WINTYTGEPTYADGFTG

SEQ ID NO: 34419 - protein, 8 aa, Artificial Sequence
  Description of Artificial Sequence: Synthetic peptide
  XENP024226 vhCDR3
DYYGSSPY

SEQ ID NO: 34420 - protein, 16 aa, Artificial Sequence
  Description of Artificial Sequence: Synthetic peptide
  XENP024226 vlCDR1
KSSQSIVHSNGNTYLE

SEQ ID NO: 34421 - protein, 7 aa, Artificial Sequence
  Description of Artificial Sequence: Synthetic peptide
  XENP024226 vlCDR2
KVSNRFS

SEQ ID NO: 34422 - protein, 9 aa, Artificial Sequence
  Description of Artificial Sequence: Synthetic peptide
  XENP024226 vlCDR3
FQGSHVPNT

SEQ ID NO: 34423 - protein, 251 aa, Artificial Sequence
  Description of Artificial Sequence: Synthetic polypeptide
  XENP024227 1C11_H3.96_L3_scFv
QIQLVQSGSELKKPGQSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34424 - protein, 117 aa, Artificial Sequence
  Description of Artificial Sequence: Synthetic polypeptide
  VH of XENP024227
QIQLVQSGSELKKPGQSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34425 - protein, 114 aa, Artificial Sequence; identical to SEQ ID NO: 33651
  Description of Artificial Sequence: Synthetic polypeptide
  VL of XENP024227

SEQ ID NO: 34426 - protein, 5 aa, Artificial Sequence
  Description of Artificial Sequence: Synthetic peptide
  XENP024227 vhCDR1
HYGMN

SEQ ID NO: 34427 - protein, 17 aa, Artificial Sequence
  Description of Artificial Sequence: Synthetic peptide
  XENP024227 vhCDR2
WINTYTGEPTYADGFTG

SEQ ID NO: 34428 - protein, 8 aa, Artificial Sequence
  Description of Artificial Sequence: Synthetic peptide
  XENP024227 vhCDR3
DYYGSSPY

SEQ ID NO: 34429 - protein, 16 aa, Artificial Sequence
  Description of Artificial Sequence: Synthetic peptide
  XENP024227 vlCDR1
KSSQSIVHSNGNTYLE

SEQ ID NO: 34430 - protein, 7 aa, Artificial Sequence
  Description of Artificial Sequence: Synthetic peptide
  XENP024227 vlCDR2
KVSNRFS

SEQ ID NO: 34431 - protein, 9 aa, Artificial Sequence
  Description of Artificial Sequence: Synthetic peptide
  XENP024227 vlCDR3
FQGSHVPNT

SEQ ID NO: 34432 - protein, 251 aa, Artificial Sequence
  Description of Artificial Sequence: Synthetic polypeptide
  XENP024228 1C11_H3.97_L3_scFv
QIQLVQSGSELKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34433 - protein, 117 aa, Artificial Sequence
  Description of Artificial Sequence: Synthetic polypeptide
  VH of XENP024228
QIQLVQSGSELKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34434 - protein, 114 aa, Artificial Sequence; identical to SEQ ID NO: 33651
  Description of Artificial Sequence: Synthetic polypeptide
  VL of XENP024228

SEQ ID NO: 34435 - protein, 5 aa, Artificial Sequence
  Description of Artificial Sequence: Synthetic peptide
  XENP024228 vhCDR1
HYGMN

SEQ ID NO: 34436 - protein, 17 aa, Artificial Sequence
  Description of Artificial Sequence: Synthetic peptide
  XENP024228 vhCDR2
WINTYTGEPTYADGFTG

SEQ ID NO: 34437 - protein, 8 aa, Artificial Sequence
  Description of Artificial Sequence: Synthetic peptide
  XENP024228 vhCDR3
DYYGSSPY

SEQ ID NO: 34438 - protein, 16 aa, Artificial Sequence
  Description of Artificial Sequence: Synthetic peptide
  XENP024228 vlCDR1
KSSQSIVHSNGNTYLE

SEQ ID NO: 34439 - protein, 7 aa, Artificial Sequence
  Description of Artificial Sequence: Synthetic peptide
  XENP024228 vlCDR2
KVSNRFS

SEQ ID NO: 34440 - protein, 9 aa, Artificial Sequence
  Description of Artificial Sequence: Synthetic peptide
  XENP024228 vlCDR3
FQGSHVPNT

SEQ ID NO: 34441 - protein, 251 aa, Artificial Sequence
  Description of Artificial Sequence: Synthetic polypeptide
  XENP024229 1C11_H3.98_L3_scFv
QIQLVQSGSELKKPGRSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34442 - protein, 117 aa, Artificial Sequence
  Description of Artificial Sequence: Synthetic polypeptide
  VH of XENP024229
QIQLVQSGSELKKPGRSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34443 - protein, 114 aa, Artificial Sequence; identical to SEQ ID NO: 33651
  Description of Artificial Sequence: Synthetic polypeptide
  VL of XENP024229

SEQ ID NO: 34444 - protein, 5 aa, Artificial Sequence
  Description of Artificial Sequence: Synthetic peptide
  XENP024229 vhCDR1
HYGMN

SEQ ID NO: 34445 - protein, 17 aa, Artificial Sequence
  Description of Artificial Sequence: Synthetic peptide
  XENP024229 vhCDR2
WINTYTGEPTYADGFTG

SEQ ID NO: 34446 - protein, 8 aa, Artificial Sequence
  Description of Artificial Sequence: Synthetic peptide
  XENP024229 vhCDR3
DYYGSSPY

SEQ ID NO: 34447 - protein, 16 aa, Artificial Sequence
  Description of Artificial Sequence: Synthetic peptide
  XENP024229 vlCDR1
KSSQSIVHSNGNTYLE

SEQ ID NO: 34448 - protein, 7 aa, Artificial Sequence
  Description of Artificial Sequence: Synthetic peptide
  XENP024229 vlCDR2
KVSNRFS

SEQ ID NO: 34449 - protein, 9 aa, Artificial Sequence
  Description of Artificial Sequence: Synthetic peptide
  XENP024229 vlCDR3
FQGSHVPNT

SEQ ID NO: 34450 - protein, 251 aa, Artificial Sequence
  Description of Artificial Sequence: Synthetic polypeptide
  XENP024230 1C11_H3.99_L3_scFv
QIQLVQSGSELKKPGATVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34451 - protein, 117 aa, Artificial Sequence
  Description of Artificial Sequence: Synthetic polypeptide
  VH of XENP024230
QIQLVQSGSELKKPGATVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34452 - protein, 114 aa, Artificial Sequence; identical to SEQ ID NO: 33651
  Description of Artificial Sequence: Synthetic polypeptide
  VL of XENP024230

SEQ ID NO: 34453 - protein, 5 aa, Artificial Sequence
  Description of Artificial Sequence: Synthetic peptide
  XENP024230 vhCDR1
HYGMN

SEQ ID NO: 34454 - protein, 17 aa, Artificial Sequence
  Description of Artificial Sequence: Synthetic peptide
  XENP024230 vhCDR2
WINTYTGEPTYADGFTG

SEQ ID NO: 34455 - protein, 8 aa, Artificial Sequence
  Description of Artificial Sequence: Synthetic peptide
  XENP024230 vhCDR3
DYYGSSPY

SEQ ID NO: 34456 - protein, 16 aa, Artificial Sequence
  Description of Artificial Sequence: Synthetic peptide
  XENP024230 vlCDR1
KSSQSIVHSNGNTYLE

SEQ ID NO: 34457 - protein, 7 aa, Artificial Sequence
  Description of Artificial Sequence: Synthetic peptide
  XENP024230 vlCDR2
KVSNRFS

SEQ ID NO: 34458 - protein, 9 aa, Artificial Sequence
  Description of Artificial Sequence: Synthetic peptide
  XENP024230 vlCDR3
FQGSHVPNT

SEQ ID NO: 34459 - protein, 251 aa, Artificial Sequence
  Description of Artificial Sequence: Synthetic polypeptide
  XENP024231 1C11_H3.100_L3_scFv
QIQLVQSGSELKKPGASLKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34460 - protein, 117 aa, Artificial Sequence
  Description of Artificial Sequence: Synthetic polypeptide
  VH of XENP024231
QIQLVQSGSELKKPGASLKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34461 - protein, 114 aa, Artificial Sequence; identical to SEQ ID NO: 33651
  Description of Artificial Sequence: Synthetic polypeptide
  VL of XENP024231

SEQ ID NO: 34462 - protein, 5 aa, Artificial Sequence
  Description of Artificial Sequence: Synthetic peptide
  XENP024231 vhCDR1
HYGMN

SEQ ID NO: 34463 - protein, 17 aa, Artificial Sequence
  Description of Artificial Sequence: Synthetic peptide
  XENP024231 vhCDR2
WINTYTGEPTYADGFTG

SEQ ID NO: 34464 - protein, 8 aa, Artificial Sequence
  Description of Artificial Sequence: Synthetic peptide
  XENP024231 vhCDR3
DYYGSSPY

SEQ ID NO: 34465 - protein, 16 aa, Artificial Sequence
  Description of Artificial Sequence: Synthetic peptide
  XENP024231 vlCDR1
KSSQSIVHSNGNTYLE

SEQ ID NO: 34466 - protein, 7 aa, Artificial Sequence
  Description of Artificial Sequence: Synthetic peptide
  XENP024231 vlCDR2
KVSNRFS

SEQ ID NO: 34467 - protein, 9 aa, Artificial Sequence
  Description of Artificial Sequence: Synthetic peptide
  XENP024231 vlCDR3
FQGSHVPNT

SEQ ID NO: 34468 - protein, 251 aa, Artificial Sequence
  Description of Artificial Sequence: Synthetic polypeptide
  XENP024232 1C11_H3.101_L3_scFv
QIQLVQSGSELKKPGASVRVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34469 - protein, 117 aa, Artificial Sequence
  Description of Artificial Sequence: Synthetic polypeptide
  VH of XENP024232
QIQLVQSGSELKKPGASVRVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34470 - protein, 114 aa, Artificial Sequence; identical to SEQ ID NO: 33651
  Description of Artificial Sequence: Synthetic polypeptide
  VL of XENP024232

SEQ ID NO: 34471 - protein, 5 aa, Artificial Sequence
  Description of Artificial Sequence: Synthetic peptide
  XENP024232 vhCDR1
HYGMN

SEQ ID NO: 34472 - protein, 17 aa, Artificial Sequence
  Description of Artificial Sequence: Synthetic peptide
  XENP024232 vhCDR2
WINTYTGEPTYADGFTG

SEQ ID NO: 34473 - protein, 8 aa, Artificial Sequence
  Description of Artificial Sequence: Synthetic peptide
  XENP024232 vhCDR3
DYYGSSPY

SEQ ID NO: 34474 - protein, 16 aa, Artificial Sequence
  Description of Artificial Sequence: Synthetic peptide
  XENP024232 vlCDR1
KSSQSIVHSNGNTYLE

SEQ ID NO: 34475 - protein, 7 aa, Artificial Sequence
  Description of Artificial Sequence: Synthetic peptide
  XENP024232 vlCDR2
KVSNRFS

SEQ ID NO: 34476 - protein, 9 aa, Artificial Sequence
  Description of Artificial Sequence: Synthetic peptide
  XENP024232 vlCDR3
FQGSHVPNT

SEQ ID NO: 34477 - protein, 251 aa, Artificial Sequence
  Description of Artificial Sequence: Synthetic polypeptide
  XENP024233 1C11_H3.102_L3_scFv
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34478 - protein, 117 aa, Artificial Sequence
  Description of Artificial Sequence: Synthetic polypeptide
  VH of XENP024233
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34479 - protein, 114 aa, Artificial Sequence; identical to SEQ ID NO: 33651
  Description of Artificial Sequence: Synthetic polypeptide
  VL of XENP024233

SEQ ID NO: 34480 - protein, 5 aa, Artificial Sequence
  Description of Artificial Sequence: Synthetic peptide
  XENP024233 vhCDR1
HYGMN

SEQ ID NO: 34481 - protein, 17 aa, Artificial Sequence
  Description of Artificial Sequence: Synthetic peptide
  XENP024233 vhCDR2
WINTYTGEPTYADGFTG

SEQ ID NO: 34482 - protein, 8 aa, Artificial Sequence
  Description of Artificial Sequence: Synthetic peptide
  XENP024233 vhCDR3
DYYGSSPY

SEQ ID NO: 34483 - protein, 16 aa, Artificial Sequence
  Description of Artificial Sequence: Synthetic peptide
  XENP024233 vlCDR1
KSSQSIVHSNGNTYLE

SEQ ID NO: 34484 - protein, 7 aa, Artificial Sequence
  Description of Artificial Sequence: Synthetic peptide
  XENP024233 vlCDR2
KVSNRFS

SEQ ID NO: 34485 - protein, 9 aa, Artificial Sequence
  Description of Artificial Sequence: Synthetic peptide
  XENP024233 vlCDR3
FQGSHVPNT

SEQ ID NO: 34486 - protein, 251 aa, Artificial Sequence
  Description of Artificial Sequence: Synthetic polypeptide
  XENP024234 1C11_H3.103_L3_scFv
QIQLVQSGSELKKPGASVKVTCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34487 - protein, 117 aa, Artificial Sequence
  Description of Artificial Sequence: Synthetic polypeptide
  VH of XENP024234
QIQLVQSGSELKKPGASVKVTCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34488 - protein, 114 aa, Artificial Sequence; identical to SEQ ID NO: 33651
  Description of Artificial Sequence: Synthetic polypeptide
  VL of XENP024234

SEQ ID NO: 34489 - protein, 5 aa, Artificial Sequence
  Description of Artificial Sequence: Synthetic peptide
  XENP024234 vhCDR1
HYGMN

SEQ ID NO: 34490 - protein, 17 aa, Artificial Sequence
  Description of Artificial Sequence: Synthetic peptide
  XENP024234 vhCDR2
WINTYTGEPTYADGFTG

SEQ ID NO: 34491 - protein, 8 aa, Artificial Sequence
  Description of Artificial Sequence: Synthetic peptide
  XENP024234 vhCDR3
DYYGSSPY

SEQ ID NO: 34492 - protein, 16 aa, Artificial Sequence
  Description of Artificial Sequence: Synthetic peptide
  XENP024234 vlCDR1
KSSQSIVHSNGNTYLE

SEQ ID NO: 34493 - protein, 7 aa, Artificial Sequence
  Description of Artificial Sequence: Synthetic peptide
  XENP024234 vlCDR2
KVSNRFS

SEQ ID NO: 34494 - protein, 9 aa, Artificial Sequence
  Description of Artificial Sequence: Synthetic peptide
  XENP024234 vlCDR3
FQGSHVPNT

SEQ ID NO: 34495 - protein, 251 aa, Artificial Sequence
  Description of Artificial Sequence: Synthetic polypeptide
  XENP024235 1C11_H3.104_L3_scFv
QIQLVQSGSELKKPGASVKVSCAASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34496 - protein, 117 aa, Artificial Sequence
  Description of Artificial Sequence: Synthetic polypeptide
  VH of XENP024235
QIQLVQSGSELKKPGASVKVSCAASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34497 - protein, 114 aa, Artificial Sequence; identical to SEQ ID NO: 33651
  Description of Artificial Sequence: Synthetic polypeptide
  VL of XENP024235

SEQ ID NO: 34498 - protein, 5 aa, Artificial Sequence
  Description of Artificial Sequence: Synthetic peptide
  XENP024235 vhCDR1
HYGMN

SEQ ID NO: 34499 - protein, 17 aa, Artificial Sequence
  Description of Artificial Sequence: Synthetic peptide
  XENP024235 vhCDR2
WINTYTGEPTYADGFTG

SEQ ID NO: 34500 - protein, 8 aa, Artificial Sequence
  Description of Artificial Sequence: Synthetic peptide
  XENP024235 vhCDR3
DYYGSSPY

SEQ ID NO: 34501 - protein, 16 aa, Artificial Sequence
  Description of Artificial Sequence: Synthetic peptide
  XENP024235 vlCDR1
KSSQSIVHSNGNTYLE

SEQ ID NO: 34502 - protein, 7 aa, Artificial Sequence
  Description of Artificial Sequence: Synthetic peptide
  XENP024235 vlCDR2
KVSNRFS

SEQ ID NO: 34503 - protein, 9 aa, Artificial Sequence
  Description of Artificial Sequence: Synthetic peptide
  XENP024235 vlCDR3
FQGSHVPNT

SEQ ID NO: 34504 - protein, 251 aa, Artificial Sequence
  Description of Artificial Sequence: Synthetic polypeptide
  XENP024236 1C11_H3.105_L3_scFv
QIQLVQSGSELKKPGASVKVSCTASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34505 - protein, 117 aa, Artificial Sequence
  Description of Artificial Sequence: Synthetic polypeptide
  VH of XENP024236
QIQLVQSGSELKKPGASVKVSCTASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34506 - protein, 114 aa, Artificial Sequence; identical to SEQ ID NO: 33651
  Description of Artificial Sequence: Synthetic polypeptide
  VL of XENP024236

SEQ ID NO: 34507 - protein, 5 aa, Artificial Sequence
  Description of Artificial Sequence: Synthetic peptide
  XENP024236 vhCDR1
HYGMN

SEQ ID NO: 34508 - protein, 17 aa, Artificial Sequence
  Description of Artificial Sequence: Synthetic peptide
  XENP024236 vhCDR2
WINTYTGEPTYADGFTG

SEQ ID NO: 34509 - protein, 8 aa, Artificial Sequence
  Description of Artificial Sequence: Synthetic peptide
  XENP024236 vhCDR3
DYYGSSPY

SEQ ID NO: 34510 - protein, 16 aa, Artificial Sequence
  Description of Artificial Sequence: Synthetic peptide
  XENP024236 vlCDR1
KSSQSIVHSNGNTYLE

SEQ ID NO: 34511 - protein, 7 aa, Artificial Sequence
  Description of Artificial Sequence: Synthetic peptide
  XENP024236 vlCDR2
KVSNRFS

SEQ ID NO: 34512 - protein, 9 aa, Artificial Sequence
  Description of Artificial Sequence: Synthetic peptide
  XENP024236 vlCDR3
FQGSHVPNT

SEQ ID NO: 34513 - protein, 251 aa, Artificial Sequence
  Description of Artificial Sequence: Synthetic polypeptide
  XENP024237 1C11_H3.106_L3_scFv
QIQLVQSGSELKKPGASVKVSCKVSGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34514 - protein, 117 aa, Artificial Sequence
  Description of Artificial Sequence: Synthetic polypeptide
  VH of XENP024237
QIQLVQSGSELKKPGASVKVSCKVSGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34515 - protein, 114 aa, Artificial Sequence; identical to SEQ ID NO: 33651
  Description of Artificial Sequence: Synthetic polypeptide
  VL of XENP024237

SEQ ID NO: 34516 - protein, 5 aa, Artificial Sequence
  Description of Artificial Sequence: Synthetic peptide
  XENP024237 vhCDR1
HYGMN

SEQ ID NO: 34517 - protein, 17 aa, Artificial Sequence
  Description of Artificial Sequence: Synthetic peptide
  XENP024237 vhCDR2
WINTYTGEPTYADGFTG

SEQ ID NO: 34518 - protein, 8 aa, Artificial Sequence
  Description of Artificial Sequence: Synthetic peptide
  XENP024237 vhCDR3
DYYGSSPY

SEQ ID NO: 34519 - protein, 16 aa, Artificial Sequence
  Description of Artificial Sequence: Synthetic peptide
  XENP024237 vlCDR1
KSSQSIVHSNGNTYLE

SEQ ID NO: 34520 - protein, 7 aa, Artificial Sequence
  Description of Artificial Sequence: Synthetic peptide
  XENP024237 vlCDR2
KVSNRFS

SEQ ID NO: 34521 - protein, 9 aa, Artificial Sequence
  Description of Artificial Sequence: Synthetic peptide
  XENP024237 vlCDR3
FQGSHVPNT

SEQ ID NO: 34522 - protein, 251 aa, Artificial Sequence
  Description of Artificial Sequence: Synthetic polypeptide
  XENP024238 1C11_H3.107_L3_scFv
QIQLVQSGSELKKPGASVKVSCKGSGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34523 - protein, 117 aa, Artificial Sequence
  Description of Artificial Sequence: Synthetic polypeptide
  VH of XENP024238
QIQLVQSGSELKKPGASVKVSCKGSGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34524 - protein, 114 aa, Artificial Sequence; identical to SEQ ID NO: 33651
  Description of Artificial Sequence: Synthetic polypeptide
  VL of XENP024238

SEQ ID NO: 34525 - protein, 5 aa, Artificial Sequence
  Description of Artificial Sequence: Synthetic peptide
  XENP024238 vhCDR1
HYGMN

SEQ ID NO: 34526 - protein, 17 aa, Artificial Sequence
  Description of Artificial Sequence: Synthetic peptide
  XENP024238 vhCDR2
WINTYTGEPTYADGFTG

SEQ ID NO: 34527 - protein, 8 aa, Artificial Sequence
  Description of Artificial Sequence: Synthetic peptide
  XENP024238 vhCDR3
DYYGSSPY

SEQ ID NO: 34528 - protein, 16 aa, Artificial Sequence
  Description of Artificial Sequence: Synthetic peptide
  XENP024238 vlCDR1
KSSQSIVHSNGNTYLE

SEQ ID NO: 34529 - protein, 7 aa, Artificial Sequence
  Description of Artificial Sequence: Synthetic peptide
  XENP024238 vlCDR2
KVSNRFS

SEQ ID NO: 34530 - protein, 9 aa, Artificial Sequence
  Description of Artificial Sequence: Synthetic peptide
  XENP024238 vlCDR3
FQGSHVPNT

SEQ ID NO: 34531 - protein, 251 aa, Artificial Sequence
  Description of Artificial Sequence: Synthetic polypeptide
  XENP024239 1C11_H3.109_L3_scFv
QIQLVQSGSELKKPGASVKVSCKASGFTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34532 - protein, 117 aa, Artificial Sequence
  Description of Artificial Sequence: Synthetic polypeptide
  VH of XENP024239
QIQLVQSGSELKKPGASVKVSCKASGFTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34533 - protein, 114 aa, Artificial Sequence; identical to SEQ ID NO: 33651
  Description of Artificial Sequence: Synthetic polypeptide
  VL of XENP024239

SEQ ID NO: 34534 - protein, 5 aa, Artificial Sequence
  Description of Artificial Sequence: Synthetic peptide
  XENP024239 vhCDR1
HYGMN

SEQ ID NO: 34535 - protein, 17 aa, Artificial Sequence
  Description of Artificial Sequence: Synthetic peptide
  XENP024239 vhCDR2
WINTYTGEPTYADGFTG

SEQ ID NO: 34536 - protein, 8 aa, Artificial Sequence
  Description of Artificial Sequence: Synthetic peptide
  XENP024239 vhCDR3
DYYGSSPY

SEQ ID NO: 34537 - protein, 16 aa, Artificial Sequence
  Description of Artificial Sequence: Synthetic peptide
  XENP024239 vlCDR1
KSSQSIVHSNGNTYLE

SEQ ID NO: 34538 - protein, 7 aa, Artificial Sequence
  Description of Artificial Sequence: Synthetic peptide
  XENP024239 vlCDR2
KVSNRFS

SEQ ID NO: 34539 - protein, 9 aa, Artificial Sequence
  Description of Artificial Sequence: Synthetic peptide
  XENP024239 vlCDR3
FQGSHVPNT

SEQ ID NO: 34540 - protein, 251 aa, Artificial Sequence
  Description of Artificial Sequence: Synthetic polypeptide
  XENP024240 1C11_H3.110_L3_scFv
QIQLVQSGSELKKPGASVKVSCKASGGTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34541 - protein, 117 aa, Artificial Sequence
  Description of Artificial Sequence: Synthetic polypeptide
  VH of XENP024240
QIQLVQSGSELKKPGASVKVSCKASGGTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34542 - protein, 114 aa, Artificial Sequence; identical to SEQ ID NO: 33651
  Description of Artificial Sequence: Synthetic polypeptide
  VL of XENP024240

SEQ ID NO: 34543 - protein, 5 aa, Artificial Sequence
  Description of Artificial Sequence: Synthetic peptide
  XENP024240 vhCDR1
HYGMN

SEQ ID NO: 34544 - protein, 17 aa, Artificial Sequence
  Description of Artificial Sequence: Synthetic peptide
  XENP024240 vhCDR2
WINTYTGEPTYADGFTG

SEQ ID NO: 34545 - protein, 8 aa, Artificial Sequence
  Description of Artificial Sequence: Synthetic peptide
  XENP024240 vhCDR3
DYYGSSPY

SEQ ID NO: 34546 - protein, 16 aa, Artificial Sequence
  Description of Artificial Sequence: Synthetic peptide
  XENP024240 vlCDR1
KSSQSIVHSNGNTYLE

SEQ ID NO: 34547 - protein, 7 aa, Artificial Sequence
  Description of Artificial Sequence: Synthetic peptide
  XENP024240 vlCDR2
KVSNRFS

SEQ ID NO: 34548 - protein, 9 aa, Artificial Sequence
  Description of Artificial Sequence: Synthetic peptide
  XENP024240 vlCDR3
FQGSHVPNT

SEQ ID NO: 34549 - protein, 251 aa, Artificial Sequence
  Description of Artificial Sequence: Synthetic polypeptide
  XENP024241 1C11_H3.111_L3_scFv
QIQLVQSGSELKKPGASVKVSCKASGYSFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34550 - protein, 117 aa, Artificial Sequence
  Description of Artificial Sequence: Synthetic polypeptide
  VH of XENP024241
QIQLVQSGSELKKPGASVKVSCKASGYSFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34551 - protein, 114 aa, Artificial Sequence; identical to SEQ ID NO: 33651
  Description of Artificial Sequence: Synthetic polypeptide
  VL of XENP024241

SEQ ID NO: 34552 - protein, 5 aa, Artificial Sequence
  Description of Artificial Sequence: Synthetic peptide
  XENP024241 vhCDR1
HYGMN

SEQ ID NO: 34553 - protein, 17 aa, Artificial Sequence
  Description of Artificial Sequence: Synthetic peptide
  XENP024241 vhCDR2
WINTYTGEPTYADGFTG

SEQ ID NO: 34554 - protein, 8 aa, Artificial Sequence
  Description of Artificial Sequence: Synthetic peptide
  XENP024241 vhCDR3
DYYGSSPY

SEQ ID NO: 34555 - protein, 16 aa, Artificial Sequence
  Description of Artificial Sequence: Synthetic peptide
  XENP024241 vlCDR1
KSSQSIVHSNGNTYLE

SEQ ID NO: 34556 - protein, 7 aa, Artificial Sequence
  Description of Artificial Sequence: Synthetic peptide
  XENP024241 vlCDR2
KVSNRFS

SEQ ID NO: 34557 - protein, 9 aa, Artificial Sequence
  Description of Artificial Sequence: Synthetic peptide
  XENP024241 vlCDR3
FQGSHVPNT

SEQ ID NO: 34558 - protein, 251 aa, Artificial Sequence
  Description of Artificial Sequence: Synthetic polypeptide
  XENP024242 1C11_H3.113_L3_scFv
QIQLVQSGSELKKPGASVKVSCKASGYTITHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34559 - protein, 117 aa, Artificial Sequence
  Description of Artificial Sequence: Synthetic polypeptide
  VH of XENP024242
QIQLVQSGSELKKPGASVKVSCKASGYTITHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34560 - protein, 114 aa, Artificial Sequence; identical to SEQ ID NO: 33651
  Description of Artificial Sequence: Synthetic polypeptide
  VL of XENP024242

SEQ ID NO: 34561 - protein, 5 aa, Artificial Sequence
  Description of Artificial Sequence: Synthetic peptide
  XENP024242 vhCDR1
HYGMN

SEQ ID NO: 34562 - protein, 17 aa, Artificial Sequence
  Description of Artificial Sequence: Synthetic peptide
  XENP024242 vhCDR2
WINTYTGEPTYADGFTG

SEQ ID NO: 34563 - protein, 8 aa, Artificial Sequence
  Description of Artificial Sequence: Synthetic peptide
  XENP024242 vhCDR3
DYYGSSPY

SEQ ID NO: 34564 - protein, 16 aa, Artificial Sequence
  Description of Artificial Sequence: Synthetic peptide
  XENP024242 vlCDR1
KSSQSIVHSNGNTYLE

SEQ ID NO: 34565 - protein, 7 aa, Artificial Sequence
  Description of Artificial Sequence: Synthetic peptide
  XENP024242 vlCDR2
KVSNRFS

SEQ ID NO: 34566 - protein, 9 aa, Artificial Sequence
  Description of Artificial Sequence: Synthetic peptide
  XENP024242 vlCDR3
FQGSHVPNT

SEQ ID NO: 34567 - protein, 251 aa, Artificial Sequence
  Description of Artificial Sequence: Synthetic polypeptide
  XENP024243 1C11_H3.114_L3_scFv
QIQLVQSGSELKKPGASVKVSCKASGYTVTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34568 - protein, 117 aa, Artificial Sequence
  Description of Artificial Sequence: Synthetic polypeptide
  VH of XENP024243
QIQLVQSGSELKKPGASVKVSCKASGYTVTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34569 - protein, 114 aa, Artificial Sequence; identical to SEQ ID NO: 33651
  Description of Artificial Sequence: Synthetic polypeptide
  VL of XENP024243

SEQ ID NO: 34570 - protein, 5 aa, Artificial Sequence
  Description of Artificial Sequence: Synthetic peptide
  XENP024243 vhCDR1
HYGMN

SEQ ID NO: 34571 - protein, 17 aa, Artificial Sequence
  Description of Artificial Sequence: Synthetic peptide
  XENP024243 vhCDR2
WINTYTGEPTYADGFTG

SEQ ID NO: 34572 - protein, 8 aa, Artificial Sequence
  Description of Artificial Sequence: Synthetic peptide
  XENP024243 vhCDR3
DYYGSSPY

SEQ ID NO: 34573 - protein, 16 aa, Artificial Sequence
  Description of Artificial Sequence: Synthetic peptide
  XENP024243 vlCDR1
KSSQSIVHSNGNTYLE

SEQ ID NO: 34574 - protein, 7 aa, Artificial Sequence
  Description of Artificial Sequence: Synthetic peptide
  XENP024243 vlCDR2
KVSNRFS

SEQ ID NO: 34575 - protein, 9 aa, Artificial Sequence
  Description of Artificial Sequence: Synthetic peptide
  XENP024243 vlCDR3
FQGSHVPNT

SEQ ID NO: 34576 - protein, 251 aa, Artificial Sequence
  Description of Artificial Sequence: Synthetic polypeptide
  XENP024244 1C11_H3.115_L3_scFv
QIQLVQSGSELKKPGASVKVSCKASGYTFSHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34577 - protein, 117 aa, Artificial Sequence
  Description of Artificial Sequence: Synthetic polypeptide
  VH of XENP024244
QIQLVQSGSELKKPGASVKVSCKASGYTFSHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34578 - protein, 114 aa, Artificial Sequence; identical to SEQ ID NO: 33651
  Description of Artificial Sequence: Synthetic polypeptide
  VL of XENP024244

SEQ ID NO: 34579 - protein, 5 aa, Artificial Sequence
  Description of Artificial Sequence: Synthetic peptide
  XENP024244 vhCDR1
HYGMN

SEQ ID NO: 34580 - protein, 17 aa, Artificial Sequence
  Description of Artificial Sequence: Synthetic peptide
  XENP024244 vhCDR2
WINTYTGEPTYADGFTG

SEQ ID NO: 34581 - protein, 8 aa, Artificial Sequence
  Description of Artificial Sequence: Synthetic peptide
  XENP024244 vhCDR3
DYYGSSPY

SEQ ID NO: 34582 - protein, 16 aa, Artificial Sequence
  Description of Artificial Sequence: Synthetic peptide
  XENP024244 vlCDR1
KSSQSIVHSNGNTYLE

SEQ ID NO: 34583 - protein, 7 aa, Artificial Sequence
  Description of Artificial Sequence: Synthetic peptide
  XENP024244 vlCDR2
KVSNRFS

SEQ ID NO: 34584 - protein, 9 aa, Artificial Sequence
  Description of Artificial Sequence: Synthetic peptide
  XENP024244 vlCDR3
FQGSHVPNT

SEQ ID NO: 34585 - protein, 251 aa, Artificial Sequence
  Description of Artificial Sequence: Synthetic polypeptide
  XENP024245 1C11_H3.116_L3_scFv
QIQLVQSGSELKKPGASVKVSCKASGYTFDHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34586 - protein, 117 aa, Artificial Sequence
  Description of Artificial Sequence: Synthetic polypeptide
  VH of XENP024245
QIQLVQSGSELKKPGASVKVSCKASGYTFDHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34587 - protein, 114 aa, Artificial Sequence; identical to SEQ ID NO: 33651
  Description of Artificial Sequence: Synthetic polypeptide
  VL of XENP024245

SEQ ID NO: 34588 - protein, 5 aa, Artificial Sequence
  Description of Artificial Sequence: Synthetic peptide
  XENP024245 vhCDR1
HYGMN

SEQ ID NO: 34589 - protein, 17 aa, Artificial Sequence
  Description of Artificial Sequence: Synthetic peptide
  XENP024245 vhCDR2
WINTYTGEPTYADGFTG

SEQ ID NO: 34590 - protein, 8 aa, Artificial Sequence
  Description of Artificial Sequence: Synthetic peptide
  XENP024245 vhCDR3
DYYGSSPY

SEQ ID NO: 34591 - protein, 16 aa, Artificial Sequence
  Description of Artificial Sequence: Synthetic peptide
  XENP024245 vlCDR1
KSSQSIVHSNGNTYLE

SEQ ID NO: 34592 - protein, 7 aa, Artificial Sequence
  Description of Artificial Sequence: Synthetic peptide
  XENP024245 vlCDR2
KVSNRFS

SEQ ID NO: 34593 - protein, 9 aa, Artificial Sequence
  Description of Artificial Sequence: Synthetic peptide
  XENP024245 vlCDR3
FQGSHVPNT

SEQ ID NO: 34594 - protein, 251 aa, Artificial Sequence
  Description of Artificial Sequence: Synthetic polypeptide
  XENP024246 1C11_H3.117_L3_scFv
QIQLVQSGSELKKPGASVKVSCKASGYTFGHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34595 - protein, 117 aa, Artificial Sequence
  Description of Artificial Sequence: Synthetic polypeptide
  VH of XENP024246
QIQLVQSGSELKKPGASVKVSCKASGYTFGHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34596 - protein, 114 aa, Artificial Sequence; identical to SEQ ID NO: 33651
  Description of Artificial Sequence: Synthetic polypeptide
  VL of XENP024246

SEQ ID NO: 34597 - protein, 5 aa, Artificial Sequence
  Description of Artificial Sequence: Synthetic peptide
  XENP024246 vhCDR1
HYGMN

SEQ ID NO: 34598 - protein, 17 aa, Artificial Sequence
  Description of Artificial Sequence: Synthetic peptide
  XENP024246 vhCDR2
WINTYTGEPTYADGFTG

SEQ ID NO: 34599 - protein, 8 aa, Artificial Sequence
  Description of Artificial Sequence: Synthetic peptide
  XENP024246 vhCDR3
DYYGSSPY

SEQ ID NO: 34600 - protein, 16 aa, Artificial Sequence
  Description of Artificial Sequence: Synthetic peptide
  XENP024246 vlCDR1
KSSQSIVHSNGNTYLE

SEQ ID NO: 34601 - protein, 7 aa, Artificial Sequence
  Description of Artificial Sequence: Synthetic peptide
  XENP024246 vlCDR2
KVSNRFS

SEQ ID NO: 34602 - protein, 9 aa, Artificial Sequence
  Description of Artificial Sequence: Synthetic peptide
  XENP024246 vlCDR3
FQGSHVPNT

SEQ ID NO: 34603 - protein, 251 aa, Artificial Sequence
  Description of Artificial Sequence: Synthetic polypeptide
  XENP024247 1C11_H3.120_L3_scFv
QIQLVQSGSELKKPGASVKVSCKASGYTFTHYGINWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34604 - protein, 117 aa, Artificial Sequence
  Description of Artificial Sequence: Synthetic polypeptide
  VH of XENP024247
QIQLVQSGSELKKPGASVKVSCKASGYTFTHYGINWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34605 - protein, 114 aa, Artificial Sequence; identical to SEQ ID NO: 33651
  Description of Artificial Sequence: Synthetic polypeptide
  VL of XENP024247

SEQ ID NO: 34606 - protein, 5 aa, Artificial Sequence
  Description of Artificial Sequence: Synthetic peptide
  XENP024247 vhCDR1
HYGIN

SEQ ID NO: 34607 - protein, 17 aa, Artificial Sequence
  Description of Artificial Sequence: Synthetic peptide
  XENP024247 vhCDR2
WINTYTGEPTYADGFTG

SEQ ID NO: 34608 - protein, 8 aa, Artificial Sequence
  Description of Artificial Sequence: Synthetic peptide
  XENP024247 vhCDR3
DYYGSSPY

SEQ ID NO: 34609 - protein, 16 aa, Artificial Sequence
  Description of Artificial Sequence: Synthetic peptide
  XENP024247 vlCDR1
KSSQSIVHSNGNTYLE

SEQ ID NO: 34610 - protein, 7 aa, Artificial Sequence
  Description of Artificial Sequence: Synthetic peptide
  XENP024247 vlCDR2
KVSNRFS

SEQ ID NO: 34611 - protein, 9 aa, Artificial Sequence
  Description of Artificial Sequence: Synthetic peptide
  XENP024247 vlCDR3
FQGSHVPNT

SEQ ID NO: 34612 - protein, 251 aa, Artificial Sequence
  Description of Artificial Sequence: Synthetic polypeptide
  XENP024248 1C11_H3.121_L3_scFv
QIQLVQSGSELKKPGASVKVSCKASGYTFTHYGVNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34613 - protein, 117 aa, Artificial Sequence
  Description of Artificial Sequence: Synthetic polypeptide
  VH of XENP024248
QIQLVQSGSELKKPGASVKVSCKASGYTFTHYGVNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34614 - protein, 114 aa, Artificial Sequence; identical to SEQ ID NO: 33651
  Description of Artificial Sequence: Synthetic polypeptide
  VL of XENP024248

SEQ ID NO: 34615 - protein, 5 aa, Artificial Sequence
  Description of Artificial Sequence: Synthetic peptide
  XENP024248 vhCDR1
HYGVN

SEQ ID NO: 34616 - protein, 17 aa, Artificial Sequence
  Description of Artificial Sequence: Synthetic peptide
  XENP024248 vhCDR2
WINTYTGEPTYADGFTG

SEQ ID NO: 34617 - protein, 8 aa, Artificial Sequence
  Description of Artificial Sequence: Synthetic peptide
  XENP024248 vhCDR3
DYYGSSPY

SEQ ID NO: 34618 - protein, 16 aa, Artificial Sequence
  Description of Artificial Sequence: Synthetic peptide
  XENP024248 vlCDR1
KSSQSIVHSNGNTYLE

SEQ ID NO: 34619 - protein, 7 aa, Artificial Sequence
  Description of Artificial Sequence: Synthetic peptide
  XENP024248 vlCDR2
KVSNRFS

SEQ ID NO: 34620 - protein, 9 aa, Artificial Sequence
  Description of Artificial Sequence: Synthetic peptide
  XENP024248 vlCDR3
FQGSHVPNT

SEQ ID NO: 34621 - protein, 251 aa, Artificial Sequence
  Description of Artificial Sequence: Synthetic polypeptide
  XENP024249 1C11_H3.123_L3_scFv
QIQLVQSGSELKKPGASVKVSCKASGYTFTHYGMNWIRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34622 - protein, 117 aa, Artificial Sequence
  Description of Artificial Sequence: Synthetic polypeptide
  VH of XENP024249
QIQLVQSGSELKKPGASVKVSCKASGYTFTHYGMNWIRQAPGQGLEWMGWINTYTGEPTYADGFTGRFVFSLDTSVSTAYLQISSLKAEDTAVYFCARDYYGSSPYWGQGTLVTVSS

SEQ ID NO: 34623 - protein, 114 aa, Artificial Sequence; identical to SEQ ID NO: 33651
  Description of Artificial Sequence: Synthetic polypeptide
  VL of XENP024249

SEQ ID NO: 34624 - protein, 5 aa, Artificial Sequence
  Description of Artificial Sequence: Synthetic peptide
  XENP024249 vhCDR1
HYGMN

SEQ ID NO: 34625 - protein, 17 aa, Artificial Sequence
  Description of Artificial Sequence: Synthetic peptide
  XENP024249 vhCDR2
WINTYTGEPTYADGFTG

SEQ ID NO: 34626 - protein, 8 aa, Artificial Sequence
  Description of Artificial Sequence: Synthetic peptide
  XENP024249 vhCDR3
DYYGSSPY

SEQ ID NO: 34627 - protein, 16 aa, Artificial Sequence
  Description of Artificial Sequence: Synthetic peptide
  XENP024249 vlCDR1
KSSQSIVHSNGNTYLE

SEQ ID NO: 34628 - protein, 7 aa, Artificial Sequence
  Description of Artificial Sequence: Synthetic peptide
  XENP024249 vlCDR2
KVSNRFS

SEQ ID NO: 34629 - protein, 9 aa, Artificial Sequence
  Description of Artificial Sequence: Synthetic peptide
  XENP024249 vlCDR3
FQGSHVPNT

SEQ ID NO: 34630 - protein, 251 aa, Artificial Sequence
  Description of Artificial Sequence: Synthetic polypeptide
  XENP024250 1C11_H3.125_L3_scFv
QIQLVQSGSELKKPGASVKVSCKASGYTFTHYGMNWVRQPPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34631 - protein, 117 aa, Artificial Sequence
  Description of Artificial Sequence: Synthetic polypeptide
  VH of XENP024250
QIQLVQSGSELKKPGASVKVSCKASGYTFTHYGMNWVRQPPGQGLEWMGWINTYTGEPTYADGFTGRFVFSLDTSVSTAYLQISSLKAEDTAVYFCARDYYGSSPYWGQGTLVTVSS

SEQ ID NO: 34632 - protein, 114 aa, Artificial Sequence; identical to SEQ ID NO: 33651
  Description of Artificial Sequence: Synthetic polypeptide
  VL of XENP024250

SEQ ID NO: 34633 - protein, 5 aa, Artificial Sequence
  Description of Artificial Sequence: Synthetic peptide
  XENP024250 vhCDR1
HYGMN

SEQ ID NO: 34634 - protein, 17 aa, Artificial Sequence
  Description of Artificial Sequence: Synthetic peptide
  XENP024250 vhCDR2
WINTYTGEPTYADGFTG

SEQ ID NO: 34635 - protein, 8 aa, Artificial Sequence
  Description of Artificial Sequence: Synthetic peptide
  XENP024250 vhCDR3
DYYGSSPY

SEQ ID NO: 34636 - protein, 16 aa, Artificial Sequence
  Description of Artificial Sequence: Synthetic peptide
  XENP024250 vlCDR1
KSSQSIVHSNGNTYLE

SEQ ID NO: 34637 - protein, 7 aa, Artificial Sequence
  Description of Artificial Sequence: Synthetic peptide
  XENP024250 vlCDR2
KVSNRFS

SEQ ID NO: 34638 - protein, 9 aa, Artificial Sequence
  Description of Artificial Sequence: Synthetic peptide
  XENP024250 vlCDR3
FQGSHVPNT

SEQ ID NO: 34639 - protein, 251 aa, Artificial Sequence
  Description of Artificial Sequence: Synthetic polypeptide
  XENP024251 1C11_H3.126_L3_scFv
QIQLVQSGSELKKPGASVKVSCKASGYTFTHYGMNWVRQATGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34640 - protein, 117 aa, Artificial Sequence
  Description of Artificial Sequence: Synthetic polypeptide
  VH of XENP024251
QIQLVQSGSELKKPGASVKVSCKASGYTFTHYGMNWVRQATGQGLEWMGWINTYTGEPTYADGFTGRFVFSLDTSVSTAYLQISSLKAEDTAVYFCARDYYGSSPYWGQGTLVTVSS

SEQ ID NO: 34641 - protein, 114 aa, Artificial Sequence; identical to SEQ ID NO: 33651
  Description of Artificial Sequence: Synthetic polypeptide
  VL of XENP024251

SEQ ID NO: 34642 - protein, 5 aa, Artificial Sequence
  Description of Artificial Sequence: Synthetic peptide
  XENP024251 vhCDR1
HYGMN

SEQ ID NO: 34643 - protein, 17 aa, Artificial Sequence
  Description of Artificial Sequence: Synthetic peptide
  XENP024251 vhCDR2
WINTYTGEPTYADGFTG

SEQ ID NO: 34644 - protein, 8 aa, Artificial Sequence
  Description of Artificial Sequence: Synthetic peptide
  XENP024251 vhCDR3
DYYGSSPY

SEQ ID NO: 34645 - protein, 16 aa, Artificial Sequence
  Description of Artificial Sequence: Synthetic peptide
  XENP024251 vlCDR1
KSSQSIVHSNGNTYLE

SEQ ID NO: 34646 - protein, 7 aa, Artificial Sequence
  Description of Artificial Sequence: Synthetic peptide
  XENP024251 vlCDR2
KVSNRFS

SEQ ID NO: 34647 - protein, 9 aa, Artificial Sequence
  Description of Artificial Sequence: Synthetic peptide
  XENP024251 vlCDR3
FQGSHVPNT

SEQ ID NO: 34648 - protein, 251 aa, Artificial Sequence
  Description of Artificial Sequence: Synthetic polypeptide
  XENP024252 1C11_H3.127_L3_scFv
QIQLVQSGSELKKPGASVKVSCKASGYTFTHYGMNWVRQAPGQALEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34649 - protein, 117 aa, Artificial Sequence
  Description of Artificial Sequence: Synthetic polypeptide
  VH of XENP024252
QIQLVQSGSELKKPGASVKVSCKASGYTFTHYGMNWVRQAPGQALEWMGWINTYTGEPTYADGFTGRFVFSLDTSVSTAYLQISSLKAEDTAVYFCARDYYGSSPYWGQGTLVTVSS

SEQ ID NO: 34650 - protein, 114 aa, Artificial Sequence; identical to SEQ ID NO: 33651
  Description of Artificial Sequence: Synthetic polypeptide
  VL of XENP024252

SEQ ID NO: 34651 - protein, 5 aa, Artificial Sequence
  Description of Artificial Sequence: Synthetic peptide
  XENP024252 vhCDR1
HYGMN

SEQ ID NO: 34652 - protein, 17 aa, Artificial Sequence
  Description of Artificial Sequence: Synthetic peptide
  XENP024252 vhCDR2
WINTYTGEPTYADGFTG

SEQ ID NO: 34653 - protein, 8 aa, Artificial Sequence
  Description of Artificial Sequence: Synthetic peptide
  XENP024252 vhCDR3
DYYGSSPY

SEQ ID NO: 34654 - protein, 16 aa, Artificial Sequence
  Description of Artificial Sequence: Synthetic peptide
  XENP024252 vlCDR1
KSSQSIVHSNGNTYLE

SEQ ID NO: 34655 - protein, 7 aa, Artificial Sequence
  Description of Artificial Sequence: Synthetic peptide
  XENP024252 vlCDR2
KVSNRFS

SEQ ID NO: 34656 - protein, 9 aa, Artificial Sequence
  Description of Artificial Sequence: Synthetic peptide
  XENP024252 vlCDR3
FQGSHVPNT

SEQ ID NO: 34657 - protein, 251 aa, Artificial Sequence
  Description of Artificial Sequence: Synthetic polypeptide
  XENP024253 1C11_H3.128_L3_scFv
QIQLVQSGSELKKPGASVKVSCKASGYTFTHYGMNWVRQAPGQGLEWVGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34658 - protein, 117 aa, Artificial Sequence
  Description of Artificial Sequence: Synthetic polypeptide
  VH of XENP024253
QIQLVQSGSELKKPGASVKVSCKASGYTFTHYGMNWVRQAPGQGLEWVGWINTYTGEPTYADGFTGRFVFSLDTSVSTAYLQISSLKAEDTAVYFCARDYYGSSPYWGQGTLVTVSS

SEQ ID NO: 34659 - protein, 114 aa, Artificial Sequence; identical to SEQ ID NO: 33651
  Description of Artificial Sequence: Synthetic polypeptide
  VL of XENP024253

SEQ ID NO: 34660 - protein, 5 aa, Artificial Sequence
  Description of Artificial Sequence: Synthetic peptide
  XENP024253 vhCDR1
HYGMN

SEQ ID NO: 34661 - protein, 17 aa, Artificial Sequence
  Description of Artificial Sequence: Synthetic peptide
  XENP024253 vhCDR2
WINTYTGEPTYADGFTG

SEQ ID NO: 34662 - protein, 8 aa, Artificial Sequence
  Description of Artificial Sequence: Synthetic peptide
  XENP024253 vhCDR3
DYYGSSPY

SEQ ID NO: 34663 - protein, 16 aa, Artificial Sequence
  Description of Artificial Sequence: Synthetic peptide
  XENP024253 vlCDR1
KSSQSIVHSNGNTYLE

SEQ ID NO: 34664 - protein, 7 aa, Artificial Sequence
  Description of Artificial Sequence: Synthetic peptide
  XENP024253 vlCDR2
KVSNRFS

SEQ ID NO: 34665 - protein, 9 aa, Artificial Sequence
  Description of Artificial Sequence: Synthetic peptide
  XENP024253 vlCDR3
FQGSHVPNT

SEQ ID NO: 34666 - protein, 251 aa, Artificial Sequence
  Description of Artificial Sequence: Synthetic polypeptide
  XENP024254 1C11_H3.129_L3_scFv
QIQLVQSGSELKKPGASVKVSCKASGYTFTHYGMNWVRQAPGQGLEWIGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34667 - protein, 117 aa, Artificial Sequence
  Description of Artificial Sequence: Synthetic polypeptide
  VH of XENP024254
QIQLVQSGSELKKPGASVKVSCKASGYTFTHYGMNWVRQAPGQGLEWIGWINTYTGEPTYADGFTGRFVFSLDTSVSTAYLQISSLKAEDTAVYFCARDYYGSSPYWGQGTLVTVSS

SEQ ID NO: 34668 - protein, 114 aa, Artificial Sequence; identical to SEQ ID NO: 33651
  Description of Artificial Sequence: Synthetic polypeptide
  VL of XENP024254

SEQ ID NO: 34669 - protein, 5 aa, Artificial Sequence
  Description of Artificial Sequence: Synthetic peptide
  XENP024254 vhCDR1
HYGMN

SEQ ID NO: 34670 - protein, 17 aa, Artificial Sequence
  Description of Artificial Sequence: Synthetic peptide
  XENP024254 vhCDR2
WINTYTGEPTYADGFTG

SEQ ID NO: 34671 - protein, 8 aa, Artificial Sequence
  Description of Artificial Sequence: Synthetic peptide
  XENP024254 vhCDR3
DYYGSSPY

SEQ ID NO: 34672 - protein, 16 aa, Artificial Sequence
  Description of Artificial Sequence: Synthetic peptide
  XENP024254 vlCDR1
KSSQSIVHSNGNTYLE

SEQ ID NO: 34673 - protein, 7 aa, Artificial Sequence
  Description of Artificial Sequence: Synthetic peptide
  XENP024254 vlCDR2
KVSNRFS

SEQ ID NO: 34674 - protein, 9 aa, Artificial Sequence
  Description of Artificial Sequence: Synthetic peptide
  XENP024254 vlCDR3
FQGSHVPNT

SEQ ID NO: 34675 - protein, 251 aa, Artificial Sequence
  Description of Artificial Sequence: Synthetic polypeptide
  XENP024255 1C11_H3.130_L3_scFv
QIQLVQSGSELKKPGASVKVSCKASGYTFTHYGMNWVRQAPGQGLEWMSWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34676 - protein, 117 aa, Artificial Sequence
  Description of Artificial Sequence: Synthetic polypeptide
  VH of XENP024255
QIQLVQSGSELKKPGASVKVSCKASGYTFTHYGMNWVRQAPGQGLEWMSWINTYTGEPTYADGFTGRFVFSLDTSVSTAYLQISSLKAEDTAVYFCARDYYGSSPYWGQGTLVTVSS

SEQ ID NO: 34677 - protein, 114 aa, Artificial Sequence; identical to SEQ ID NO: 33651
  Description of Artificial Sequence: Synthetic polypeptide
  VL of XENP024255

SEQ ID NO: 34678 - protein, 5 aa, Artificial Sequence
  Description of Artificial Sequence: Synthetic peptide
  XENP024255 vhCDR1
HYGMN

SEQ ID NO: 34679 - protein, 17 aa, Artificial Sequence
  Description of Artificial Sequence: Synthetic peptide
  XENP024255 vhCDR2
WINTYTGEPTYADGFTG

SEQ ID NO: 34680 - protein, 8 aa, Artificial Sequence
  Description of Artificial Sequence: Synthetic peptide
  XENP024255 vhCDR3
DYYGSSPY

SEQ ID NO: 34681 - protein, 16 aa, Artificial Sequence
  Description of Artificial Sequence: Synthetic peptide
  XENP024255 vlCDR1
KSSQSIVHSNGNTYLE

SEQ ID NO: 34682 - protein, 7 aa, Artificial Sequence
  Description of Artificial Sequence: Synthetic peptide
  XENP024255 vlCDR2
KVSNRFS

SEQ ID NO: 34683 - protein, 9 aa, Artificial Sequence
  Description of Artificial Sequence: Synthetic peptide
  XENP024255 vlCDR3
FQGSHVPNT

SEQ ID NO: 34684 - protein, 251 aa, Artificial Sequence
  Description of Artificial Sequence: Synthetic polypeptide
  XENP024256 1C11_H3.134_L3_scFv
QIQLVQSGSELKKPGASVKVSCKASGYTFTHYGMNWVRQAPGQGLEWMGWINTKTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34685 - protein, 117 aa, Artificial Sequence
  Description of Artificial Sequence: Synthetic polypeptide
  VH of XENP024256
QIQLVQSGSELKKPGASVKVSCKASGYTFTHYGMNWVRQAPGQGLEWMGWINTKTGEPTYADGFTGRFVFSLDTSVSTAYLQISSLKAEDTAVYFCARDYYGSSPYWGQGTLVTVSS

SEQ ID NO: 34686 - protein, 114 aa, Artificial Sequence; identical to SEQ ID NO: 33651
  Description of Artificial Sequence: Synthetic polypeptide
  VL of XENP024256

SEQ ID NO: 34687 - protein, 5 aa, Artificial Sequence
  Description of Artificial Sequence: Synthetic peptide
  XENP024256 vhCDR1
HYGMN

SEQ ID NO: 34688 - protein, 17 aa, Artificial Sequence
  Description of Artificial Sequence: Synthetic peptide
  XENP024256 vhCDR2
WINTKTGEPTYADGFTG

SEQ ID NO: 34689 - protein, 8 aa, Artificial Sequence
  Description of Artificial Sequence: Synthetic peptide
  XENP024256 vhCDR3
DYYGSSPY

SEQ ID NO: 34690 - protein, 16 aa, Artificial Sequence
  Description of Artificial Sequence: Synthetic peptide
  XENP024256 vlCDR1
KSSQSIVHSNGNTYLE

SEQ ID NO: 34691 - protein, 7 aa, Artificial Sequence
  Description of Artificial Sequence: Synthetic peptide
  XENP024256 vlCDR2
KVSNRFS

SEQ ID NO: 34692 - protein, 9 aa, Artificial Sequence
  Description of Artificial Sequence: Synthetic peptide
  XENP024256 vlCDR3
FQGSHVPNT

SEQ ID NO: 34693 - protein, 251 aa, Artificial Sequence
  Description of Artificial Sequence: Synthetic polypeptide
  XENP024257 1C11_H3.135_L3_scFv
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34694 - protein, 117 aa, Artificial Sequence
  Description of Artificial Sequence: Synthetic polypeptide
  VH of XENP024257
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYYGSSPYWGQGTLVTVSS

SEQ ID NO: 34695 - protein, 114 aa, Artificial Sequence; identical to SEQ ID NO: 33651
  Description of Artificial Sequence: Synthetic polypeptide
  VL of XENP024257

SEQ ID NO: 34696 - protein, 5 aa, Artificial Sequence
  Description of Artificial Sequence: Synthetic peptide
  XENP024257 vhCDR1
HYGMN

SEQ ID NO: 34697 - protein, 17 aa, Artificial Sequence
  Description of Artificial Sequence: Synthetic peptide
  XENP024257 vhCDR2
WINTYTSEPTYADGFTG

SEQ ID NO: 34698 - protein, 8 aa, Artificial Sequence
  Description of Artificial Sequence: Synthetic peptide
  XENP024257 vhCDR3
DYYGSSPY

SEQ ID NO: 34699 - protein, 16 aa, Artificial Sequence
  Description of Artificial Sequence: Synthetic peptide
  XENP024257 vlCDR1
KSSQSIVHSNGNTYLE

SEQ ID NO: 34700 - protein, 7 aa, Artificial Sequence
  Description of Artificial Sequence: Synthetic peptide
  XENP024257 vlCDR2
KVSNRFS

SEQ ID NO: 34701 - protein, 9 aa, Artificial Sequence
  Description of Artificial Sequence: Synthetic peptide
  XENP024257 vlCDR3
FQGSHVPNT

SEQ ID NO: 34702 - protein, 251 aa, Artificial Sequence
  Description of Artificial Sequence: Synthetic polypeptide
  XENP024258 1C11_H3.136_L3_scFv
QIQLVQSGSELKKPGASVKVSCKASGYTFTHYGMNWVRQAPGQGLEWMGWINTYTGSPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34703 - protein, 117 aa, Artificial Sequence
  Description of Artificial Sequence: Synthetic polypeptide
  VH of XENP024258
QIQLVQSGSELKKPGASVKVSCKASGYTFTHYGMNWVRQAPGQGLEWMGWINTYTGSPTYADGFTGRFVFSLDTSVSTAYLQISSLKAEDTAVYFCARDYYGSSPYWGQGTLVTVSS

SEQ ID NO: 34704 - protein, 114 aa, Artificial Sequence; identical to SEQ ID NO: 33651
  Description of Artificial Sequence: Synthetic polypeptide
  VL of XENP024258

SEQ ID NO: 34705 - protein, 5 aa, Artificial Sequence
  Description of Artificial Sequence: Synthetic peptide
  XENP024258 vhCDR1
HYGMN

SEQ ID NO: 34706 - protein, 17 aa, Artificial Sequence
  Description of Artificial Sequence: Synthetic peptide
  XENP024258 vhCDR2
WINTYTGSPTYADGFTG

SEQ ID NO: 34707 - protein, 8 aa, Artificial Sequence
  Description of Artificial Sequence: Synthetic peptide
  XENP024258 vhCDR3
DYYGSSPY

SEQ ID NO: 34708 - protein, 16 aa, Artificial Sequence
  Description of Artificial Sequence: Synthetic peptide
  XENP024258 vlCDR1
KSSQSIVHSNGNTYLE

SEQ ID NO: 34709 - protein, 7 aa, Artificial Sequence
  Description of Artificial Sequence: Synthetic peptide
  XENP024258 vlCDR2
KVSNRFS

SEQ ID NO: 34710 - protein, 9 aa, Artificial Sequence
  Description of Artificial Sequence: Synthetic peptide
  XENP024258 vlCDR3
FQGSHVPNT

SEQ ID NO: 34711 - protein, 251 aa, Artificial Sequence
  Description of Artificial Sequence: Synthetic polypeptide
  XENP024259 1C11_H3.137_L3_scFv
QIQLVQSGSELKKPGASVKVSCKASGYTFTHYGMNWVRQAPGQGLEWMGWINTYTGNPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34712 - protein, 117 aa, Artificial Sequence
  Description of Artificial Sequence: Synthetic polypeptide
  VH of XENP024259
QIQLVQSGSELKKPGASVKVSCKASGYTFTHYGMNWVRQAPGQGLEWMGWINTYTGNPTYADGFTGRFVFSLDTSVSTAYLQISSLKAEDTAVYFCARDYYGSSPYWGQGTLVTVSS

SEQ ID NO: 34713 - protein, 114 aa, Artificial Sequence; identical to SEQ ID NO: 33651
  Description of Artificial Sequence: Synthetic polypeptide
  VL of XENP024259

SEQ ID NO: 34714 - protein, 5 aa, Artificial Sequence
  Description of Artificial Sequence: Synthetic peptide
  XENP024259 vhCDR1
HYGMN

SEQ ID NO: 34715 - protein, 17 aa, Artificial Sequence
  Description of Artificial Sequence: Synthetic peptide
  XENP024259 vhCDR2
WINTYTGNPTYADGFTG

SEQ ID NO: 34716 - protein, 8 aa, Artificial Sequence
  Description of Artificial Sequence: Synthetic peptide
  XENP024259 vhCDR3
DYYGSSPY

SEQ ID NO: 34717 - protein, 16 aa, Artificial Sequence
  Description of Artificial Sequence: Synthetic peptide
  XENP024259 vlCDR1
KSSQSIVHSNGNTYLE

SEQ ID NO: 34718 - protein, 7 aa, Artificial Sequence
  Description of Artificial Sequence: Synthetic peptide
  XENP024259 vlCDR2
KVSNRFS

SEQ ID NO: 34719 - protein, 9 aa, Artificial Sequence
  Description of Artificial Sequence: Synthetic peptide
  XENP024259 vlCDR3
FQGSHVPNT

SEQ ID NO: 34720 - protein, 251 aa, Artificial Sequence
  Description of Artificial Sequence: Synthetic polypeptide
  XENP024260 1C11_H3.138_L3_scFv
QIQLVQSGSELKKPGASVKVSCKASGYTFTHYGMNWVRQAPGQGLEWMGWINTYTGDPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34721 - protein, 117 aa, Artificial Sequence
  Description of Artificial Sequence: Synthetic polypeptide
  VH of XENP024260
QIQLVQSGSELKKPGASVKVSCKASGYTFTHYGMNWVRQAPGQGLEWMGWINTYTGDPTYADGFTGRFVFSLDTSVSTAYLQISSLKAEDTAVYFCARDYYGSSPYWGQGTLVTVSS

SEQ ID NO: 34722 - protein, 114 aa, Artificial Sequence; identical to SEQ ID NO: 33651
  Description of Artificial Sequence: Synthetic polypeptide
  VL of XENP024260

SEQ ID NO: 34723 - protein, 5 aa, Artificial Sequence
  Description of Artificial Sequence: Synthetic peptide
  XENP024260 vhCDR1
HYGMN

SEQ ID NO: 34724 - protein, 17 aa, Artificial Sequence
  Description of Artificial Sequence: Synthetic peptide
  XENP024260 vhCDR2
WINTYTGDPTYADGFTG

SEQ ID NO: 34725 - protein, 8 aa, Artificial Sequence
  Description of Artificial Sequence: Synthetic peptide
  XENP024260 vhCDR3
DYYGSSPY

SEQ ID NO: 34726 - protein, 16 aa, Artificial Sequence
  Description of Artificial Sequence: Synthetic peptide
  XENP024260 vlCDR1
KSSQSIVHSNGNTYLE

SEQ ID NO: 34727 - protein, 7 aa, Artificial Sequence
  Description of Artificial Sequence: Synthetic peptide
  XENP024260 vlCDR2
KVSNRFS

SEQ ID NO: 34728 - protein, 9 aa, Artificial Sequence
  Description of Artificial Sequence: Synthetic peptide
  XENP024260 vlCDR3
FQGSHVPNT

SEQ ID NO: 34729 - protein, 251 aa, Artificial Sequence
  Description of Artificial Sequence: Synthetic polypeptide
  XENP024261 1C11_H3.139_L3_scFv
QIQLVQSGSELKKPGASVKVSCKASGYTFTHYGMNWVRQAPGQGLEWMGWINTYTGTPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34730 - protein, 117 aa, Artificial Sequence
  Description of Artificial Sequence: Synthetic polypeptide
  VH of XENP024261
QIQLVQSGSELKKPGASVKVSCKASGYTFTHYGMNWVRQAPGQGLEWMGWINTYTGTPTYADGFTGRFVFSLDTSVSTAYLQISSLKAEDTAVYFCARDYYGSSPYWGQGTLVTVSS

SEQ ID NO: 34731 - protein, 114 aa, Artificial Sequence; identical to SEQ ID NO: 33651
  Description of Artificial Sequence: Synthetic polypeptide
  VL of XENP024261

SEQ ID NO: 34732 - protein, 5 aa, Artificial Sequence
  Description of Artificial Sequence: Synthetic peptide
  XENP024261 vhCDR1
HYGMN

SEQ ID NO: 34733 - protein, 17 aa, Artificial Sequence
  Description of Artificial Sequence: Synthetic peptide
  XENP024261 vhCDR2
WINTYTGTPTYADGFTG

SEQ ID NO: 34734 - protein, 8 aa, Artificial Sequence
  Description of Artificial Sequence: Synthetic peptide
  XENP024261 vhCDR3
DYYGSSPY

SEQ ID NO: 34735 - protein, 16 aa, Artificial Sequence
  Description of Artificial Sequence: Synthetic peptide
  XENP024261 vlCDR1
KSSQSIVHSNGNTYLE

SEQ ID NO: 34736 - protein, 7 aa, Artificial Sequence
  Description of Artificial Sequence: Synthetic peptide
  XENP024261 vlCDR2
KVSNRFS

SEQ ID NO: 34737 - protein, 9 aa, Artificial Sequence
  Description of Artificial Sequence: Synthetic peptide
  XENP024261 vlCDR3
FQGSHVPNT

SEQ ID NO: 34738 - protein, 251 aa, Artificial Sequence
  Description of Artificial Sequence: Synthetic polypeptide
  XENP024262 1C11_H3.140_L3_scFv
QIQLVQSGSELKKPGASVKVSCKASGYTFTHYGMNWVRQAPGQGLEWMGWINTYTGYPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34739 - protein, 117 aa, Artificial Sequence
  Description of Artificial Sequence: Synthetic polypeptide
  VH of XENP024262
QIQLVQSGSELKKPGASVKVSCKASGYTFTHYGMNWVRQAPGQGLEWMGWINTYTGYPTYADGFTGRFVFSLDTSVSTAYLQISSLKAEDTAVYFCARDYYGSSPYWGQGTLVTVSS

SEQ ID NO: 34740 - protein, 114 aa, Artificial Sequence; identical to SEQ ID NO: 33651
  Description of Artificial Sequence: Synthetic polypeptide
  VL of XENP024262

SEQ ID NO: 34741 - protein, 5 aa, Artificial Sequence
  Description of Artificial Sequence: Synthetic peptide
  XENP024262 vhCDR1
HYGMN

SEQ ID NO: 34742 - protein, 17 aa, Artificial Sequence
  Description of Artificial Sequence: Synthetic peptide
  XENP024262 vhCDR2
WINTYTGYPTYADGFTG

SEQ ID NO: 34743 - protein, 8 aa, Artificial Sequence
  Description of Artificial Sequence: Synthetic peptide
  XENP024262 vhCDR3
DYYGSSPY

SEQ ID NO: 34744 - protein, 16 aa, Artificial Sequence
  Description of Artificial Sequence: Synthetic peptide
  XENP024262 vlCDR1
KSSQSIVHSNGNTYLE

SEQ ID NO: 34745 - protein, 7 aa, Artificial Sequence
  Description of Artificial Sequence: Synthetic peptide
  XENP024262 vlCDR2
KVSNRFS

SEQ ID NO: 34746 - protein, 9 aa, Artificial Sequence
  Description of Artificial Sequence: Synthetic peptide
  XENP024262 vlCDR3
FQGSHVPNT

SEQ ID NO: 34747 - protein, 251 aa, Artificial Sequence
  Description of Artificial Sequence: Synthetic polypeptide
  XENP024263 1C11_H3.143_L3_scFv
QIQLVQSGSELKKPGASVKVSCKASGYTFTHYGMNWVRQAPGQGLEWMGWINTYTGEPYYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34748 - protein, 117 aa, Artificial Sequence
  Description of Artificial Sequence: Synthetic polypeptide
  VH of XENP024263
QIQLVQSGSELKKPGASVKVSCKASGYTFTHYGMNWVRQAPGQGLEWMGWINTYTGEPYYADGFTGRFVFSLDTSVSTAYLQISSLKAEDTAVYFCARDYYGSSPYWGQGTLVTVSS

SEQ ID NO: 34749 - protein, 114 aa, Artificial Sequence; identical to SEQ ID NO: 33651
  Description of Artificial Sequence: Synthetic polypeptide
  VL of XENP024263

SEQ ID NO: 34750 - protein, 5 aa, Artificial Sequence
  Description of Artificial Sequence: Synthetic peptide
  XENP024263 vhCDR1
HYGMN

SEQ ID NO: 34751 - protein, 17 aa, Artificial Sequence
  Description of Artificial Sequence: Synthetic peptide
  XENP024263 vhCDR2
WINTYTGEPYYADGFTG

SEQ ID NO: 34752 - protein, 8 aa, Artificial Sequence
  Description of Artificial Sequence: Synthetic peptide
  XENP024263 vhCDR3
DYYGSSPY

SEQ ID NO: 34753 - protein, 16 aa, Artificial Sequence
  Description of Artificial Sequence: Synthetic peptide
  XENP024263 vlCDR1
KSSQSIVHSNGNTYLE

SEQ ID NO: 34754 - protein, 7 aa, Artificial Sequence
  Description of Artificial Sequence: Synthetic peptide
  XENP024263 vlCDR2
KVSNRFS

SEQ ID NO: 34755 - protein, 9 aa, Artificial Sequence
  Description of Artificial Sequence: Synthetic peptide
  XENP024263 vlCDR3
FQGSHVPNT

SEQ ID NO: 34756 - protein, 251 aa, Artificial Sequence
  Description of Artificial Sequence: Synthetic polypeptide
  XENP024264 1C11_H3.144_L3_scFv
QIQLVQSGSELKKPGASVKVSCKASGYTFTHYGMNWVRQAPGQGLEWMGWINTYTGEPNYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34757 - protein, 117 aa, Artificial Sequence
  Description of Artificial Sequence: Synthetic polypeptide
  VH of XENP024264
QIQLVQSGSELKKPGASVKVSCKASGYTFTHYGMNWVRQAPGQGLEWMGWINTYTGEPNYADGFTGRFVFSLDTSVSTAYLQISSLKAEDTAVYFCARDYYGSSPYWGQGTLVTVSS

SEQ ID NO: 34758 - protein, 114 aa, Artificial Sequence; identical to SEQ ID NO: 33651
  Description of Artificial Sequence: Synthetic polypeptide
  VL of XENP024264

SEQ ID NO: 34759 - protein, 5 aa, Artificial Sequence
  Description of Artificial Sequence: Synthetic peptide
  XENP024264 vhCDR1
HYGMN

SEQ ID NO: 34760 - protein, 17 aa, Artificial Sequence
  Description of Artificial Sequence: Synthetic peptide
  XENP024264 vhCDR2
WINTYTGEPNYADGFTG

SEQ ID NO: 34761 - protein, 8 aa, Artificial Sequence
  Description of Artificial Sequence: Synthetic peptide
  XENP024264 vhCDR3
DYYGSSPY

SEQ ID NO: 34762 - protein, 16 aa, Artificial Sequence
  Description of Artificial Sequence: Synthetic peptide
  XENP024264 vlCDR1
KSSQSIVHSNGNTYLE

SEQ ID NO: 34763 - protein, 7 aa, Artificial Sequence
  Description of Artificial Sequence: Synthetic peptide
  XENP024264 vlCDR2
KVSNRFS

SEQ ID NO: 34764 - protein, 9 aa, Artificial Sequence
  Description of Artificial Sequence: Synthetic peptide
  XENP024264 vlCDR3
FQGSHVPNT

SEQ ID NO: 34765 - protein, 251 aa, Artificial Sequence
  Description of Artificial Sequence: Synthetic polypeptide
  XENP024265 1C11_H3.145_L3_scFv
QIQLVQSGSELKKPGASVKVSCKASGYTFTHYGMNWVRQAPGQGLEWMGWINTYTGEPTYSDGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34766 - protein, 117 aa, Artificial Sequence
  Description of Artificial Sequence: Synthetic polypeptide
  VH of XENP024265
QIQLVQSGSELKKPGASVKVSCKASGYTFTHYGMNWVRQAPGQGLEWMGWINTYTGEPTYSDGFTGRFVFSLDTSVSTAYLQISSLKAEDTAVYFCARDYYGSSPYWGQGTLVTVSS

SEQ ID NO: 34767 - protein, 114 aa, Artificial Sequence; identical to SEQ ID NO: 33651
  Description of Artificial Sequence: Synthetic polypeptide
  VL of XENP024265

SEQ ID NO: 34768 - protein, 5 aa, Artificial Sequence
  Description of Artificial Sequence: Synthetic peptide
  XENP024265 vhCDR1
HYGMN

SEQ ID NO: 34769 - protein, 17 aa, Artificial Sequence
  Description of Artificial Sequence: Synthetic peptide
  XENP024265 vhCDR2
WINTYTGEPTYSDGFTG

SEQ ID NO: 34770 - protein, 8 aa, Artificial Sequence
  Description of Artificial Sequence: Synthetic peptide
  XENP024265 vhCDR3
DYYGSSPY

SEQ ID NO: 34771 - protein, 16 aa, Artificial Sequence
  Description of Artificial Sequence: Synthetic peptide
  XENP024265 vlCDR1
KSSQSIVHSNGNTYLE

SEQ ID NO: 34772 - protein, 7 aa, Artificial Sequence
  Description of Artificial Sequence: Synthetic peptide
  XENP024265 vlCDR2
KVSNRFS

SEQ ID NO: 34773 - protein, 9 aa, Artificial Sequence
  Description of Artificial Sequence: Synthetic peptide
  XENP024265 vlCDR3
FQGSHVPNT

SEQ ID NO: 34774 - protein, 251 aa, Artificial Sequence
  Description of Artificial Sequence: Synthetic polypeptide
  XENP024266 1C11_H3.146_L3_scFv
QIQLVQSGSELKKPGASVKVSCKASGYTFTHYGMNWVRQAPGQGLEWMGWINTYTGEPTYAPGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34775 - protein, 117 aa, Artificial Sequence
  Description of Artificial Sequence: Synthetic polypeptide
  VH of XENP024266
QIQLVQSGSELKKPGASVKVSCKASGYTFTHYGMNWVRQAPGQGLEWMGWINTYTGEPTYAPGFTGRFVFSLDTSVSTAYLQISSLKAEDTAVYFCARDYYGSSPYWGQGTLVTVSS

SEQ ID NO: 34776 - protein, 114 aa, Artificial Sequence; identical to SEQ ID NO: 33651
  Description of Artificial Sequence: Synthetic polypeptide
  VL of XENP024266

SEQ ID NO: 34777 - protein, 5 aa, Artificial Sequence
  Description of Artificial Sequence: Synthetic peptide
  XENP024266 vhCDR1
HYGMN

SEQ ID NO: 34778 - protein, 17 aa, Artificial Sequence
  Description of Artificial Sequence: Synthetic peptide
  XENP024266 vhCDR2
WINTYTGEPTYAPGFTG

SEQ ID NO: 34779 - protein, 8 aa, Artificial Sequence
  Description of Artificial Sequence: Synthetic peptide
  XENP024266 vhCDR3
DYYGSSPY

SEQ ID NO: 34780 - protein, 16 aa, Artificial Sequence
  Description of Artificial Sequence: Synthetic peptide
  XENP024266 vlCDR1
KSSQSIVHSNGNTYLE

SEQ ID NO: 34781 - protein, 7 aa, Artificial Sequence
  Description of Artificial Sequence: Synthetic peptide
  XENP024266 vlCDR2
KVSNRFS

SEQ ID NO: 34782 - protein, 9 aa, Artificial Sequence
  Description of Artificial Sequence: Synthetic peptide
  XENP024266 vlCDR3
FQGSHVPNT

SEQ ID NO: 34783 - protein, 251 aa, Artificial Sequence
  Description of Artificial Sequence: Synthetic polypeptide
  XENP024267 1C11_H3.147_L3_scFv
QIQLVQSGSELKKPGASVKVSCKASGYTFTHYGMNWVRQAPGQGLEWMGWINTYTGEPTYATGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34784 - protein, 117 aa, Artificial Sequence
  Description of Artificial Sequence: Synthetic polypeptide
  VH of XENP024267
QIQLVQSGSELKKPGASVKVSCKASGYTFTHYGMNWVRQAPGQGLEWMGWINTYTGEPTYATGFTGRFVFSLDTSVSTAYLQISSLKAEDTAVYFCARDYYGSSPYWGQGTLVTVSS

SEQ ID NO: 34785 - protein, 114 aa, Artificial Sequence; identical to SEQ ID NO: 33651
  Description of Artificial Sequence: Synthetic polypeptide
  VL of XENP024267

SEQ ID NO: 34786 - protein, 5 aa, Artificial Sequence
  Description of Artificial Sequence: Synthetic peptide
  XENP024267 vhCDR1
HYGMN

SEQ ID NO: 34787 - protein, 17 aa, Artificial Sequence
  Description of Artificial Sequence: Synthetic peptide
  XENP024267 vhCDR2
WINTYTGEPTYATGFTG

SEQ ID NO: 34788 - protein, 8 aa, Artificial Sequence
  Description of Artificial Sequence: Synthetic peptide
  XENP024267 vhCDR3
DYYGSSPY

SEQ ID NO: 34789 - protein, 16 aa, Artificial Sequence
  Description of Artificial Sequence: Synthetic peptide
  XENP024267 vlCDR1
KSSQSIVHSNGNTYLE

SEQ ID NO: 34790 - protein, 7 aa, Artificial Sequence
  Description of Artificial Sequence: Synthetic peptide
  XENP024267 vlCDR2
KVSNRFS

SEQ ID NO: 34791 - protein, 9 aa, Artificial Sequence
  Description of Artificial Sequence: Synthetic peptide
  XENP024267 vlCDR3
FQGSHVPNT

SEQ ID NO: 34792 - protein, 251 aa, Artificial Sequence
  Description of Artificial Sequence: Synthetic polypeptide
  XENP024268 1C11_H3.148_L3_scFv
QIQLVQSGSELKKPGASVKVSCKASGYTFTHYGMNWVRQAPGQGLEWMGWINTYTGEPTYAQKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34793 - protein, 117 aa, Artificial Sequence
  Description of Artificial Sequence: Synthetic polypeptide
  VH of XENP024268
QIQLVQSGSELKKPGASVKVSCKASGYTFTHYGMNWVRQAPGQGLEWMGWINTYTGEPTYAQKFTGRFVFSLDTSVSTAYLQISSLKAEDTAVYFCARDYYGSSPYWGQGTLVTVSS

SEQ ID NO: 34794 - protein, 114 aa, Artificial Sequence; identical to SEQ ID NO: 33651
  Description of Artificial Sequence: Synthetic polypeptide
  VL of XENP024268

SEQ ID NO: 34795 - protein, 5 aa, Artificial Sequence
  Description of Artificial Sequence: Synthetic peptide
  XENP024268 vhCDR1
HYGMN

SEQ ID NO: 34796 - protein, 17 aa, Artificial Sequence
  Description of Artificial Sequence: Synthetic peptide
  XENP024268 vhCDR2
WINTYTGEPTYAQKFTG

SEQ ID NO: 34797 - protein, 8 aa, Artificial Sequence
  Description of Artificial Sequence: Synthetic peptide
  XENP024268 vhCDR3
DYYGSSPY

SEQ ID NO: 34798 - protein, 16 aa, Artificial Sequence
  Description of Artificial Sequence: Synthetic peptide
  XENP024268 vlCDR1
KSSQSIVHSNGNTYLE

SEQ ID NO: 34799 - protein, 7 aa, Artificial Sequence
  Description of Artificial Sequence: Synthetic peptide
  XENP024268 vlCDR2
KVSNRFS

SEQ ID NO: 34800 - protein, 9 aa, Artificial Sequence
  Description of Artificial Sequence: Synthetic peptide
  XENP024268 vlCDR3
FQGSHVPNT

SEQ ID NO: 34801 - protein, 251 aa, Artificial Sequence
  Description of Artificial Sequence: Synthetic polypeptide
  XENP024269 1C11_H3.149_L3_scFv
QIQLVQSGSELKKPGASVKVSCKASGYTFTHYGMNWVRQAPGQGLEWMGWINTYTGEPTYADGFTDRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34802 - protein, 117 aa, Artificial Sequence
  Description of Artificial Sequence: Synthetic polypeptide
  VH of XENP024269
QIQLVQSGSELKKPGASVKVSCKASGYTFTHYGMNWVRQAPGQGLEWMGWINTYTGEPTYADGFTDRFVFSLDTSVSTAYLQISSLKAEDTAVYFCARDYYGSSPYWGQGTLVTVSS

SEQ ID NO: 34803 - protein, 114 aa, Artificial Sequence; identical to SEQ ID NO: 33651
  Description of Artificial Sequence: Synthetic polypeptide
  VL of XENP024269

SEQ ID NO: 34804 - protein, 5 aa, Artificial Sequence
  Description of Artificial Sequence: Synthetic peptide
  XENP024269 vhCDR1
HYGMN

SEQ ID NO: 34805 - protein, 17 aa, Artificial Sequence
  Description of Artificial Sequence: Synthetic peptide
  XENP024269 vhCDR2
WINTYTGEPTYADGFTD

SEQ ID NO: 34806 - protein, 8 aa, Artificial Sequence
  Description of Artificial Sequence: Synthetic peptide
  XENP024269 vhCDR3
DYYGSSPY

SEQ ID NO: 34807 - protein, 16 aa, Artificial Sequence
  Description of Artificial Sequence: Synthetic peptide
  XENP024269 vlCDR1
KSSQSIVHSNGNTYLE

SEQ ID NO: 34808 - protein, 7 aa, Artificial Sequence
  Description of Artificial Sequence: Synthetic peptide
  XENP024269 vlCDR2
KVSNRFS

SEQ ID NO: 34809 - protein, 9 aa, Artificial Sequence
  Description of Artificial Sequence: Synthetic peptide
  XENP024269 vlCDR3
FQGSHVPNT

SEQ ID NO: 34810 - protein, 251 aa, Artificial Sequence
  Description of Artificial Sequence: Synthetic polypeptide
  XENP024270 1C11_H3.150_L3_scFv
QIQLVQSGSELKKPGASVKVSCKASGYTFTHYGMNWVRQAPGQGLEWMGWINTYTGEPTYADGFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34811 - protein, 117 aa, Artificial Sequence
  Description of Artificial Sequence: Synthetic polypeptide
  VH of XENP024270
QIQLVQSGSELKKPGASVKVSCKASGYTFTHYGMNWVRQAPGQGLEWMGWINTYTGEPTYADGFTERFVFSLDTSVSTAYLQISSLKAEDTAVYFCARDYYGSSPYWGQGTLVTVSS

SEQ ID NO: 34812 - protein, 114 aa, Artificial Sequence; identical to SEQ ID NO: 33651
  Description of Artificial Sequence: Synthetic polypeptide
  VL of XENP024270

SEQ ID NO: 34813 - protein, 5 aa, Artificial Sequence
  Description of Artificial Sequence: Synthetic peptide
  XENP024270 vhCDR1
HYGMN

SEQ ID NO: 34814 - protein, 17 aa, Artificial Sequence
  Description of Artificial Sequence: Synthetic peptide
  XENP024270 vhCDR2
WINTYTGEPTYADGFTE

SEQ ID NO: 34815 - protein, 8 aa, Artificial Sequence
  Description of Artificial Sequence: Synthetic peptide
  XENP024270 vhCDR3
DYYGSSPY

SEQ ID NO: 34816 - protein, 16 aa, Artificial Sequence
  Description of Artificial Sequence: Synthetic peptide
  XENP024270 vlCDR1
KSSQSIVHSNGNTYLE

SEQ ID NO: 34817 - protein, 7 aa, Artificial Sequence
  Description of Artificial Sequence: Synthetic peptide
  XENP024270 vlCDR2
KVSNRFS

SEQ ID NO: 34818 - protein, 9 aa, Artificial Sequence
  Description of Artificial Sequence: Synthetic peptide
  XENP024270 vlCDR3
FQGSHVPNT

SEQ ID NO: 34819 - protein, 251 aa, Artificial Sequence
  Description of Artificial Sequence: Synthetic polypeptide
  XENP024271 1C11_H3.151_L3_scFv
QIQLVQSGSELKKPGASVKVSCKASGYTFTHYGMNWVRQAPGQGLEWMGWINTYTGEPTYADGFTSRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34820 - protein, 117 aa, Artificial Sequence
  Description of Artificial Sequence: Synthetic polypeptide
  VH of XENP024271
QIQLVQSGSELKKPGASVKVSCKASGYTFTHYGMNWVRQAPGQGLEWMGWINTYTGEPTYADGFTSRFVFSLDTSVSTAYLQISSLKAEDTAVYFCARDYYGSSPYWGQGTLVTVSS

SEQ ID NO: 34821 - protein, 114 aa, Artificial Sequence; identical to SEQ ID NO: 33651
  Description of Artificial Sequence: Synthetic polypeptide
  VL of XENP024271

SEQ ID NO: 34822 - protein, 5 aa, Artificial Sequence
  Description of Artificial Sequence: Synthetic peptide
  XENP024271 vhCDR1
HYGMN

SEQ ID NO: 34823 - protein, 17 aa, Artificial Sequence
  Description of Artificial Sequence: Synthetic peptide
  XENP024271 vhCDR2
WINTYTGEPTYADGFTS

SEQ ID NO: 34824 - protein, 8 aa, Artificial Sequence
  Description of Artificial Sequence: Synthetic peptide
  XENP024271 vhCDR3
DYYGSSPY

SEQ ID NO: 34825 - protein, 16 aa, Artificial Sequence
  Description of Artificial Sequence: Synthetic peptide
  XENP024271 vlCDR1
KSSQSIVHSNGNTYLE

SEQ ID NO: 34826 - protein, 7 aa, Artificial Sequence
  Description of Artificial Sequence: Synthetic peptide
  XENP024271 vlCDR2
KVSNRFS

SEQ ID NO: 34827 - protein, 9 aa, Artificial Sequence
  Description of Artificial Sequence: Synthetic peptide
  XENP024271 vlCDR3
FQGSHVPNT

SEQ ID NO: 34828 - protein, 251 aa, Artificial Sequence
  Description of Artificial Sequence: Synthetic polypeptide
  XENP024272 1C11_H3.152_L3_scFv
QIQLVQSGSELKKPGASVKVSCKASGYTFTHYGMNWVRQAPGQGLEWMGWINTYTGEPTYADGFTGRFVFTLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34829 - protein, 117 aa, Artificial Sequence
  Description of Artificial Sequence: Synthetic polypeptide
  VH of XENP024272
QIQLVQSGSELKKPGASVKVSCKASGYTFTHYGMNWVRQAPGQGLEWMGWINTYTGEPTYADGFTGRFVFTLDTSVSTAYLQISSLKAEDTAVYFCARDYYGSSPYWGQGTLVTVSS

SEQ ID NO: 34830 - protein, 114 aa, Artificial Sequence; identical to SEQ ID NO: 33651
  Description of Artificial Sequence: Synthetic polypeptide
  VL of XENP024272

SEQ ID NO: 34831 - protein, 5 aa, Artificial Sequence
  Description of Artificial Sequence: Synthetic peptide
  XENP024272 vhCDR1
HYGMN

SEQ ID NO: 34832 - protein, 17 aa, Artificial Sequence
  Description of Artificial Sequence: Synthetic peptide
  XENP024272 vhCDR2
WINTYTGEPTYADGFTG

SEQ ID NO: 34833 - protein, 8 aa, Artificial Sequence
  Description of Artificial Sequence: Synthetic peptide
  XENP024272 vhCDR3
DYYGSSPY

SEQ ID NO: 34834 - protein, 16 aa, Artificial Sequence
  Description of Artificial Sequence: Synthetic peptide
  XENP024272 vlCDR1
KSSQSIVHSNGNTYLE

SEQ ID NO: 34835 - protein, 7 aa, Artificial Sequence
  Description of Artificial Sequence: Synthetic peptide
  XENP024272 vlCDR2
KVSNRFS

SEQ ID NO: 34836 - protein, 9 aa, Artificial Sequence
  Description of Artificial Sequence: Synthetic peptide
  XENP024272 vlCDR3
FQGSHVPNT

SEQ ID NO: 34837 - protein, 251 aa, Artificial Sequence
  Description of Artificial Sequence: Synthetic polypeptide
  XENP024273 1C11_H3.153_L3_scFv
QIQLVQSGSELKKPGASVKVSCKASGYTFTHYGMNWVRQAPGQGLEWMGWINTYTGEPTYADGFTGRFVFSTDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34838 - protein, 117 aa, Artificial Sequence
  Description of Artificial Sequence: Synthetic polypeptide
  VH of XENP024273
QIQLVQSGSELKKPGASVKVSCKASGYTFTHYGMNWVRQAPGQGLEWMGWINTYTGEPTYADGFTGRFVFSTDTSVSTAYLQISSLKAEDTAVYFCARDYYGSSPYWGQGTLVTVSS

SEQ ID NO: 34839 - protein, 114 aa, Artificial Sequence; identical to SEQ ID NO: 33651
  Description of Artificial Sequence: Synthetic polypeptide
  VL of XENP024273

SEQ ID NO: 34840 - protein, 5 aa, Artificial Sequence
  Description of Artificial Sequence: Synthetic peptide
  XENP024273 vhCDR1
HYGMN

SEQ ID NO: 34841 - protein, 17 aa, Artificial Sequence
  Description of Artificial Sequence: Synthetic peptide
  XENP024273 vhCDR2
WINTYTGEPTYADGFTG

SEQ ID NO: 34842 - protein, 8 aa, Artificial Sequence
  Description of Artificial Sequence: Synthetic peptide
  XENP024273 vhCDR3
DYYGSSPY

SEQ ID NO: 34843 - protein, 16 aa, Artificial Sequence
  Description of Artificial Sequence: Synthetic peptide
  XENP024273 vlCDR1
KSSQSIVHSNGNTYLE

SEQ ID NO: 34844 - protein, 7 aa, Artificial Sequence
  Description of Artificial Sequence: Synthetic peptide
  XENP024273 vlCDR2
KVSNRFS

SEQ ID NO: 34845 - protein, 9 aa, Artificial Sequence
  Description of Artificial Sequence: Synthetic peptide
  XENP024273 vlCDR3
FQGSHVPNT

SEQ ID NO: 34846 - protein, 251 aa, Artificial Sequence
  Description of Artificial Sequence: Synthetic polypeptide
  XENP024274 1C11_H3.154_L3_scFv
QIQLVQSGSELKKPGASVKVSCKASGYTFTHYGMNWVRQAPGQGLEWMGWINTYTGEPTYADGFTGRFVFSIDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34847 - protein, 117 aa, Artificial Sequence
  Description of Artificial Sequence: Synthetic polypeptide
  VH of XENP024274
QIQLVQSGSELKKPGASVKVSCKASGYTFTHYGMNWVRQAPGQGLEWMGWINTYTGEPTYADGFTGRFVFSIDTSVSTAYLQISSLKAEDTAVYFCARDYYGSSPYWGQGTLVTVSS

SEQ ID NO: 34848 - protein, 114 aa, Artificial Sequence; identical to SEQ ID NO: 33651
  Description of Artificial Sequence: Synthetic polypeptide
  VL of XENP024274

SEQ ID NO: 34849 - protein, 5 aa, Artificial Sequence
  Description of Artificial Sequence: Synthetic peptide
  XENP024274 vhCDR1
HYGMN

SEQ ID NO: 34850 - protein, 17 aa, Artificial Sequence
  Description of Artificial Sequence: Synthetic peptide
  XENP024274 vhCDR2
WINTYTGEPTYADGFTG

SEQ ID NO: 34851 - protein, 8 aa, Artificial Sequence
  Description of Artificial Sequence: Synthetic peptide
  XENP024274 vhCDR3
DYYGSSPY

SEQ ID NO: 34852 - protein, 16 aa, Artificial Sequence
  Description of Artificial Sequence: Synthetic peptide
  XENP024274 vlCDR1
KSSQSIVHSNGNTYLE

SEQ ID NO: 34853 - protein, 7 aa, Artificial Sequence
  Description of Artificial Sequence: Synthetic peptide
  XENP024274 vlCDR2
KVSNRFS

SEQ ID NO: 34854 - protein, 9 aa, Artificial Sequence
  Description of Artificial Sequence: Synthetic peptide
  XENP024274 vlCDR3
FQGSHVPNT

SEQ ID NO: 34855 - protein, 251 aa, Artificial Sequence
  Description of Artificial Sequence: Synthetic polypeptide
  XENP024275 1C11_H3.155_L3_scFv
QIQLVQSGSELKKPGASVKVSCKASGYTFTHYGMNWVRQAPGQGLEWMGWINTYTGEPTYADGFTGRFVFSLDNSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34856 - protein, 117 aa, Artificial Sequence
  Description of Artificial Sequence: Synthetic polypeptide
  VH of XENP024275
QIQLVQSGSELKKPGASVKVSCKASGYTFTHYGMNWVRQAPGQGLEWMGWINTYTGEPTYADGFTGRFVFSLDNSVSTAYLQISSLKAEDTAVYFCARDYYGSSPYWGQGTLVTVSS

SEQ ID NO: 34857 - protein, 114 aa, Artificial Sequence; identical to SEQ ID NO: 33651
  Description of Artificial Sequence: Synthetic polypeptide
  VL of XENP024275

SEQ ID NO: 34858 - protein, 5 aa, Artificial Sequence
  Description of Artificial Sequence: Synthetic peptide
  XENP024275 vhCDR1
HYGMN

SEQ ID NO: 34859 - protein, 17 aa, Artificial Sequence
  Description of Artificial Sequence: Synthetic peptide
  XENP024275 vhCDR2
WINTYTGEPTYADGFTG

SEQ ID NO: 34860 - protein, 8 aa, Artificial Sequence
  Description of Artificial Sequence: Synthetic peptide
  XENP024275 vhCDR3
DYYGSSPY

SEQ ID NO: 34861 - protein, 16 aa, Artificial Sequence
  Description of Artificial Sequence: Synthetic peptide
  XENP024275 vlCDR1
KSSQSIVHSNGNTYLE

SEQ ID NO: 34862 - protein, 7 aa, Artificial Sequence
  Description of Artificial Sequence: Synthetic peptide
  XENP024275 vlCDR2
KVSNRFS

SEQ ID NO: 34863 - protein, 9 aa, Artificial Sequence
  Description of Artificial Sequence: Synthetic peptide
  XENP024275 vlCDR3
FQGSHVPNT

SEQ ID NO: 34864 - protein, 251 aa, Artificial Sequence
  Description of Artificial Sequence: Synthetic polypeptide
  XENP024276 1C11_H3.156_L3_scFv
QIQLVQSGSELKKPGASVKVSCKASGYTFTHYGMNWVRQAPGQGLEWMGWINTYTGEPTYADGFTGRFVFSLDRSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34865 - protein, 117 aa, Artificial Sequence
  Description of Artificial Sequence: Synthetic polypeptide
  VH of XENP024276
QIQLVQSGSELKKPGASVKVSCKASGYTFTHYGMNWVRQAPGQGLEWMGWINTYTGEPTYADGFTGRFVFSLDRSVSTAYLQISSLKAEDTAVYFCARDYYGSSPYWGQGTLVTVSS

SEQ ID NO: 34866 - protein, 114 aa, Artificial Sequence; identical to SEQ ID NO: 33651
  Description of Artificial Sequence: Synthetic polypeptide
  VL of XENP024276

SEQ ID NO: 34867 - protein, 5 aa, Artificial Sequence
  Description of Artificial Sequence: Synthetic peptide
  XENP024276 vhCDR1
HYGMN

SEQ ID NO: 34868 - protein, 17 aa, Artificial Sequence
  Description of Artificial Sequence: Synthetic peptide
  XENP024276 vhCDR2
WINTYTGEPTYADGFTG

SEQ ID NO: 34869 - protein, 8 aa, Artificial Sequence
  Description of Artificial Sequence: Synthetic peptide
  XENP024276 vhCDR3
DYYGSSPY

SEQ ID NO: 34870 - protein, 16 aa, Artificial Sequence
  Description of Artificial Sequence: Synthetic peptide
  XENP024276 vlCDR1
KSSQSIVHSNGNTYLE

SEQ ID NO: 34871 - protein, 7 aa, Artificial Sequence
  Description of Artificial Sequence: Synthetic peptide
  XENP024276 vlCDR2
KVSNRFS

SEQ ID NO: 34872 - protein, 9 aa, Artificial Sequence
  Description of Artificial Sequence: Synthetic peptide
  XENP024276 vlCDR3
FQGSHVPNT

SEQ ID NO: 34873 - protein, 251 aa, Artificial Sequence
  Description of Artificial Sequence: Synthetic polypeptide
  XENP024277 1C11_H3.157_L3_scFv
QIQLVQSGSELKKPGASVKVSCKASGYTFTHYGMNWVRQAPGQGLEWMGWINTYTGEPTYADGFTGRFVFSLDTAVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34874 - protein, 117 aa, Artificial Sequence
  Description of Artificial Sequence: Synthetic polypeptide
  VH of XENP024277
QIQLVQSGSELKKPGASVKVSCKASGYTFTHYGMNWVRQAPGQGLEWMGWINTYTGEPTYADGFTGRFVFSLDTAVSTAYLQISSLKAEDTAVYFCARDYYGSSPYWGQGTLVTVSS

SEQ ID NO: 34875 - protein, 114 aa, Artificial Sequence; identical to SEQ ID NO: 33651
  Description of Artificial Sequence: Synthetic polypeptide
  VL of XENP024277

SEQ ID NO: 34876 - protein, 5 aa, Artificial Sequence
  Description of Artificial Sequence: Synthetic peptide
  XENP024277 vhCDR1
HYGMN

SEQ ID NO: 34877 - protein, 17 aa, Artificial Sequence
  Description of Artificial Sequence: Synthetic peptide
  XENP024277 vhCDR2
WINTYTGEPTYADGFTG

SEQ ID NO: 34878 - protein, 8 aa, Artificial Sequence
  Description of Artificial Sequence: Synthetic peptide
  XENP024277 vhCDR3
DYYGSSPY

SEQ ID NO: 34879 - protein, 16 aa, Artificial Sequence
  Description of Artificial Sequence: Synthetic peptide
  XENP024277 vlCDR1
KSSQSIVHSNGNTYLE

SEQ ID NO: 34880 - protein, 7 aa, Artificial Sequence
  Description of Artificial Sequence: Synthetic peptide
  XENP024277 vlCDR2
KVSNRFS

SEQ ID NO: 34881 - protein, 9 aa, Artificial Sequence
  Description of Artificial Sequence: Synthetic peptide
  XENP024277 vlCDR3
FQGSHVPNT

SEQ ID NO: 34882 - protein, 251 aa, Artificial Sequence
  Description of Artificial Sequence: Synthetic polypeptide
  XENP024278 1C11_H3.158_L3_scFv
QIQLVQSGSELKKPGASVKVSCKASGYTFTHYGMNWVRQAPGQGLEWMGWINTYTGEPTYADGFTGRFVFSLDTSVNTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34883 - protein, 117 aa, Artificial Sequence
  Description of Artificial Sequence: Synthetic polypeptide
  VH of XENP024278
QIQLVQSGSELKKPGASVKVSCKASGYTFTHYGMNWVRQAPGQGLEWMGWINTYTGEPTYADGFTGRFVFSLDTSVNTAYLQISSLKAEDTAVYFCARDYYGSSPYWGQGTLVTVSS

SEQ ID NO: 34884 - protein, 114 aa, Artificial Sequence; identical to SEQ ID NO: 33651
  Description of Artificial Sequence: Synthetic polypeptide
  VL of XENP024278

SEQ ID NO: 34885 - protein, 5 aa, Artificial Sequence
  Description of Artificial Sequence: Synthetic peptide
  XENP024278 vhCDR1
HYGMN

SEQ ID NO: 34886 - protein, 17 aa, Artificial Sequence
  Description of Artificial Sequence: Synthetic peptide
  XENP024278 vhCDR2
WINTYTGEPTYADGFTG

SEQ ID NO: 34887 - protein, 8 aa, Artificial Sequence
  Description of Artificial Sequence: Synthetic peptide
  XENP024278 vhCDR3
DYYGSSPY

SEQ ID NO: 34888 - protein, 16 aa, Artificial Sequence
  Description of Artificial Sequence: Synthetic peptide
  XENP024278 vlCDR1
KSSQSIVHSNGNTYLE

SEQ ID NO: 34889 - protein, 7 aa, Artificial Sequence
  Description of Artificial Sequence: Synthetic peptide
  XENP024278 vlCDR2
KVSNRFS

SEQ ID NO: 34890 - protein, 9 aa, Artificial Sequence
  Description of Artificial Sequence: Synthetic peptide
  XENP024278 vlCDR3
FQGSHVPNT

SEQ ID NO: 34891 - protein, 251 aa, Artificial Sequence
  Description of Artificial Sequence: Synthetic polypeptide
  XENP024279 1C11_H3.159_L3_scFv
QIQLVQSGSELKKPGASVKVSCKASGYTFTHYGMNWVRQAPGQGLEWMGWINTYTGEPTYADGFTGRFVFSLDTSVDTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34892 - protein, 117 aa, Artificial Sequence
  Description of Artificial Sequence: Synthetic polypeptide
  VH of XENP024279
QIQLVQSGSELKKPGASVKVSCKASGYTFTHYGMNWVRQAPGQGLEWMGWINTYTGEPTYADGFTGRFVFSLDTSVDTAYLQISSLKAEDTAVYFCARDYYGSSPYWGQGTLVTVSS

SEQ ID NO: 34893 - protein, 114 aa, Artificial Sequence; identical to SEQ ID NO: 33651
  Description of Artificial Sequence: Synthetic polypeptide
  VL of XENP024279

SEQ ID NO: 34894 - protein, 5 aa, Artificial Sequence
  Description of Artificial Sequence: Synthetic peptide
  XENP024279 vhCDR1
HYGMN

SEQ ID NO: 34895 - protein, 17 aa, Artificial Sequence
  Description of Artificial Sequence: Synthetic peptide
  XENP024279 vhCDR2
WINTYTGEPTYADGFTG

SEQ ID NO: 34896 - protein, 8 aa, Artificial Sequence
  Description of Artificial Sequence: Synthetic peptide
  XENP024279 vhCDR3
DYYGSSPY

SEQ ID NO: 34897 - protein, 16 aa, Artificial Sequence
  Description of Artificial Sequence: Synthetic peptide
  XENP024279 vlCDR1
KSSQSIVHSNGNTYLE

SEQ ID NO: 34898 - protein, 7 aa, Artificial Sequence
  Description of Artificial Sequence: Synthetic peptide
  XENP024279 vlCDR2
KVSNRFS

SEQ ID NO: 34899 - protein, 9 aa, Artificial Sequence
  Description of Artificial Sequence: Synthetic peptide
  XENP024279 vlCDR3
FQGSHVPNT

SEQ ID NO: 34900 - protein, 251 aa, Artificial Sequence
  Description of Artificial Sequence: Synthetic polypeptide
  XENP024280 1C11_H3.160_L3_scFv
QIQLVQSGSELKKPGASVKVSCKASGYTFTHYGMNWVRQAPGQGLEWMGWINTYTGEPTYADGFTGRFVFSLDTSVSQAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34901 - protein, 117 aa, Artificial Sequence
  Description of Artificial Sequence: Synthetic polypeptide
  VH of XENP024280
QIQLVQSGSELKKPGASVKVSCKASGYTFTHYGMNWVRQAPGQGLEWMGWINTYTGEPTYADGFTGRFVFSLDTSVSQAYLQISSLKAEDTAVYFCARDYYGSSPYWGQGTLVTVSS

SEQ ID NO: 34902 - protein, 114 aa, Artificial Sequence; identical to SEQ ID NO: 33651
  Description of Artificial Sequence: Synthetic polypeptide
  VL of XENP024280

SEQ ID NO: 34903 - protein, 5 aa, Artificial Sequence
  Description of Artificial Sequence: Synthetic peptide
  XENP024280 vhCDR1
HYGMN

SEQ ID NO: 34904 - protein, 17 aa, Artificial Sequence
  Description of Artificial Sequence: Synthetic peptide
  XENP024280 vhCDR2
WINTYTGEPTYADGFTG

SEQ ID NO: 34905 - protein, 8 aa, Artificial Sequence
  Description of Artificial Sequence: Synthetic peptide
  XENP024280 vhCDR3
DYYGSSPY

SEQ ID NO: 34906 - protein, 16 aa, Artificial Sequence
  Description of Artificial Sequence: Synthetic peptide
  XENP024280 vlCDR1
KSSQSIVHSNGNTYLE

SEQ ID NO: 34907 - protein, 7 aa, Artificial Sequence
  Description of Artificial Sequence: Synthetic peptide
  XENP024280 vlCDR2
KVSNRFS

SEQ ID NO: 34908 - protein, 9 aa, Artificial Sequence
  Description of Artificial Sequence: Synthetic peptide
  XENP024280 vlCDR3
FQGSHVPNT

SEQ ID NO: 34909 - protein, 251 aa, Artificial Sequence
  Description of Artificial Sequence: Synthetic polypeptide
  XENP024281 1C11_H3.161_L3_scFv
QIQLVQSGSELKKPGASVKVSCKASGYTFTHYGMNWVRQAPGQGLEWMGWINTYTGEPTYADGFTGRFVFSLDTSVSSAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34910 - protein, 117 aa, Artificial Sequence
  Description of Artificial Sequence: Synthetic polypeptide
  VH of XENP024281
QIQLVQSGSELKKPGASVKVSCKASGYTFTHYGMNWVRQAPGQGLEWMGWINTYTGEPTYADGFTGRFVFSLDTSVSSAYLQISSLKAEDTAVYFCARDYYGSSPYWGQGTLVTVSS

SEQ ID NO: 34911 - protein, 114 aa, Artificial Sequence; identical to SEQ ID NO: 33651
  Description of Artificial Sequence: Synthetic polypeptide
  VL of XENP024281

SEQ ID NO: 34912 - protein, 5 aa, Artificial Sequence
  Description of Artificial Sequence: Synthetic peptide
  XENP024281 vhCDR1
HYGMN

SEQ ID NO: 34913 - protein, 17 aa, Artificial Sequence
  Description of Artificial Sequence: Synthetic peptide
  XENP024281 vhCDR2
WINTYTGEPTYADGFTG

SEQ ID NO: 34914 - protein, 8 aa, Artificial Sequence
  Description of Artificial Sequence: Synthetic peptide
  XENP024281 vhCDR3
DYYGSSPY

SEQ ID NO: 34915 - protein, 16 aa, Artificial Sequence
  Description of Artificial Sequence: Synthetic peptide
  XENP024281 vlCDR1
KSSQSIVHSNGNTYLE

SEQ ID NO: 34916 - protein, 7 aa, Artificial Sequence
  Description of Artificial Sequence: Synthetic peptide
  XENP024281 vlCDR2
KVSNRFS

SEQ ID NO: 34917 - protein, 9 aa, Artificial Sequence
  Description of Artificial Sequence: Synthetic peptide
  XENP024281 vlCDR3
FQGSHVPNT

SEQ ID NO: 34918 - protein, 251 aa, Artificial Sequence
  Description of Artificial Sequence: Synthetic polypeptide
  XENP024282 1C11_H3.162_L3_scFv
QIQLVQSGSELKKPGASVKVSCKASGYTFTHYGMNWVRQAPGQGLEWMGWINTYTGEPTYADGFTGRFVFSLDTSVSTLYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34919 - protein, 117 aa, Artificial Sequence
  Description of Artificial Sequence: Synthetic polypeptide
  VH of XENP024282
QIQLVQSGSELKKPGASVKVSCKASGYTFTHYGMNWVRQAPGQGLEWMGWINTYTGEPTYADGFTGRFVFSLDTSVSTLYLQISSLKAEDTAVYFCARDYYGSSPYWGQGTLVTVSS

SEQ ID NO: 34920 - protein, 114 aa, Artificial Sequence; identical to SEQ ID NO: 33651
  Description of Artificial Sequence: Synthetic polypeptide
  VL of XENP024282

SEQ ID NO: 34921 - protein, 5 aa, Artificial Sequence
  Description of Artificial Sequence: Synthetic peptide
  XENP024282 vhCDR1
HYGMN

SEQ ID NO: 34922 - protein, 17 aa, Artificial Sequence
  Description of Artificial Sequence: Synthetic peptide
  XENP024282 vhCDR2
WINTYTGEPTYADGFTG

SEQ ID NO: 34923 - protein, 8 aa, Artificial Sequence
  Description of Artificial Sequence: Synthetic peptide
  XENP024282 vhCDR3
DYYGSSPY

SEQ ID NO: 34924 - protein, 16 aa, Artificial Sequence
  Description of Artificial Sequence: Synthetic peptide
  XENP024282 vlCDR1
KSSQSIVHSNGNTYLE

SEQ ID NO: 34925 - protein, 7 aa, Artificial Sequence
  Description of Artificial Sequence: Synthetic peptide
  XENP024282 vlCDR2
KVSNRFS

SEQ ID NO: 34926 - protein, 9 aa, Artificial Sequence
  Description of Artificial Sequence: Synthetic peptide
  XENP024282 vlCDR3
FQGSHVPNT

SEQ ID NO: 34927 - protein, 251 aa, Artificial Sequence
  Description of Artificial Sequence: Synthetic polypeptide
  XENP024283 1C11_H3.164_L3_scFv
QIQLVQSGSELKKPGASVKVSCKASGYTFTHYGMNWVRQAPGQGLEWMGWINTYTGEPTYADGFTGRFVFSLDTSVSTAVLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34928 - protein, 117 aa, Artificial Sequence
  Description of Artificial Sequence: Synthetic polypeptide
  VH of XENP024283
QIQLVQSGSELKKPGASVKVSCKASGYTFTHYGMNWVRQAPGQGLEWMGWINTYTGEPTYADGFTGRFVFSLDTSVSTAVLQISSLKAEDTAVYFCARDYYGSSPYWGQGTLVTVSS

SEQ ID NO: 34929 - protein, 114 aa, Artificial Sequence; identical to SEQ ID NO: 33651
  Description of Artificial Sequence: Synthetic polypeptide
  VL of XENP024283

SEQ ID NO: 34930 - protein, 5 aa, Artificial Sequence
  Description of Artificial Sequence: Synthetic peptide
  XENP024283 vhCDR1
HYGMN

SEQ ID NO: 34931 - protein, 17 aa, Artificial Sequence
  Description of Artificial Sequence: Synthetic peptide
  XENP024283 vhCDR2
WINTYTGEPTYADGFTG

SEQ ID NO: 34932 - protein, 8 aa, Artificial Sequence
  Description of Artificial Sequence: Synthetic peptide
  XENP024283 vhCDR3
DYYGSSPY

SEQ ID NO: 34933 - protein, 16 aa, Artificial Sequence
  Description of Artificial Sequence: Synthetic peptide
  XENP024283 vlCDR1
KSSQSIVHSNGNTYLE

SEQ ID NO: 34934 - protein, 7 aa, Artificial Sequence
  Description of Artificial Sequence: Synthetic peptide
  XENP024283 vlCDR2
KVSNRFS

SEQ ID NO: 34935 - protein, 9 aa, Artificial Sequence
  Description of Artificial Sequence: Synthetic peptide
  XENP024283 vlCDR3
FQGSHVPNT

SEQ ID NO: 34936 - protein, 251 aa, Artificial Sequence
  Description of Artificial Sequence: Synthetic polypeptide
  XENP024284 1C11_H3.165_L3_scFv
QIQLVQSGSELKKPGASVKVSCKASGYTFTHYGMNWVRQAPGQGLEWMGWINTYTGEPTYADGFTGRFVFSLDTSVSTASLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34937 - protein, 117 aa, Artificial Sequence
  Description of Artificial Sequence: Synthetic polypeptide
  VH of XENP024284
QIQLVQSGSELKKPGASVKVSCKASGYTFTHYGMNWVRQAPGQGLEWMGWINTYTGEPTYADGFTGRFVFSLDTSVSTASLQISSLKAEDTAVYFCARDYYGSSPYWGQGTLVTVSS

SEQ ID NO: 34938 - protein, 114 aa, Artificial Sequence; identical to SEQ ID NO: 33651
  Description of Artificial Sequence: Synthetic polypeptide
  VL of XENP024284

SEQ ID NO: 34939 - protein, 5 aa, Artificial Sequence
  Description of Artificial Sequence: Synthetic peptide
  XENP024284 vhCDR1
HYGMN

SEQ ID NO: 34940 - protein, 17 aa, Artificial Sequence
  Description of Artificial Sequence: Synthetic peptide
  XENP024284 vhCDR2
WINTYTGEPTYADGFTG

SEQ ID NO: 34941 - protein, 8 aa, Artificial Sequence
  Description of Artificial Sequence: Synthetic peptide
  XENP024284 vhCDR3
DYYGSSPY

SEQ ID NO: 34942 - protein, 16 aa, Artificial Sequence
  Description of Artificial Sequence: Synthetic peptide
  XENP024284 vlCDR1
KSSQSIVHSNGNTYLE

SEQ ID NO: 34943 - protein, 7 aa, Artificial Sequence
  Description of Artificial Sequence: Synthetic peptide
  XENP024284 vlCDR2
KVSNRFS

SEQ ID NO: 34944 - protein, 9 aa, Artificial Sequence
  Description of Artificial Sequence: Synthetic peptide
  XENP024284 vlCDR3
FQGSHVPNT

SEQ ID NO: 34945 - protein, 251 aa, Artificial Sequence
  Description of Artificial Sequence: Synthetic polypeptide
  XENP024285 1C11_H3.166_L3_scFv
QIQLVQSGSELKKPGASVKVSCKASGYTFTHYGMNWVRQAPGQGLEWMGWINTYTGEPTYADGFTGRFVFSLDTSVSTAYLEISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34946 - protein, 117 aa, Artificial Sequence
  Description of Artificial Sequence: Synthetic polypeptide
  VH of XENP024285
QIQLVQSGSELKKPGASVKVSCKASGYTFTHYGMNWVRQAPGQGLEWMGWINTYTGEPTYADGFTGRFVFSLDTSVSTAYLEISSLKAEDTAVYFCARDYYGSSPYWGQGTLVTVSS

SEQ ID NO: 34947 - protein, 114 aa, Artificial Sequence; identical to SEQ ID NO: 33651
  Description of Artificial Sequence: Synthetic polypeptide
  VL of XENP024285

SEQ ID NO: 34948 - protein, 5 aa, Artificial Sequence
  Description of Artificial Sequence: Synthetic peptide
  XENP024285 vhCDR1
HYGMN

SEQ ID NO: 34949 - protein, 17 aa, Artificial Sequence
  Description of Artificial Sequence: Synthetic peptide
  XENP024285 vhCDR2
WINTYTGEPTYADGFTG

SEQ ID NO: 34950 - protein, 8 aa, Artificial Sequence
  Description of Artificial Sequence: Synthetic peptide
  XENP024285 vhCDR3
DYYGSSPY

SEQ ID NO: 34951 - protein, 16 aa, Artificial Sequence
  Description of Artificial Sequence: Synthetic peptide
  XENP024285 vlCDR1
KSSQSIVHSNGNTYLE

SEQ ID NO: 34952 - protein, 7 aa, Artificial Sequence
  Description of Artificial Sequence: Synthetic peptide
  XENP024285 vlCDR2
KVSNRFS

SEQ ID NO: 34953 - protein, 9 aa, Artificial Sequence
  Description of Artificial Sequence: Synthetic peptide
  XENP024285 vlCDR3
FQGSHVPNT

SEQ ID NO: 34954 - protein, 251 aa, Artificial Sequence
  Description of Artificial Sequence: Synthetic polypeptide
  XENP024286 1C11_H3.167_L3_scFv
QIQLVQSGSELKKPGASVKVSCKASGYTFTHYGMNWVRQAPGQGLEWMGWINTYTGEPTYADGFTGRFVFSLDTSVSTAYLKISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34955 - protein, 117 aa, Artificial Sequence
  Description of Artificial Sequence: Synthetic polypeptide
  VH of XENP024286
QIQLVQSGSELKKPGASVKVSCKASGYTFTHYGMNWVRQAPGQGLEWMGWINTYTGEPTYADGFTGRFVFSLDTSVSTAYLKISSLKAEDTAVYFCARDYYGSSPYWGQGTLVTVSS

SEQ ID NO: 34956 - protein, 114 aa, Artificial Sequence; identical to SEQ ID NO: 33651
  Description of Artificial Sequence: Synthetic polypeptide
  VL of XENP024286

SEQ ID NO: 34957 - protein, 5 aa, Artificial Sequence
  Description of Artificial Sequence: Synthetic peptide
  XENP024286 vhCDR1
HYGMN

SEQ ID NO: 34958 - protein, 17 aa, Artificial Sequence
  Description of Artificial Sequence: Synthetic peptide
  XENP024286 vhCDR2
WINTYTGEPTYADGFTG

SEQ ID NO: 34959 - protein, 8 aa, Artificial Sequence
  Description of Artificial Sequence: Synthetic peptide
  XENP024286 vhCDR3
DYYGSSPY

SEQ ID NO: 34960 - protein, 16 aa, Artificial Sequence
  Description of Artificial Sequence: Synthetic peptide
  XENP024286 vlCDR1
KSSQSIVHSNGNTYLE

SEQ ID NO: 34961 - protein, 7 aa, Artificial Sequence
  Description of Artificial Sequence: Synthetic peptide
  XENP024286 vlCDR2
KVSNRFS

SEQ ID NO: 34962 - protein, 9 aa, Artificial Sequence
  Description of Artificial Sequence: Synthetic peptide
  XENP024286 vlCDR3
FQGSHVPNT

SEQ ID NO: 34963 - protein, 251 aa, Artificial Sequence
  Description of Artificial Sequence: Synthetic polypeptide
  XENP024287 1C11_H3.168_L3_scFv
QIQLVQSGSELKKPGASVKVSCKASGYTFTHYGMNWVRQAPGQGLEWMGWINTYTGEPTYADGFTGRFVFSLDTSVSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34964 - protein, 117 aa, Artificial Sequence
  Description of Artificial Sequence: Synthetic polypeptide
  VH of XENP024287
QIQLVQSGSELKKPGASVKVSCKASGYTFTHYGMNWVRQAPGQGLEWMGWINTYTGEPTYADGFTGRFVFSLDTSVSTAYLQINSLKAEDTAVYFCARDYYGSSPYWGQGTLVTVSS

SEQ ID NO: 34965 - protein, 114 aa, Artificial Sequence; identical to SEQ ID NO: 33651
  Description of Artificial Sequence: Synthetic polypeptide
  VL of XENP024287

SEQ ID NO: 34966 - protein, 5 aa, Artificial Sequence
  Description of Artificial Sequence: Synthetic peptide
  XENP024287 vhCDR1
HYGMN

SEQ ID NO: 34967 - protein, 17 aa, Artificial Sequence
  Description of Artificial Sequence: Synthetic peptide
  XENP024287 vhCDR2
WINTYTGEPTYADGFTG

SEQ ID NO: 34968 - protein, 8 aa, Artificial Sequence
  Description of Artificial Sequence: Synthetic peptide
  XENP024287 vhCDR3
DYYGSSPY

SEQ ID NO: 34969 - protein, 16 aa, Artificial Sequence
  Description of Artificial Sequence: Synthetic peptide
  XENP024287 vlCDR1
KSSQSIVHSNGNTYLE

SEQ ID NO: 34970 - protein, 7 aa, Artificial Sequence
  Description of Artificial Sequence: Synthetic peptide
  XENP024287 vlCDR2
KVSNRFS

SEQ ID NO: 34971 - protein, 9 aa, Artificial Sequence
  Description of Artificial Sequence: Synthetic peptide
  XENP024287 vlCDR3
FQGSHVPNT

SEQ ID NO: 34972 - protein, 251 aa, Artificial Sequence
  Description of Artificial Sequence: Synthetic polypeptide
  XENP024288 1C11_H3.169_L3_scFv
QIQLVQSGSELKKPGASVKVSCKASGYTFTHYGMNWVRQAPGQGLEWMGWINTYTGEPTYADGFTGRFVFSLDTSVSTAYLQISSVKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34973 - protein, 117 aa, Artificial Sequence
  Description of Artificial Sequence: Synthetic polypeptide
  VH of XENP024288
QIQLVQSGSELKKPGASVKVSCKASGYTFTHYGMNWVRQAPGQGLEWMGWINTYTGEPTYADGFTGRFVFSLDTSVSTAYLQISSVKAEDTAVYFCARDYYGSSPYWGQGTLVTVSS

SEQ ID NO: 34974 - protein, 114 aa, Artificial Sequence; identical to SEQ ID NO: 33651
  Description of Artificial Sequence: Synthetic polypeptide
  VL of XENP024288

SEQ ID NO: 34975 - protein, 5 aa, Artificial Sequence
  Description of Artificial Sequence: Synthetic peptide
  XENP024288 vhCDR1
HYGMN

SEQ ID NO: 34976 - protein, 17 aa, Artificial Sequence
  Description of Artificial Sequence: Synthetic peptide
  XENP024288 vhCDR2
WINTYTGEPTYADGFTG

SEQ ID NO: 34977 - protein, 8 aa, Artificial Sequence
  Description of Artificial Sequence: Synthetic peptide
  XENP024288 vhCDR3
DYYGSSPY

SEQ ID NO: 34978 - protein, 16 aa, Artificial Sequence
  Description of Artificial Sequence: Synthetic peptide
  XENP024288 vlCDR1
KSSQSIVHSNGNTYLE

SEQ ID NO: 34979 - protein, 7 aa, Artificial Sequence
  Description of Artificial Sequence: Synthetic peptide
  XENP024288 vlCDR2
KVSNRFS

SEQ ID NO: 34980 - protein, 9 aa, Artificial Sequence
  Description of Artificial Sequence: Synthetic peptide
  XENP024288 vlCDR3
FQGSHVPNT

SEQ ID NO: 34981 - protein, 251 aa, Artificial Sequence
  Description of Artificial Sequence: Synthetic polypeptide
  XENP024289 1C11_H3.170_L3_scFv
QIQLVQSGSELKKPGASVKVSCKASGYTFTHYGMNWVRQAPGQGLEWMGWINTYTGEPTYADGFTGRFVFSLDTSVSTAYLQISSMKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34982 - protein, 117 aa, Artificial Sequence
  Description of Artificial Sequence: Synthetic polypeptide
  VH of XENP024289
QIQLVQSGSELKKPGASVKVSCKASGYTFTHYGMNWVRQAPGQGLEWMGWINTYTGEPTYADGFTGRFVFSLDTSVSTAYLQISSMKAEDTAVYFCARDYYGSSPYWGQGTLVTVSS

SEQ ID NO: 34983 - protein, 114 aa, Artificial Sequence; identical to SEQ ID NO: 33651
  Description of Artificial Sequence: Synthetic polypeptide
  VL of XENP024289

SEQ ID NO: 34984 - protein, 5 aa, Artificial Sequence
  Description of Artificial Sequence: Synthetic peptide
  XENP024289 vhCDR1
HYGMN

SEQ ID NO: 34985 - protein, 17 aa, Artificial Sequence
  Description of Artificial Sequence: Synthetic peptide
  XENP024289 vhCDR2
WINTYTGEPTYADGFTG

SEQ ID NO: 34986 - protein, 8 aa, Artificial Sequence
  Description of Artificial Sequence: Synthetic peptide
  XENP024289 vhCDR3
DYYGSSPY

SEQ ID NO: 34987 - protein, 16 aa, Artificial Sequence
  Description of Artificial Sequence: Synthetic peptide
  XENP024289 vlCDR1
KSSQSIVHSNGNTYLE

SEQ ID NO: 34988 - protein, 7 aa, Artificial Sequence
  Description of Artificial Sequence: Synthetic peptide
  XENP024289 vlCDR2
KVSNRFS

SEQ ID NO: 34989 - protein, 9 aa, Artificial Sequence
  Description of Artificial Sequence: Synthetic peptide
  XENP024289 vlCDR3
FQGSHVPNT

SEQ ID NO: 34990 - protein, 251 aa, Artificial Sequence
  Description of Artificial Sequence: Synthetic polypeptide
  XENP024290 1C11_H3.171_L3_scFv
QIQLVQSGSELKKPGASVKVSCKASGYTFTHYGMNWVRQAPGQGLEWMGWINTYTGEPTYADGFTGRFVFSLDTSVSTAYLQISSLKSEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34991 - protein, 117 aa, Artificial Sequence
  Description of Artificial Sequence: Synthetic polypeptide
  VH of XENP024290
QIQLVQSGSELKKPGASVKVSCKASGYTFTHYGMNWVRQAPGQGLEWMGWINTYTGEPTYADGFTGRFVFSLDTSVSTAYLQISSLKSEDTAVYFCARDYYGSSPYWGQGTLVTVSS

SEQ ID NO: 34992 - protein, 114 aa, Artificial Sequence; identical to SEQ ID NO: 33651
  Description of Artificial Sequence: Synthetic polypeptide
  VL of XENP024290

SEQ ID NO: 34993 - protein, 5 aa, Artificial Sequence
  Description of Artificial Sequence: Synthetic peptide
  XENP024290 vhCDR1
HYGMN

SEQ ID NO: 34994 - protein, 17 aa, Artificial Sequence
  Description of Artificial Sequence: Synthetic peptide
  XENP024290 vhCDR2
WINTYTGEPTYADGFTG

SEQ ID NO: 34995 - protein, 8 aa, Artificial Sequence
  Description of Artificial Sequence: Synthetic peptide
  XENP024290 vhCDR3
DYYGSSPY

SEQ ID NO: 34996 - protein, 16 aa, Artificial Sequence
  Description of Artificial Sequence: Synthetic peptide
  XENP024290 vlCDR1
KSSQSIVHSNGNTYLE

SEQ ID NO: 34997 - protein, 7 aa, Artificial Sequence
  Description of Artificial Sequence: Synthetic peptide
  XENP024290 vlCDR2
KVSNRFS

SEQ ID NO: 34998 - protein, 9 aa, Artificial Sequence
  Description of Artificial Sequence: Synthetic peptide
  XENP024290 vlCDR3
FQGSHVPNT

SEQ ID NO: 34999 - protein, 251 aa, Artificial Sequence
  Description of Artificial Sequence: Synthetic polypeptide
  XENP024291 1C11_H3.172_L3_scFv
QIQLVQSGSELKKPGASVKVSCKASGYTFTHYGMNWVRQAPGQGLEWMGWINTYTGEPTYADGFTGRFVFSLDTSVSTAYLQISSLKPEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35000 - protein, 117 aa, Artificial Sequence
  Description of Artificial Sequence: Synthetic polypeptide
  VH of XENP024291
QIQLVQSGSELKKPGASVKVSCKASGYTFTHYGMNWVRQAPGQGLEWMGWINTYTGEPTYADGFTGRFVFSLDTSVSTAYLQISSLKPEDTAVYFCARDYYGSSPYWGQGTLVTVSS

SEQ ID NO: 35001 - protein, 114 aa, Artificial Sequence; identical to SEQ ID NO: 33651
  Description of Artificial Sequence: Synthetic polypeptide
  VL of XENP024291

SEQ ID NO: 35002 - protein, 5 aa, Artificial Sequence
  Description of Artificial Sequence: Synthetic peptide
  XENP024291 vhCDR1
HYGMN

SEQ ID NO: 35003 - protein, 17 aa, Artificial Sequence
  Description of Artificial Sequence: Synthetic peptide
  XENP024291 vhCDR2
WINTYTGEPTYADGFTG

SEQ ID NO: 35004 - protein, 8 aa, Artificial Sequence
  Description of Artificial Sequence: Synthetic peptide
  XENP024291 vhCDR3
DYYGSSPY

SEQ ID NO: 35005 - protein, 16 aa, Artificial Sequence
  Description of Artificial Sequence: Synthetic peptide
  XENP024291 vlCDR1
KSSQSIVHSNGNTYLE

SEQ ID NO: 35006 - protein, 7 aa, Artificial Sequence
  Description of Artificial Sequence: Synthetic peptide
  XENP024291 vlCDR2
KVSNRFS

SEQ ID NO: 35007 - protein, 9 aa, Artificial Sequence
  Description of Artificial Sequence: Synthetic peptide
  XENP024291 vlCDR3
FQGSHVPNT

SEQ ID NO: 35008 - protein, 251 aa, Artificial Sequence
  Description of Artificial Sequence: Synthetic polypeptide
  XENP024292 1C11_H3.173_L3_scFv
QIQLVQSGSELKKPGASVKVSCKASGYTFTHYGMNWVRQAPGQGLEWMGWINTYTGEPTYADGFTGRFVFSLDTSVSTAYLQISSLKADDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35009 - protein, 117 aa, Artificial Sequence
  Description of Artificial Sequence: Synthetic polypeptide
  VH of XENP024292
QIQLVQSGSELKKPGASVKVSCKASGYTFTHYGMNWVRQAPGQGLEWMGWINTYTGEPTYADGFTGRFVFSLDTSVSTAYLQISSLKADDTAVYFCARDYYGSSPYWGQGTLVTVSS

SEQ ID NO: 35010 - protein, 114 aa, Artificial Sequence; identical to SEQ ID NO: 33651
  Description of Artificial Sequence: Synthetic polypeptide
  VL of XENP024292

SEQ ID NO: 35011 - protein, 5 aa, Artificial Sequence
  Description of Artificial Sequence: Synthetic peptide
  XENP024292 vhCDR1
HYGMN

SEQ ID NO: 35012 - protein, 17 aa, Artificial Sequence
  Description of Artificial Sequence: Synthetic peptide
  XENP024292 vhCDR2
WINTYTGEPTYADGFTG

SEQ ID NO: 35013 - protein, 8 aa, Artificial Sequence
  Description of Artificial Sequence: Synthetic peptide
  XENP024292 vhCDR3
DYYGSSPY

SEQ ID NO: 35014 - protein, 16 aa, Artificial Sequence
  Description of Artificial Sequence: Synthetic peptide
  XENP024292 vlCDR1
KSSQSIVHSNGNTYLE

SEQ ID NO: 35015 - protein, 7 aa, Artificial Sequence
  Description of Artificial Sequence: Synthetic peptide
  XENP024292 vlCDR2
KVSNRFS

SEQ ID NO: 35016 - protein, 9 aa, Artificial Sequence
  Description of Artificial Sequence: Synthetic peptide
  XENP024292 vlCDR3
FQGSHVPNT

SEQ ID NO: 35017 - protein, 251 aa, Artificial Sequence
  Description of Artificial Sequence: Synthetic polypeptide
  XENP024293 1C11_H3.174_L3_scFv
QIQLVQSGSELKKPGASVKVSCKASGYTFTHYGMNWVRQAPGQGLEWMGWINTYTGEPTYADGFTGRFVFSLDTSVSTAYLQISSLKAADTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35018 - protein, 117 aa, Artificial Sequence
  Description of Artificial Sequence: Synthetic polypeptide
  VH of XENP024293
QIQLVQSGSELKKPGASVKVSCKASGYTFTHYGMNWVRQAPGQGLEWMGWINTYTGEPTYADGFTGRFVFSLDTSVSTAYLQISSLKAADTAVYFCARDYYGSSPYWGQGTLVTVSS

SEQ ID NO: 35019 - protein, 114 aa, Artificial Sequence; identical to SEQ ID NO: 33651
  Description of Artificial Sequence: Synthetic polypeptide
  VL of XENP024293

SEQ ID NO: 35020 - protein, 5 aa, Artificial Sequence
  Description of Artificial Sequence: Synthetic peptide
  XENP024293 vhCDR1
HYGMN

SEQ ID NO: 35021 - protein, 17 aa, Artificial Sequence
  Description of Artificial Sequence: Synthetic peptide
  XENP024293 vhCDR2
WINTYTGEPTYADGFTG

SEQ ID NO: 35022 - protein, 8 aa, Artificial Sequence
  Description of Artificial Sequence: Synthetic peptide
  XENP024293 vhCDR3
DYYGSSPY

SEQ ID NO: 35023 - protein, 16 aa, Artificial Sequence
  Description of Artificial Sequence: Synthetic peptide
  XENP024293 vlCDR1
KSSQSIVHSNGNTYLE

SEQ ID NO: 35024 - protein, 7 aa, Artificial Sequence
  Description of Artificial Sequence: Synthetic peptide
  XENP024293 vlCDR2
KVSNRFS

SEQ ID NO: 35025 - protein, 9 aa, Artificial Sequence
  Description of Artificial Sequence: Synthetic peptide
  XENP024293 vlCDR3
FQGSHVPNT

SEQ ID NO: 35026 - protein, 251 aa, Artificial Sequence
  Description of Artificial Sequence: Synthetic polypeptide
  XENP024372 1C11_H3_L3.86_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFTGVPDRFSGSGSGTDFTLTISSVQAEDVATYYCFQGSHVPNTFGQGTKVEIKGS

SEQ ID NO: 35027 - protein, 117 aa, Artificial Sequence; identical to SEQ ID NO: 33034
  Description of Artificial Sequence: Synthetic polypeptide
  VH of XENP024372

SEQ ID NO: 35028 - protein, 114 aa, Artificial Sequence
  Description of Artificial Sequence: Synthetic polypeptide
  VL of XENP024372
DVLMTQSPDSLAVSLGERATINCKSSQSIVHSNGNTYLEWYQQKPGQSPKLLIYKVSNRFTGVPDRFSGSGSGTDFTLTISSVQAEDVATYYCFQGSHVPNTFGQGTKVEIKGS

SEQ ID NO: 35029 - protein, 5 aa, Artificial Sequence
  Description of Artificial Sequence: Synthetic peptide
  XENP024372 vhCDR1
HYGMN

SEQ ID NO: 35030 - protein, 17 aa, Artificial Sequence
  Description of Artificial Sequence: Synthetic peptide
  XENP024372 vhCDR2
WINTYTGEPTYADGFTG

SEQ ID NO: 35031 - protein, 8 aa, Artificial Sequence
  Description of Artificial Sequence: Synthetic peptide
  XENP024372 vhCDR3
DYYGSSPY

SEQ ID NO: 35032 - protein, 16 aa, Artificial Sequence
  Description of Artificial Sequence: Synthetic peptide
  XENP024372 vlCDR1
KSSQSIVHSNGNTYLE

SEQ ID NO: 35033 - protein, 7 aa, Artificial Sequence
  Description of Artificial Sequence: Synthetic peptide
  XENP024372 vlCDR2
KVSNRFT

SEQ ID NO: 35034 - protein, 9 aa, Artificial Sequence
  Description of Artificial Sequence: Synthetic peptide
  XENP024372 vlCDR3
FQGSHVPNT

SEQ ID NO: 35035 - protein, 251 aa, Artificial Sequence
  Description of Artificial Sequence: Synthetic polypeptide
  XENP024373 1C11_H3_L3.87_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 35036 - protein, 117 aa, Artificial Sequence; identical to SEQ ID NO: 33034
  Description of Artificial Sequence: Synthetic polypeptide
  VH of XENP024373

SEQ ID NO: 35037 - protein, 114 aa, Artificial Sequence
  Description of Artificial Sequence: Synthetic polypeptide
  VL of XENP024373
DVVMTQSPDSLAVSLGERVTINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 35038 - protein, 5 aa, Artificial Sequence
  Description of Artificial Sequence: Synthetic peptide
  XENP024373 vhCDR1
HYGMN

SEQ ID NO: 35039 - protein, 17 aa, Artificial Sequence
  Description of Artificial Sequence: Synthetic peptide
  XENP024373 vhCDR2
WINTYTGEPTYADGFTG

SEQ ID NO: 35040 - protein, 8 aa, Artificial Sequence
  Description of Artificial Sequence: Synthetic peptide
  XENP024373 vhCDR3
DYYGSSPY

SEQ ID NO: 35041 - protein, 16 aa, Artificial Sequence
  Description of Artificial Sequence: Synthetic peptide
  XENP024373 vlCDR1
KASQSIVHSNGNTYLE

SEQ ID NO: 35042 - protein, 7 aa, Artificial Sequence
  Description of Artificial Sequence: Synthetic peptide
  XENP024373 vlCDR2
KVSNRFS

SEQ ID NO: 35043 - protein, 9 aa, Artificial Sequence
  Description of Artificial Sequence: Synthetic peptide
  XENP024373 vlCDR3
FQGSHVPNT

SEQ ID NO: 35044 - protein, 251 aa, Artificial Sequence
  Description of Artificial Sequence: Synthetic polypeptide
  XENP024374 1C11_H3_L3.90_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35045 - protein, 117 aa, Artificial Sequence; identical to SEQ ID NO: 33034
  Description of Artificial Sequence: Synthetic polypeptide
  VH of XENP024374

SEQ ID NO: 35046 - protein, 114 aa, Artificial Sequence
  Description of Artificial Sequence: Synthetic polypeptide
  VL of XENP024374
DVVMTQSPDSLAVSLGERATINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35047 - protein, 5 aa, Artificial Sequence
  Description of Artificial Sequence: Synthetic peptide
  XENP024374 vhCDR1
HYGMN

SEQ ID NO: 35048 - protein, 17 aa, Artificial Sequence
  Description of Artificial Sequence: Synthetic peptide
  XENP024374 vhCDR2
WINTYTGEPTYADGFTG

SEQ ID NO: 35049 - protein, 8 aa, Artificial Sequence
  Description of Artificial Sequence: Synthetic peptide
  XENP024374 vhCDR3
DYYGSSPY

SEQ ID NO: 35050 - protein, 16 aa, Artificial Sequence
  Description of Artificial Sequence: Synthetic peptide
  XENP024374 vlCDR1
KASQSIVHSNGNTYLE

SEQ ID NO: 35051 - protein, 7 aa, Artificial Sequence
  Description of Artificial Sequence: Synthetic peptide
  XENP024374 vlCDR2
KVSNRFS

SEQ ID NO: 35052 - protein, 9 aa, Artificial Sequence
  Description of Artificial Sequence: Synthetic peptide
  XENP024374 vlCDR3
FQGSHVPNT

SEQ ID NO: 35053 - protein, 251 aa, Artificial Sequence
  Description of Artificial Sequence: Synthetic polypeptide
  XENP024375 1C11_H3_L3.92_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKGS

SEQ ID NO: 35054 - protein, 117 aa, Artificial Sequence; identical to SEQ ID NO: 33034
  Description of Artificial Sequence: Synthetic polypeptide
  VH of XENP024375

SEQ ID NO: 35055 - protein, 114 aa, Artificial Sequence
  Description of Artificial Sequence: Synthetic polypeptide
  VL of XENP024375
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKGS

SEQ ID NO: 35056 - protein, 5 aa, Artificial Sequence
  Description of Artificial Sequence: Synthetic peptide
  XENP024375 vhCDR1
HYGMN

SEQ ID NO: 35057 - protein, 17 aa, Artificial Sequence
  Description of Artificial Sequence: Synthetic peptide
  XENP024375 vhCDR2
WINTYTGEPTYADGFTG

SEQ ID NO: 35058 - protein, 8 aa, Artificial Sequence
  Description of Artificial Sequence: Synthetic peptide
  XENP024375 vhCDR3
DYYGSSPY

SEQ ID NO: 35059 - protein, 16 aa, Artificial Sequence
  Description of Artificial Sequence: Synthetic peptide
  XENP024375 vlCDR1
KASQSIVHSNGNTYLE

SEQ ID NO: 35060 - protein, 7 aa, Artificial Sequence
  Description of Artificial Sequence: Synthetic peptide
  XENP024375 vlCDR2
KVSNRFT

SEQ ID NO: 35061 - protein, 9 aa, Artificial Sequence
  Description of Artificial Sequence: Synthetic peptide
  XENP024375 vlCDR3
FQGSHVPNT

SEQ ID NO: 35062 - protein, 251 aa, Artificial Sequence
  Description of Artificial Sequence: Synthetic polypeptide
  XENP024376 1C11_H3_L3.94_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIKGS

SEQ ID NO: 35063 - protein, 117 aa, Artificial Sequence; identical to SEQ ID NO: 33034
  Description of Artificial Sequence: Synthetic polypeptide
  VH of XENP024376

SEQ ID NO: 35064 - protein, 114 aa, Artificial Sequence
  Description of Artificial Sequence: Synthetic polypeptide
  VL of XENP024376
DILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIKGS

SEQ ID NO: 35065 - protein, 5 aa, Artificial Sequence
  Description of Artificial Sequence: Synthetic peptide
  XENP024376 vhCDR1
HYGMN

SEQ ID NO: 35066 - protein, 17 aa, Artificial Sequence
  Description of Artificial Sequence: Synthetic peptide
  XENP024376 vhCDR2
WINTYTGEPTYADGFTG

SEQ ID NO: 35067 - protein, 8 aa, Artificial Sequence
  Description of Artificial Sequence: Synthetic peptide
  XENP024376 vhCDR3
DYYGSSPY

SEQ ID NO: 35068 - protein, 16 aa, Artificial Sequence
  Description of Artificial Sequence: Synthetic peptide
  XENP024376 vlCDR1
KSSQSIVHSNGNTYLE

SEQ ID NO: 35069 - protein, 7 aa, Artificial Sequence
  Description of Artificial Sequence: Synthetic peptide
  XENP024376 vlCDR2
KVSNRFT

SEQ ID NO: 35070 - protein, 9 aa, Artificial Sequence
  Description of Artificial Sequence: Synthetic peptide
  XENP024376 vlCDR3
FQGSHVPNT

SEQ ID NO: 35071 - protein, 251 aa, Artificial Sequence
  Description of Artificial Sequence: Synthetic polypeptide
  XENP024377 1C11_H3_L3.96_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIKGS

SEQ ID NO: 35072 - protein, 117 aa, Artificial Sequence; identical to SEQ ID NO: 33034
  Description of Artificial Sequence: Synthetic polypeptide
  VH of XENP024377

SEQ ID NO: 35073 - protein, 114 aa, Artificial Sequence
  Description of Artificial Sequence: Synthetic polypeptide
  VL of XENP024377
DIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIKGS

SEQ ID NO: 35074 - protein, 5 aa, Artificial Sequence
  Description of Artificial Sequence: Synthetic peptide
  XENP024377 vhCDR1
HYGMN

SEQ ID NO: 35075 - protein, 17 aa, Artificial Sequence
  Description of Artificial Sequence: Synthetic peptide
  XENP024377 vhCDR2
WINTYTGEPTYADGFTG

SEQ ID NO: 35076 - protein, 8 aa, Artificial Sequence
  Description of Artificial Sequence: Synthetic peptide
  XENP024377 vhCDR3
DYYGSSPY

SEQ ID NO: 35077 - protein, 16 aa, Artificial Sequence
  Description of Artificial Sequence: Synthetic peptide
  XENP024377 vlCDR1
KASQSIVHSNGNTYLE

SEQ ID NO: 35078 - protein, 7 aa, Artificial Sequence
  Description of Artificial Sequence: Synthetic peptide
  XENP024377 vlCDR2
KVSNRFT

SEQ ID NO: 35079 - protein, 9 aa, Artificial Sequence
  Description of Artificial Sequence: Synthetic peptide
  XENP024377 vlCDR3
FQGSHVPNT

SEQ ID NO: 35080 - protein, 251 aa, Artificial Sequence
  Description of Artificial Sequence: Synthetic polypeptide
  XENP024378 1C11_H3_L3.105_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLPVTPGEPATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35081 - protein, 117 aa, Artificial Sequence; identical to SEQ ID NO: 33034
  Description of Artificial Sequence: Synthetic polypeptide
  VH of XENP024378

SEQ ID NO: 35082 - protein, 114 aa, Artificial Sequence
  Description of Artificial Sequence: Synthetic polypeptide
  VL of XENP024378
DVLMTQSPDSLPVTPGEPATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35083 - protein, 5 aa, Artificial Sequence
  Description of Artificial Sequence: Synthetic peptide
  XENP024378 vhCDR1
HYGMN

SEQ ID NO: 35084 - protein, 17 aa, Artificial Sequence
  Description of Artificial Sequence: Synthetic peptide
  XENP024378 vhCDR2
WINTYTGEPTYADGFTG

SEQ ID NO: 35085 - protein, 8 aa, Artificial Sequence
  Description of Artificial Sequence: Synthetic peptide
  XENP024378 vhCDR3
DYYGSSPY

SEQ ID NO: 35086 - protein, 16 aa, Artificial Sequence
  Description of Artificial Sequence: Synthetic peptide
  XENP024378 vlCDR1
KSSQSIVHSNGNTYLE

SEQ ID NO: 35087 - protein, 7 aa, Artificial Sequence
  Description of Artificial Sequence: Synthetic peptide
  XENP024378 vlCDR2
KVSNRFS

SEQ ID NO: 35088 - protein, 9 aa, Artificial Sequence
  Description of Artificial Sequence: Synthetic peptide
  XENP024378 vlCDR3
FQGSHVPNT

SEQ ID NO: 35089 - protein, 251 aa, Artificial Sequence
  Description of Artificial Sequence: Synthetic polypeptide
  XENP024379 1C11_H3_L3.129_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTINSLQAEDAATYYCHQGSHVPNTFGGGTKVEIKGS

SEQ ID NO: 35090 - protein, 117 aa, Artificial Sequence; identical to SEQ ID NO: 33034
  Description of Artificial Sequence: Synthetic polypeptide
  VH of XENP024379

SEQ ID NO: 35091 - protein, 114 aa, Artificial Sequence
  Description of Artificial Sequence: Synthetic polypeptide
  VL of XENP024379
DVLMTQSPDSLAVSLGERATINCKSSQSIVHSNGNTYLEWYQQKPGQSPKLLIYKVSNRFSGVPDRFSGSGSGTDFTLTINSLQAEDAATYYCHQGSHVPNTFGGGTKVEIKGS

SEQ ID NO: 35092 - protein, 5 aa, Artificial Sequence
  Description of Artificial Sequence: Synthetic peptide
  XENP024379 vhCDR1
HYGMN

SEQ ID NO: 35093 - protein, 17 aa, Artificial Sequence
  Description of Artificial Sequence: Synthetic peptide
  XENP024379 vhCDR2
WINTYTGEPTYADGFTG

SEQ ID NO: 35094 - protein, 8 aa, Artificial Sequence
  Description of Artificial Sequence: Synthetic peptide
  XENP024379 vhCDR3
DYYGSSPY

SEQ ID NO: 35095 - protein, 16 aa, Artificial Sequence
  Description of Artificial Sequence: Synthetic peptide
  XENP024379 vlCDR1
KSSQSIVHSNGNTYLE

SEQ ID NO: 35096 - protein, 7 aa, Artificial Sequence
  Description of Artificial Sequence: Synthetic peptide
  XENP024379 vlCDR2
KVSNRFS

SEQ ID NO: 35097 - protein, 9 aa, Artificial Sequence
  Description of Artificial Sequence: Synthetic peptide
  XENP024379 vlCDR3
HQGSHVPNT

SEQ ID NO: 35098 - protein, 251 aa, Artificial Sequence
  Description of Artificial Sequence: Synthetic polypeptide
  XENP024380 1C11_H3.176_L3.92_scFv
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKGS

SEQ ID NO: 35099 - protein, 117 aa, Artificial Sequence
  Description of Artificial Sequence: Synthetic polypeptide
  VH of XENP024380
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSS

SEQ ID NO: 35100 - protein, 114 aa, Artificial Sequence; identical to SEQ ID NO: 35055
  Description of Artificial Sequence: Synthetic polypeptide
  VL of XENP024380

SEQ ID NO: 35101 - protein, 5 aa, Artificial Sequence
  Description of Artificial Sequence: Synthetic peptide
  XENP024380 vhCDR1
HYGMN

SEQ ID NO: 35102 - protein, 17 aa, Artificial Sequence
  Description of Artificial Sequence: Synthetic peptide
  XENP024380 vhCDR2
WINTNTGEPTYADKFTG

SEQ ID NO: 35103 - protein, 8 aa, Artificial Sequence
  Description of Artificial Sequence: Synthetic peptide
  XENP024380 vhCDR3
DYYGSSPY

SEQ ID NO: 35104 - protein, 16 aa, Artificial Sequence
  Description of Artificial Sequence: Synthetic peptide
  XENP024380 vlCDR1
KASQSIVHSNGNTYLE

SEQ ID NO: 35105 - protein, 7 aa, Artificial Sequence
  Description of Artificial Sequence: Synthetic peptide
  XENP024380 vlCDR2
KVSNRFT

SEQ ID NO: 35106 - protein, 9 aa, Artificial Sequence
  Description of Artificial Sequence: Synthetic peptide
  XENP024380 vlCDR3
FQGSHVPNT

SEQ ID NO: 35107 - protein, 251 aa, Artificial Sequence
  Description of Artificial Sequence: Synthetic polypeptide
  XENP024381 1C11_H3.176_L3.94_scFv
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIKGS

SEQ ID NO: 35108 - protein, 117 aa, Artificial Sequence; identical to SEQ ID NO: 35099
  Description of Artificial Sequence: Synthetic polypeptide
  VH of XENP024381

SEQ ID NO: 35109 - protein, 114 aa, Artificial Sequence; identical to SEQ ID NO: 35064
  Description of Artificial Sequence: Synthetic polypeptide
  VL of XENP024381

SEQ ID NO: 35110 - protein, 5 aa, Artificial Sequence
  Description of Artificial Sequence: Synthetic peptide
  XENP024381 vhCDR1
HYGMN

SEQ ID NO: 35111 - protein, 17 aa, Artificial Sequence
  Description of Artificial Sequence: Synthetic peptide
  XENP024381 vhCDR2
WINTNTGEPTYADKFTG

SEQ ID NO: 35112 - protein, 8 aa, Artificial Sequence
  Description of Artificial Sequence: Synthetic peptide
  XENP024381 vhCDR3
DYYGSSPY

SEQ ID NO: 35113 - protein, 16 aa, Artificial Sequence
  Description of Artificial Sequence: Synthetic peptide
  XENP024381 vlCDR1
KSSQSIVHSNGNTYLE

SEQ ID NO: 35114 - protein, 7 aa, Artificial Sequence
  Description of Artificial Sequence: Synthetic peptide
  XENP024381 vlCDR2
KVSNRFT

SEQ ID NO: 35115 - protein, 9 aa, Artificial Sequence
  Description of Artificial Sequence: Synthetic peptide
  XENP024381 vlCDR3
FQGSHVPNT

SEQ ID NO: 35116 - protein, 251 aa, Artificial Sequence
  Description of Artificial Sequence: Synthetic polypeptide
  XENP024382 1C11_H3.176_L3.96_scFv
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIKGS

SEQ ID NO: 35117 - protein, 117 aa, Artificial Sequence; identical to SEQ ID NO: 35099
  Description of Artificial Sequence: Synthetic polypeptide
  VH of XENP024382

SEQ ID NO: 35118 - protein, 114 aa, Artificial Sequence; identical to SEQ ID NO: 35073
  Description of Artificial Sequence: Synthetic polypeptide
  VL of XENP024382

SEQ ID NO: 35119 - protein, 5 aa, Artificial Sequence
  Description of Artificial Sequence: Synthetic peptide
  XENP024382 vhCDR1
HYGMN

SEQ ID NO: 35120 - protein, 17 aa, Artificial Sequence
  Description of Artificial Sequence: Synthetic peptide
  XENP024382 vhCDR2
WINTNTGEPTYADKFTG

SEQ ID NO: 35121 - protein, 8 aa, Artificial Sequence
  Description of Artificial Sequence: Synthetic peptide
  XENP024382 vhCDR3
DYYGSSPY

SEQ ID NO: 35122 - protein, 16 aa, Artificial Sequence
  Description of Artificial Sequence: Synthetic peptide
  XENP024382 vlCDR1
KASQSIVHSNGNTYLE

SEQ ID NO: 35123 - protein, 7 aa, Artificial Sequence
  Description of Artificial Sequence: Synthetic peptide
  XENP024382 vlCDR2
KVSNRFT

SEQ ID NO: 35124 - protein, 9 aa, Artificial Sequence
  Description of Artificial Sequence: Synthetic peptide
  XENP024382 vlCDR3
FQGSHVPNT

SEQ ID NO: 35125 - protein, 251 aa, Artificial Sequence
  Description of Artificial Sequence: Synthetic polypeptide
  XENP024414 1C11_H3_L3.133_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35126 - protein, 117 aa, Artificial Sequence; identical to SEQ ID NO: 33034
  Description of Artificial Sequence: Synthetic polypeptide
  VH of XENP024414

SEQ ID NO: 35127 - protein, 114 aa, Artificial Sequence
  Description of Artificial Sequence: Synthetic polypeptide
  VL of XENP024414
DVVMTQSPDSLAVSLGERVTINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35128 - protein, 5 aa, Artificial Sequence
  Description of Artificial Sequence: Synthetic peptide
  XENP024414 vhCDR1
HYGMN

SEQ ID NO: 35129 - protein, 17 aa, Artificial Sequence
  Description of Artificial Sequence: Synthetic peptide
  XENP024414 vhCDR2
WINTYTGEPTYADGFTG

SEQ ID NO: 35130 - protein, 8 aa, Artificial Sequence
  Description of Artificial Sequence: Synthetic peptide
  XENP024414 vhCDR3
DYYGSSPY

SEQ ID NO: 35131 - protein, 16 aa, Artificial Sequence
  Description of Artificial Sequence: Synthetic peptide
  XENP024414 vlCDR1
KASQSIVHSNGNTYLE

SEQ ID NO: 35132 - protein, 7 aa, Artificial Sequence
  Description of Artificial Sequence: Synthetic peptide
  XENP024414 vlCDR2
KVSNRFS

SEQ ID NO: 35133 - protein, 9 aa, Artificial Sequence
  Description of Artificial Sequence: Synthetic peptide
  XENP024414 vlCDR3
FQGSHVPNT

SEQ ID NO: 35134 - protein, 251 aa, Artificial Sequence
  Description of Artificial Sequence: Synthetic polypeptide
  XENP024415 1C11_H3_L3.134_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 35135 - protein, 117 aa, Artificial Sequence; identical to SEQ ID NO: 33034
  Description of Artificial Sequence: Synthetic polypeptide
  VH of XENP024415

SEQ ID NO: 35136 - protein, 114 aa, Artificial Sequence
  Description of Artificial Sequence: Synthetic polypeptide
  VL of XENP024415
DVVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 35137 - protein, 5 aa, Artificial Sequence
  Description of Artificial Sequence: Synthetic peptide
  XENP024415 vhCDR1
HYGMN

SEQ ID NO: 35138 - protein, 17 aa, Artificial Sequence
  Description of Artificial Sequence: Synthetic peptide
  XENP024415 vhCDR2
WINTYTGEPTYADGFTG

SEQ ID NO: 35139 - protein, 8 aa, Artificial Sequence
  Description of Artificial Sequence: Synthetic peptide
  XENP024415 vhCDR3
DYYGSSPY

SEQ ID NO: 35140 - protein, 16 aa, Artificial Sequence
  Description of Artificial Sequence: Synthetic peptide
  XENP024415 vlCDR1
KASQSIVHSNGNTYLE

SEQ ID NO: 35141 - protein, 7 aa, Artificial Sequence
  Description of Artificial Sequence: Synthetic peptide
  XENP024415 vlCDR2
KVSNRFS

SEQ ID NO: 35142 - protein, 9 aa, Artificial Sequence
  Description of Artificial Sequence: Synthetic peptide
  XENP024415 vlCDR3
FQGSHVPNT

SEQ ID NO: 35143 - protein, 251 aa, Artificial Sequence
  Description of Artificial Sequence: Synthetic polypeptide
  XENP024416 1C11_H3_L3.135_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 35144 - protein, 117 aa, Artificial Sequence; identical to SEQ ID NO: 33034
  Description of Artificial Sequence: Synthetic polypeptide
  VH of XENP024416

SEQ ID NO: 35145 - protein, 114 aa, Artificial Sequence
  Description of Artificial Sequence: Synthetic polypeptide
  VL of XENP024416
DVVMTQSPDSLAVSLGERVTINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 35146 - protein, 5 aa, Artificial Sequence
  Description of Artificial Sequence: Synthetic peptide
  XENP024416 vhCDR1
HYGMN

SEQ ID NO: 35147 - protein, 17 aa, Artificial Sequence
  Description of Artificial Sequence: Synthetic peptide
  XENP024416 vhCDR2
WINTYTGEPTYADGFTG

SEQ ID NO: 35148 - protein, 8 aa, Artificial Sequence
  Description of Artificial Sequence: Synthetic peptide
  XENP024416 vhCDR3
DYYGSSPY

SEQ ID NO: 35149 - protein, 16 aa, Artificial Sequence
  Description of Artificial Sequence: Synthetic peptide
  XENP024416 vlCDR1
KASQSIVHSNGNTYLE

SEQ ID NO: 35150 - protein, 7 aa, Artificial Sequence
  Description of Artificial Sequence: Synthetic peptide
  XENP024416 vlCDR2
KVSNRFS

SEQ ID NO: 35151 - protein, 9 aa, Artificial Sequence
  Description of Artificial Sequence: Synthetic peptide
  XENP024416 vlCDR3
FQGSHVPNT

SEQ ID NO: 35152 - protein, 251 aa, Artificial Sequence
  Description of Artificial Sequence: Synthetic polypeptide
  XENP024417 1C11_H3_L3.136_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 35153 - protein, 117 aa, Artificial Sequence; identical to SEQ ID NO: 33034
  Description of Artificial Sequence: Synthetic polypeptide
  VH of XENP024417

SEQ ID NO: 35154 - protein, 114 aa, Artificial Sequence
  Description of Artificial Sequence: Synthetic polypeptide
  VL of XENP024417
DVVMTQSPDSLAVSLGERITINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 35155 - protein, 5 aa, Artificial Sequence
  Description of Artificial Sequence: Synthetic peptide
  XENP024417 vhCDR1
HYGMN

SEQ ID NO: 35156 - protein, 17 aa, Artificial Sequence
  Description of Artificial Sequence: Synthetic peptide
  XENP024417 vhCDR2
WINTYTGEPTYADGFTG

SEQ ID NO: 35157 - protein, 8 aa, Artificial Sequence
  Description of Artificial Sequence: Synthetic peptide
  XENP024417 vhCDR3
DYYGSSPY

SEQ ID NO: 35158 - protein, 16 aa, Artificial Sequence
  Description of Artificial Sequence: Synthetic peptide
  XENP024417 vlCDR1
KASQSIVHSNGNTYLE

SEQ ID NO: 35159 - protein, 7 aa, Artificial Sequence
  Description of Artificial Sequence: Synthetic peptide
  XENP024417 vlCDR2
KVSNRFS

SEQ ID NO: 35160 - protein, 9 aa, Artificial Sequence
  Description of Artificial Sequence: Synthetic peptide
  XENP024417 vlCDR3
FQGSHVPNT

SEQ ID NO: 35161 - protein, 251 aa, Artificial Sequence
  Description of Artificial Sequence: Synthetic polypeptide
  XENP024418 1C11_H3_L3.137_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35162 - protein, 117 aa, Artificial Sequence; identical to SEQ ID NO: 33034
  Description of Artificial Sequence: Synthetic polypeptide
  VH of XENP024418

SEQ ID NO: 35163 - protein, 114 aa, Artificial Sequence
  Description of Artificial Sequence: Synthetic polypeptide
  VL of XENP024418
DVVMTQSPDSLAVSLGERITINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35164 - protein, 5 aa, Artificial Sequence
  Description of Artificial Sequence: Synthetic peptide
  XENP024418 vhCDR1
HYGMN

SEQ ID NO: 35165 - protein, 17 aa, Artificial Sequence
  Description of Artificial Sequence: Synthetic peptide
  XENP024418 vhCDR2
WINTYTGEPTYADGFTG

SEQ ID NO: 35166 - protein, 8 aa, Artificial Sequence
  Description of Artificial Sequence: Synthetic peptide
  XENP024418 vhCDR3
DYYGSSPY

SEQ ID NO: 35167 - protein, 16 aa, Artificial Sequence
  Description of Artificial Sequence: Synthetic peptide
  XENP024418 vlCDR1
KASQSIVHSNGNTYLE

SEQ ID NO: 35168 - protein, 7 aa, Artificial Sequence
  Description of Artificial Sequence: Synthetic peptide
  XENP024418 vlCDR2
KVSNRFS

SEQ ID NO: 35169 - protein, 9 aa, Artificial Sequence
  Description of Artificial Sequence: Synthetic peptide
  XENP024418 vlCDR3
FQGSHVPNT

SEQ ID NO: 35170 - protein, 251 aa, Artificial Sequence
  Description of Artificial Sequence: Synthetic polypeptide
  XENP024419 1C11_H3_L3.138_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 35171 - protein, 117 aa, Artificial Sequence; identical to SEQ ID NO: 33034
  Description of Artificial Sequence: Synthetic polypeptide
  VH of XENP024419

SEQ ID NO: 35172 - protein, 114 aa, Artificial Sequence
  Description of Artificial Sequence: Synthetic polypeptide
  VL of XENP024419
DVVMTQSPDSLAVSLGERITINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 35173 - protein, 5 aa, Artificial Sequence
  Description of Artificial Sequence: Synthetic peptide
  XENP024419 vhCDR1
HYGMN

SEQ ID NO: 35174 - protein, 17 aa, Artificial Sequence
  Description of Artificial Sequence: Synthetic peptide
  XENP024419 vhCDR2
WINTYTGEPTYADGFTG

SEQ ID NO: 35175 - protein, 8 aa, Artificial Sequence
  Description of Artificial Sequence: Synthetic peptide
  XENP024419 vhCDR3
DYYGSSPY

SEQ ID NO: 35176 - protein, 16 aa, Artificial Sequence
  Description of Artificial Sequence: Synthetic peptide
  XENP024419 vlCDR1
KASQSIVHSNGNTYLE

SEQ ID NO: 35177 - protein, 7 aa, Artificial Sequence
  Description of Artificial Sequence: Synthetic peptide
  XENP024419 vlCDR2
KVSNRFS

SEQ ID NO: 35178 - protein, 9 aa, Artificial Sequence
  Description of Artificial Sequence: Synthetic peptide
  XENP024419 vlCDR3
FQGSHVPNT

SEQ ID NO: 35179 - protein, 251 aa, Artificial Sequence
  Description of Artificial Sequence: Synthetic polypeptide
  XENP024420 1C11_H3_L3.139_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGIPDRFSGSGSGTDFTLTISSVQAEDAATYYCFQGSHVPNTFGQGTKVEIKGS

SEQ ID NO: 35180 - protein, 117 aa, Artificial Sequence; identical to SEQ ID NO: 33034
  Description of Artificial Sequence: Synthetic polypeptide
  VH of XENP024420

SEQ ID NO: 35181 - protein, 114 aa, Artificial Sequence
  Description of Artificial Sequence: Synthetic polypeptide
  VL of XENP024420
DVVMTQSPDSLAVSLGERATINCKASQSIVHSNGNTYLEWYQQKPGQPPKLLIYKVSNRFSGIPDRFSGSGSGTDFTLTISSVQAEDAATYYCFQGSHVPNTFGQGTKVEIKGS

SEQ ID NO: 35182 - protein, 5 aa, Artificial Sequence
  Description of Artificial Sequence: Synthetic peptide
  XENP024420 vhCDR1
HYGMN

SEQ ID NO: 35183 - protein, 17 aa, Artificial Sequence
  Description of Artificial Sequence: Synthetic peptide
  XENP024420 vhCDR2
WINTYTGEPTYADGFTG

SEQ ID NO: 35184 - protein, 8 aa, Artificial Sequence
  Description of Artificial Sequence: Synthetic peptide
  XENP024420 vhCDR3
DYYGSSPY

SEQ ID NO: 35185 - protein, 16 aa, Artificial Sequence
  Description of Artificial Sequence: Synthetic peptide
  XENP024420 vlCDR1
KASQSIVHSNGNTYLE

SEQ ID NO: 35186 - protein, 7 aa, Artificial Sequence
  Description of Artificial Sequence: Synthetic peptide
  XENP024420 vlCDR2
KVSNRFS

SEQ ID NO: 35187 - protein, 9 aa, Artificial Sequence
  Description of Artificial Sequence: Synthetic peptide
  XENP024420 vlCDR3
FQGSHVPNT

SEQ ID NO: 35188 - protein, 251 aa, Artificial Sequence
  Description of Artificial Sequence: Synthetic polypeptide
  XENP024421 1C11_H3_L3.140_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQSPKLLIYKVSNRFSGVPDRFSGSGSGTDFTLTISSVEAEDVATYYCFQGSHVPNTFGQGTKVEIKGS

SEQ ID NO: 35189 - protein, 117 aa, Artificial Sequence; identical to SEQ ID NO: 33034
  Description of Artificial Sequence: Synthetic polypeptide
  VH of XENP024421

SEQ ID NO: 35190 - protein, 114 aa, Artificial Sequence
  Description of Artificial Sequence: Synthetic polypeptide
  VL of XENP024421
DIVMTQSPDSLAVSLGERATINCKASQSIVHSNGNTYLEWYQQKPGQSPKLLIYKVSNRFSGVPDRFSGSGSGTDFTLTISSVEAEDVATYYCFQGSHVPNTFGQGTKVEIKGS

SEQ ID NO: 35191 - protein, 5 aa, Artificial Sequence
  Description of Artificial Sequence: Synthetic peptide
  XENP024421 vhCDR1
HYGMN

SEQ ID NO: 35192 - protein, 17 aa, Artificial Sequence
  Description of Artificial Sequence: Synthetic peptide
  XENP024421 vhCDR2
WINTYTGEPTYADGFTG

SEQ ID NO: 35193 - protein, 8 aa, Artificial Sequence
  Description of Artificial Sequence: Synthetic peptide
  XENP024421 vhCDR3
DYYGSSPY

SEQ ID NO: 35194 - protein, 16 aa, Artificial Sequence
  Description of Artificial Sequence: Synthetic peptide
  XENP024421 vlCDR1
KASQSIVHSNGNTYLE

SEQ ID NO: 35195 - protein, 7 aa, Artificial Sequence
  Description of Artificial Sequence: Synthetic peptide
  XENP024421 vlCDR2
KVSNRFS

SEQ ID NO: 35196 - protein, 9 aa, Artificial Sequence
  Description of Artificial Sequence: Synthetic peptide
  XENP024421 vlCDR3
FQGSHVPNT

SEQ ID NO: 35197 - protein, 251 aa, Artificial Sequence
  Description of Artificial Sequence: Synthetic polypeptide
  XENP024422 1C11_H3_L3.141_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFSGVPDRFSGSGSGTDFTLTISSVEAEDVATYYCFQGSHVPNTFGQGTKVEIKGS

SEQ ID NO: 35198 - protein, 117 aa, Artificial Sequence; identical to SEQ ID NO: 33034
  Description of Artificial Sequence: Synthetic polypeptide
  VH of XENP024422

SEQ ID NO: 35199 - protein, 114 aa, Artificial Sequence
  Description of Artificial Sequence: Synthetic polypeptide
  VL of XENP024422
DIVMTQSPDSLAVSLGERATINCKASQSIVHSNGNTYLEWYQQKPGQPPKLLIYKVSNRFSGVPDRFSGSGSGTDFTLTISSVEAEDVATYYCFQGSHVPNTFGQGTKVEIKGS

SEQ ID NO: 35200 - protein, 5 aa, Artificial Sequence
  Description of Artificial Sequence: Synthetic peptide
  XENP024422 vhCDR1
HYGMN

SEQ ID NO: 35201 - protein, 17 aa, Artificial Sequence
  Description of Artificial Sequence: Synthetic peptide
  XENP024422 vhCDR2
WINTYTGEPTYADGFTG

SEQ ID NO: 35202 - protein, 8 aa, Artificial Sequence
  Description of Artificial Sequence: Synthetic peptide
  XENP024422 vhCDR3
DYYGSSPY

SEQ ID NO: 35203 - protein, 16 aa, Artificial Sequence
  Description of Artificial Sequence: Synthetic peptide
  XENP024422 vlCDR1
KASQSIVHSNGNTYLE

SEQ ID NO: 35204 - protein, 7 aa, Artificial Sequence
  Description of Artificial Sequence: Synthetic peptide
  XENP024422 vlCDR2
KVSNRFS

SEQ ID NO: 35205 - protein, 9 aa, Artificial Sequence
  Description of Artificial Sequence: Synthetic peptide
  XENP024422 vlCDR3
FQGSHVPNT

SEQ ID NO: 35206 - protein, 251 aa, Artificial Sequence
  Description of Artificial Sequence: Synthetic polypeptide
  XENP024423 1C11_H3_L3.142_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQAPKLLIYKVSNRFSGVPDRFSGSGSGTDFTLTISSVEAEDVATYYCFQGSHVPNTFGQGTKVEIKGS

SEQ ID NO: 35207 - protein, 117 aa, Artificial Sequence; identical to SEQ ID NO: 33034
  Description of Artificial Sequence: Synthetic polypeptide
  VH of XENP024423

SEQ ID NO: 35208 - protein, 114 aa, Artificial Sequence
  Description of Artificial Sequence: Synthetic polypeptide
  VL of XENP024423
DIVMTQSPDSLAVSLGERATINCKASQSIVHSNGNTYLEWYQQKPGQAPKLLIYKVSNRFSGVPDRFSGSGSGTDFTLTISSVEAEDVATYYCFQGSHVPNTFGQGTKVEIKGS

SEQ ID NO: 35209 - protein, 5 aa, Artificial Sequence
  Description of Artificial Sequence: Synthetic peptide
  XENP024423 vhCDR1
HYGMN

SEQ ID NO: 35210 - protein, 17 aa, Artificial Sequence
  Description of Artificial Sequence: Synthetic peptide
  XENP024423 vhCDR2
WINTYTGEPTYADGFTG

SEQ ID NO: 35211 - protein, 8 aa, Artificial Sequence
  Description of Artificial Sequence: Synthetic peptide
  XENP024423 vhCDR3
DYYGSSPY

SEQ ID NO: 35212 - protein, 16 aa, Artificial Sequence
  Description of Artificial Sequence: Synthetic peptide
  XENP024423 vlCDR1
KASQSIVHSNGNTYLE

SEQ ID NO: 35213 - protein, 7 aa, Artificial Sequence
  Description of Artificial Sequence: Synthetic peptide
  XENP024423 vlCDR2
KVSNRFS

SEQ ID NO: 35214 - protein, 9 aa, Artificial Sequence
  Description of Artificial Sequence: Synthetic peptide
  XENP024423 vlCDR3
FQGSHVPNT

SEQ ID NO: 35215 - protein, 251 aa, Artificial Sequence
  Description of Artificial Sequence: Synthetic polypeptide
  XENP024424 1C11_H3.176_L3_scFv
QIQLVQSGSELKKPGASVKVSCKASGYTFTHYGMNWVRQAPGQGLEWMGWINTYTGEPTYAPGFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35216 - protein, 117 aa, Artificial Sequence
  Description of Artificial Sequence: Synthetic polypeptide
  VH of XENP024424
QIQLVQSGSELKKPGASVKVSCKASGYTFTHYGMNWVRQAPGQGLEWMGWINTYTGEPTYAPGFKGRFVFSLDTSVSTAYLQISSLKAEDTAVYFCARDYYGSSPYWGQGTLVTVSS

SEQ ID NO: 35217 - protein, 114 aa, Artificial Sequence; identical to SEQ ID NO: 33651
  Description of Artificial Sequence: Synthetic polypeptide
  VL of XENP024424

SEQ ID NO: 35218 - protein, 5 aa, Artificial Sequence
  Description of Artificial Sequence: Synthetic peptide
  XENP024424 vhCDR1
HYGMN

SEQ ID NO: 35219 - protein, 17 aa, Artificial Sequence
  Description of Artificial Sequence: Synthetic peptide
  XENP024424 vhCDR2
WINTYTGEPTYAPGFKG

SEQ ID NO: 35220 - protein, 8 aa, Artificial Sequence
  Description of Artificial Sequence: Synthetic peptide
  XENP024424 vhCDR3
DYYGSSPY

SEQ ID NO: 35221 - protein, 16 aa, Artificial Sequence
  Description of Artificial Sequence: Synthetic peptide
  XENP024424 vlCDR1
KSSQSIVHSNGNTYLE

SEQ ID NO: 35222 - protein, 7 aa, Artificial Sequence
  Description of Artificial Sequence: Synthetic peptide
  XENP024424 vlCDR2
KVSNRFS

SEQ ID NO: 35223 - protein, 9 aa, Artificial Sequence
  Description of Artificial Sequence: Synthetic peptide
  XENP024424 vlCDR3
FQGSHVPNT

SEQ ID NO: 35224 - protein, 251 aa, Artificial Sequence
  Description of Artificial Sequence: Synthetic polypeptide
  XENP024425 1C11_H3.177_L3_scFv
QIQLVQSGSELKKPGASVKVSCKASGYTFTHYGMNWVRQAPGQGLEWMGWINTYTGEPTYAPKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35225 - protein, 117 aa, Artificial Sequence
  Description of Artificial Sequence: Synthetic polypeptide
  VH of XENP024425
QIQLVQSGSELKKPGASVKVSCKASGYTFTHYGMNWVRQAPGQGLEWMGWINTYTGEPTYAPKFTGRFVFSLDTSVSTAYLQISSLKAEDTAVYFCARDYYGSSPYWGQGTLVTVSS

SEQ ID NO: 35226 - protein, 114 aa, Artificial Sequence; identical to SEQ ID NO: 33651
  Description of Artificial Sequence: Synthetic polypeptide
  VL of XENP024425

SEQ ID NO: 35227 - protein, 5 aa, Artificial Sequence
  Description of Artificial Sequence: Synthetic peptide
  XENP024425 vhCDR1
HYGMN

SEQ ID NO: 35228 - protein, 17 aa, Artificial Sequence
  Description of Artificial Sequence: Synthetic peptide
  XENP024425 vhCDR2
WINTYTGEPTYAPKFTG

SEQ ID NO: 35229 - protein, 8 aa, Artificial Sequence
  Description of Artificial Sequence: Synthetic peptide
  XENP024425 vhCDR3
DYYGSSPY

SEQ ID NO: 35230 - protein, 16 aa, Artificial Sequence
  Description of Artificial Sequence: Synthetic peptide
  XENP024425 vlCDR1
KSSQSIVHSNGNTYLE

SEQ ID NO: 35231 - protein, 7 aa, Artificial Sequence
  Description of Artificial Sequence: Synthetic peptide
  XENP024425 vlCDR2
KVSNRFS

SEQ ID NO: 35232 - protein, 9 aa, Artificial Sequence
  Description of Artificial Sequence: Synthetic peptide
  XENP024425 vlCDR3
FQGSHVPNT

SEQ ID NO: 35233 - protein, 251 aa, Artificial Sequence
  Description of Artificial Sequence: Synthetic polypeptide
  XENP024426 1C11_H3.178_L3_scFv
QIQLVQSGSELKKPGASVKVSCKASGYTFTHYGMNWVRQAPGQGLEWMGWINTYTGEPTYAPGFKERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35234 - protein, 117 aa, Artificial Sequence
  Description of Artificial Sequence: Synthetic polypeptide
  VH of XENP024426
QIQLVQSGSELKKPGASVKVSCKASGYTFTHYGMNWVRQAPGQGLEWMGWINTYTGEPTYAPGFKERFVFSLDTSVSTAYLQISSLKAEDTAVYFCARDYYGSSPYWGQGTLVTVSS

SEQ ID NO: 35235 - protein, 114 aa, Artificial Sequence; identical to SEQ ID NO: 33651
  Description of Artificial Sequence: Synthetic polypeptide
  VL of XENP024426

SEQ ID NO: 35236 - protein, 5 aa, Artificial Sequence
  Description of Artificial Sequence: Synthetic peptide
  XENP024426 vhCDR1
HYGMN

SEQ ID NO: 35237 - protein, 17 aa, Artificial Sequence
  Description of Artificial Sequence: Synthetic peptide
  XENP024426 vhCDR2
WINTYTGEPTYAPGFKE

SEQ ID NO: 35238 - protein, 8 aa, Artificial Sequence
  Description of Artificial Sequence: Synthetic peptide
  XENP024426 vhCDR3
DYYGSSPY

SEQ ID NO: 35239 - protein, 16 aa, Artificial Sequence
  Description of Artificial Sequence: Synthetic peptide
  XENP024426 vlCDR1
KSSQSIVHSNGNTYLE

SEQ ID NO: 35240 - protein, 7 aa, Artificial Sequence
  Description of Artificial Sequence: Synthetic peptide
  XENP024426 vlCDR2
KVSNRFS

SEQ ID NO: 35241 - protein, 9 aa, Artificial Sequence
  Description of Artificial Sequence: Synthetic peptide
  XENP024426 vlCDR3
FQGSHVPNT

SEQ ID NO: 35242 - protein, 251 aa, Artificial Sequence
  Description of Artificial Sequence: Synthetic polypeptide
  XENP024427 1C11_H3.179_L3_scFv
QIQLVQSGSELKKPGASVKVSCKASGYTFTHYGMNWVRQAPGQGLEWMGWINTYTGEPTYAPKFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35243 - protein, 117 aa, Artificial Sequence
  Description of Artificial Sequence: Synthetic polypeptide
  VH of XENP024427
QIQLVQSGSELKKPGASVKVSCKASGYTFTHYGMNWVRQAPGQGLEWMGWINTYTGEPTYAPKFTERFVFSLDTSVSTAYLQISSLKAEDTAVYFCARDYYGSSPYWGQGTLVTVSS

SEQ ID NO: 35244 - protein, 114 aa, Artificial Sequence; identical to SEQ ID NO: 33651
  Description of Artificial Sequence: Synthetic polypeptide
  VL of XENP024427

SEQ ID NO: 35245 - protein, 5 aa, Artificial Sequence
  Description of Artificial Sequence: Synthetic peptide
  XENP024427 vhCDR1
HYGMN

SEQ ID NO: 35246 - protein, 17 aa, Artificial Sequence
  Description of Artificial Sequence: Synthetic peptide
  XENP024427 vhCDR2
WINTYTGEPTYAPKFTE

SEQ ID NO: 35247 - protein, 8 aa, Artificial Sequence
  Description of Artificial Sequence: Synthetic peptide
  XENP024427 vhCDR3
DYYGSSPY

SEQ ID NO: 35248 - protein, 16 aa, Artificial Sequence
  Description of Artificial Sequence: Synthetic peptide
  XENP024427 vlCDR1
KSSQSIVHSNGNTYLE

SEQ ID NO: 35249 - protein, 7 aa, Artificial Sequence
  Description of Artificial Sequence: Synthetic peptide
  XENP024427 vlCDR2
KVSNRFS

SEQ ID NO: 35250 - protein, 9 aa, Artificial Sequence
  Description of Artificial Sequence: Synthetic peptide
  XENP024427 vlCDR3
FQGSHVPNT

SEQ ID NO: 35251 - protein, 251 aa, Artificial Sequence
  Description of Artificial Sequence: Synthetic polypeptide
  XENP024428 1C11_H3.180_L3_scFv
QIQLVQSGSELKKPGASVKVSCKASGYTFTHYGINWVRQAPGQGLEWMGWINTYTGEPTYADGFTGRFVFSVDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35252 - protein, 117 aa, Artificial Sequence
  Description of Artificial Sequence: Synthetic polypeptide
  VH of XENP024428
QIQLVQSGSELKKPGASVKVSCKASGYTFTHYGINWVRQAPGQGLEWMGWINTYTGEPTYADGFTGRFVFSVDTSVSTAYLQISSLKAEDTAVYFCARDYYGSSPYWGQGTLVTVSS

SEQ ID NO: 35253 - protein, 114 aa, Artificial Sequence; identical to SEQ ID NO: 33651
  Description of Artificial Sequence: Synthetic polypeptide
  VL of XENP024428

SEQ ID NO: 35254 - protein, 5 aa, Artificial Sequence
  Description of Artificial Sequence: Synthetic peptide
  XENP024428 vhCDR1
HYGIN

SEQ ID NO: 35255 - protein, 17 aa, Artificial Sequence
  Description of Artificial Sequence: Synthetic peptide
  XENP024428 vhCDR2
WINTYTGEPTYADGFTG

SEQ ID NO: 35256 - protein, 8 aa, Artificial Sequence
  Description of Artificial Sequence: Synthetic peptide
  XENP024428 vhCDR3
DYYGSSPY

SEQ ID NO: 35257 - protein, 16 aa, Artificial Sequence
  Description of Artificial Sequence: Synthetic peptide
  XENP024428 vlCDR1
KSSQSIVHSNGNTYLE

SEQ ID NO: 35258 - protein, 7 aa, Artificial Sequence
  Description of Artificial Sequence: Synthetic peptide
  XENP024428 vlCDR2
KVSNRFS

SEQ ID NO: 35259 - protein, 9 aa, Artificial Sequence
  Description of Artificial Sequence: Synthetic peptide
  XENP024428 vlCDR3
FQGSHVPNT

SEQ ID NO: 35260 - protein, 251 aa, Artificial Sequence
  Description of Artificial Sequence: Synthetic polypeptide
  XENP024429 1C11_H3.181_L3_scFv
QIQLVQSGSELKKPGASVKVSCKASGYTFTHYGINWVRQAPGQGLEWMGWINTYTGEPTYADGFTGRFVFSIDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35261 - protein, 117 aa, Artificial Sequence
  Description of Artificial Sequence: Synthetic polypeptide
  VH of XENP024429
QIQLVQSGSELKKPGASVKVSCKASGYTFTHYGINWVRQAPGQGLEWMGWINTYTGEPTYADGFTGRFVFSIDTSVSTAYLQISSLKAEDTAVYFCARDYYGSSPYWGQGTLVTVSS

SEQ ID NO: 35262 - protein, 114 aa, Artificial Sequence; identical to SEQ ID NO: 33651
  Description of Artificial Sequence: Synthetic polypeptide
  VL of XENP024429

SEQ ID NO: 35263 - protein, 5 aa, Artificial Sequence
  Description of Artificial Sequence: Synthetic peptide
  XENP024429 vhCDR1
HYGIN

SEQ ID NO: 35264 - protein, 17 aa, Artificial Sequence
  Description of Artificial Sequence: Synthetic peptide
  XENP024429 vhCDR2
WINTYTGEPTYADGFTG

SEQ ID NO: 35265 - protein, 8 aa, Artificial Sequence
  Description of Artificial Sequence: Synthetic peptide
  XENP024429 vhCDR3
DYYGSSPY

SEQ ID NO: 35266 - protein, 16 aa, Artificial Sequence
  Description of Artificial Sequence: Synthetic peptide
  XENP024429 vlCDR1
KSSQSIVHSNGNTYLE

SEQ ID NO: 35267 - protein, 7 aa, Artificial Sequence
  Description of Artificial Sequence: Synthetic peptide
  XENP024429 vlCDR2
KVSNRFS

SEQ ID NO: 35268 - protein, 9 aa, Artificial Sequence
  Description of Artificial Sequence: Synthetic peptide
  XENP024429 vlCDR3
FQGSHVPNT

SEQ ID NO: 35269 - protein, 251 aa, Artificial Sequence
  Description of Artificial Sequence: Synthetic polypeptide
  XENP024430 1C11_H3.182_L3_scFv
QIQLVQSGSELVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35270 - protein, 117 aa, Artificial Sequence
  Description of Artificial Sequence: Synthetic polypeptide
  VH of XENP024430
QIQLVQSGSELVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 35271 - protein, 114 aa, Artificial Sequence; identical to SEQ ID NO: 33651
  Description of Artificial Sequence: Synthetic polypeptide
  VL of XENP024430

SEQ ID NO: 35272 - protein, 5 aa, Artificial Sequence
  Description of Artificial Sequence: Synthetic peptide
  XENP024430 vhCDR1
HYGMN

SEQ ID NO: 35273 - protein, 17 aa, Artificial Sequence
  Description of Artificial Sequence: Synthetic peptide
  XENP024430 vhCDR2
WINTYTGEPTYADGFTG

SEQ ID NO: 35274 - protein, 8 aa, Artificial Sequence
  Description of Artificial Sequence: Synthetic peptide
  XENP024430 vhCDR3
DYYGSSPY

SEQ ID NO: 35275 - protein, 16 aa, Artificial Sequence
  Description of Artificial Sequence: Synthetic peptide
  XENP024430 vlCDR1
KSSQSIVHSNGNTYLE

SEQ ID NO: 35276 - protein, 7 aa, Artificial Sequence
  Description of Artificial Sequence: Synthetic peptide
  XENP024430 vlCDR2
KVSNRFS

SEQ ID NO: 35277 - protein, 9 aa, Artificial Sequence
  Description of Artificial Sequence: Synthetic peptide
  XENP024430 vlCDR3
FQGSHVPNT

SEQ ID NO: 35278 - protein, 251 aa, Artificial Sequence
  Description of Artificial Sequence: Synthetic polypeptide
  XENP024431 1C11_H3.183_L3_scFv
QIQLVQSGSVLKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35279 - protein, 117 aa, Artificial Sequence
  Description of Artificial Sequence: Synthetic polypeptide
  VH of XENP024431
QIQLVQSGSVLKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 35280 - protein, 114 aa, Artificial Sequence; identical to SEQ ID NO: 33651
  Description of Artificial Sequence: Synthetic polypeptide
  VL of XENP024431

SEQ ID NO: 35281 - protein, 5 aa, Artificial Sequence
  Description of Artificial Sequence: Synthetic peptide
  XENP024431 vhCDR1
HYGMN

SEQ ID NO: 35282 - protein, 17 aa, Artificial Sequence
  Description of Artificial Sequence: Synthetic peptide
  XENP024431 vhCDR2
WINTYTGEPTYADGFTG

SEQ ID NO: 35283 - protein, 8 aa, Artificial Sequence
  Description of Artificial Sequence: Synthetic peptide
  XENP024431 vhCDR3
DYYGSSPY

SEQ ID NO: 35284 - protein, 16 aa, Artificial Sequence
  Description of Artificial Sequence: Synthetic peptide
  XENP024431 vlCDR1
KSSQSIVHSNGNTYLE

SEQ ID NO: 35285 - protein, 7 aa, Artificial Sequence
  Description of Artificial Sequence: Synthetic peptide
  XENP024431 vlCDR2
KVSNRFS

SEQ ID NO: 35286 - protein, 9 aa, Artificial Sequence
  Description of Artificial Sequence: Synthetic peptide
  XENP024431 vlCDR3
FQGSHVPNT

SEQ ID NO: 35287 - protein, 251 aa, Artificial Sequence
  Description of Artificial Sequence: Synthetic polypeptide
  XENP024432 1C11_H3.184_L3_scFv
QIQLVQSGSVLVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35288 - protein, 117 aa, Artificial Sequence
  Description of Artificial Sequence: Synthetic polypeptide
  VH of XENP024432
QIQLVQSGSVLVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 35289 - protein, 114 aa, Artificial Sequence; identical to SEQ ID NO: 33651
  Description of Artificial Sequence: Synthetic polypeptide
  VL of XENP024432

SEQ ID NO: 35290 - protein, 5 aa, Artificial Sequence
  Description of Artificial Sequence: Synthetic peptide
  XENP024432 vhCDR1
HYGMN

SEQ ID NO: 35291 - protein, 17 aa, Artificial Sequence
  Description of Artificial Sequence: Synthetic peptide
  XENP024432 vhCDR2
WINTYTGEPTYADGFTG

SEQ ID NO: 35292 - protein, 8 aa, Artificial Sequence
  Description of Artificial Sequence: Synthetic peptide
  XENP024432 vhCDR3
DYYGSSPY

SEQ ID NO: 35293 - protein, 16 aa, Artificial Sequence
  Description of Artificial Sequence: Synthetic peptide
  XENP024432 vlCDR1
KSSQSIVHSNGNTYLE

SEQ ID NO: 35294 - protein, 7 aa, Artificial Sequence
  Description of Artificial Sequence: Synthetic peptide
  XENP024432 vlCDR2
KVSNRFS

SEQ ID NO: 35295 - protein, 9 aa, Artificial Sequence
  Description of Artificial Sequence: Synthetic peptide
  XENP024432 vlCDR3
FQGSHVPNT

SEQ ID NO: 35296 - protein, 251 aa, Artificial Sequence
  Description of Artificial Sequence: Synthetic polypeptide
  XENP024433 1C11_H3.185_L3_scFv
EVQLVQSGSELVKPGESVKVSCKASGYTFTHYGINWVRQPPGQGLEWIGWINTYTGEPYYAPKFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35297 - protein, 117 aa, Artificial Sequence
  Description of Artificial Sequence: Synthetic polypeptide
  VH of XENP024433
EVQLVQSGSELVKPGESVKVSCKASGYTFTHYGINWVRQPPGQGLEWIGWINTYTGEPYYAPKFTERFVFSLDTSQDTAYLQINSLKAEDTAVYYCARDYYGSSPYWGQGTLVTVSS

SEQ ID NO: 35298 - protein, 114 aa, Artificial Sequence; identical to SEQ ID NO: 33651
  Description of Artificial Sequence: Synthetic polypeptide
  VL of XENP024433

SEQ ID NO: 35299 - protein, 5 aa, Artificial Sequence
  Description of Artificial Sequence: Synthetic peptide
  XENP024433 vhCDR1
HYGIN

SEQ ID NO: 35300 - protein, 17 aa, Artificial Sequence
  Description of Artificial Sequence: Synthetic peptide
  XENP024433 vhCDR2
WINTYTGEPYYAPKFTE

SEQ ID NO: 35301 - protein, 8 aa, Artificial Sequence
  Description of Artificial Sequence: Synthetic peptide
  XENP024433 vhCDR3
DYYGSSPY

SEQ ID NO: 35302 - protein, 16 aa, Artificial Sequence
  Description of Artificial Sequence: Synthetic peptide
  XENP024433 vlCDR1
KSSQSIVHSNGNTYLE

SEQ ID NO: 35303 - protein, 7 aa, Artificial Sequence
  Description of Artificial Sequence: Synthetic peptide
  XENP024433 vlCDR2
KVSNRFS

SEQ ID NO: 35304 - protein, 9 aa, Artificial Sequence
  Description of Artificial Sequence: Synthetic peptide
  XENP024433 vlCDR3
FQGSHVPNT

SEQ ID NO: 35305 - protein, 251 aa, Artificial Sequence
  Description of Artificial Sequence: Synthetic polypeptide
  XENP024434 1C11_H3.186_L3_scFv
EVQLVQSGSELVKPGESVKVSCKASGYTFTHYGINWVRQPPGQGLEWMGWINTYTGEPYYAPGFTERFVFSLDTSVDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35306 - protein, 117 aa, Artificial Sequence
  Description of Artificial Sequence: Synthetic polypeptide
  VH of XENP024434
EVQLVQSGSELVKPGESVKVSCKASGYTFTHYGINWVRQPPGQGLEWMGWINTYTGEPYYAPGFTERFVFSLDTSVDTAYLQINSLKAEDTAVYYCARDYYGSSPYWGQGTLVTVSS

SEQ ID NO: 35307 - protein, 114 aa, Artificial Sequence; identical to SEQ ID NO: 33651
  Description of Artificial Sequence: Synthetic polypeptide
  VL of XENP024434

SEQ ID NO: 35308 - protein, 5 aa, Artificial Sequence
  Description of Artificial Sequence: Synthetic peptide
  XENP024434 vhCDR1
HYGIN

SEQ ID NO: 35309 - protein, 17 aa, Artificial Sequence
  Description of Artificial Sequence: Synthetic peptide
  XENP024434 vhCDR2
WINTYTGEPYYAPGFTE

SEQ ID NO: 35310 - protein, 8 aa, Artificial Sequence
  Description of Artificial Sequence: Synthetic peptide
  XENP024434 vhCDR3
DYYGSSPY

SEQ ID NO: 35311 - protein, 16 aa, Artificial Sequence
  Description of Artificial Sequence: Synthetic peptide
  XENP024434 vlCDR1
KSSQSIVHSNGNTYLE

SEQ ID NO: 35312 - protein, 7 aa, Artificial Sequence
  Description of Artificial Sequence: Synthetic peptide
  XENP024434 vlCDR2
KVSNRFS

SEQ ID NO: 35313 - protein, 9 aa, Artificial Sequence
  Description of Artificial Sequence: Synthetic peptide
  XENP024434 vlCDR3
FQGSHVPNT

SEQ ID NO: 35314 - protein, 251 aa, Artificial Sequence
  Description of Artificial Sequence: Synthetic polypeptide
  XENP024435 1C11_H3.187_L3_scFv
QVQLVQSGSELVKPGESVKVSCKASGYTFTHYGINWVRQPPGQGLEWMGWINTYTGEPYYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35315 - protein, 117 aa, Artificial Sequence
  Description of Artificial Sequence: Synthetic polypeptide
  VH of XENP024435
QVQLVQSGSELVKPGESVKVSCKASGYTFTHYGINWVRQPPGQGLEWMGWINTYTGEPYYAPGFTERFVFSLDTSQSTAYLQINSLKAEDTAVYYCARDYYGSSPYWGQGTLVTVSS

SEQ ID NO: 35316 - protein, 114 aa, Artificial Sequence; identical to SEQ ID NO: 33651
  Description of Artificial Sequence: Synthetic polypeptide
  VL of XENP024435

SEQ ID NO: 35317 - protein, 5 aa, Artificial Sequence
  Description of Artificial Sequence: Synthetic peptide
  XENP024435 vhCDR1
HYGIN

SEQ ID NO: 35318 - protein, 17 aa, Artificial Sequence
  Description of Artificial Sequence: Synthetic peptide
  XENP024435 vhCDR2
WINTYTGEPYYAPGFTE

SEQ ID NO: 35319 - protein, 8 aa, Artificial Sequence
  Description of Artificial Sequence: Synthetic peptide
  XENP024435 vhCDR3
DYYGSSPY

SEQ ID NO: 35320 - protein, 16 aa, Artificial Sequence
  Description of Artificial Sequence: Synthetic peptide
  XENP024435 vlCDR1
KSSQSIVHSNGNTYLE

SEQ ID NO: 35321 - protein, 7 aa, Artificial Sequence
  Description of Artificial Sequence: Synthetic peptide
  XENP024435 vlCDR2
KVSNRFS

SEQ ID NO: 35322 - protein, 9 aa, Artificial Sequence
  Description of Artificial Sequence: Synthetic peptide
  XENP024435 vlCDR3
FQGSHVPNT

SEQ ID NO: 35323 - protein, 251 aa, Artificial Sequence
  Description of Artificial Sequence: Synthetic polypeptide
  XENP024436 1C11_H3.188_L3_scFv
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35324 - protein, 117 aa, Artificial Sequence
  Description of Artificial Sequence: Synthetic polypeptide
  VH of XENP024436
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 35325 - protein, 114 aa, Artificial Sequence; identical to SEQ ID NO: 33651
  Description of Artificial Sequence: Synthetic polypeptide
  VL of XENP024436

SEQ ID NO: 35326 - protein, 5 aa, Artificial Sequence
  Description of Artificial Sequence: Synthetic peptide
  XENP024436 vhCDR1
HYGIN

SEQ ID NO: 35327 - protein, 17 aa, Artificial Sequence
  Description of Artificial Sequence: Synthetic peptide
  XENP024436 vhCDR2
WINTYTGEPYYAPGFTG

SEQ ID NO: 35328 - protein, 8 aa, Artificial Sequence
  Description of Artificial Sequence: Synthetic peptide
  XENP024436 vhCDR3
DYYGSSPY

SEQ ID NO: 35329 - protein, 16 aa, Artificial Sequence
  Description of Artificial Sequence: Synthetic peptide
  XENP024436 vlCDR1
KSSQSIVHSNGNTYLE

SEQ ID NO: 35330 - protein, 7 aa, Artificial Sequence
  Description of Artificial Sequence: Synthetic peptide
  XENP024436 vlCDR2
KVSNRFS

SEQ ID NO: 35331 - protein, 9 aa, Artificial Sequence
  Description of Artificial Sequence: Synthetic peptide
  XENP024436 vlCDR3
FQGSHVPNT

SEQ ID NO: 35332 - protein, 251 aa, Artificial Sequence
  Description of Artificial Sequence: Synthetic polypeptide
  XENP024437 1C11_H3.189_L3_scFv
QVQLVQSGSELKKPGASVKVSCKASGYTFTHYGINWVRQPPGQGLEWIGWINTYTGEPYYAPKFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35333 - protein, 117 aa, Artificial Sequence
  Description of Artificial Sequence: Synthetic polypeptide
  VH of XENP024437
QVQLVQSGSELKKPGASVKVSCKASGYTFTHYGINWVRQPPGQGLEWIGWINTYTGEPYYAPKFTGRFVFSLDTSVSTAYLQINSLKAEDTAVYYCARDYYGSSPYWGQGTLVTVSS

SEQ ID NO: 35334 - protein, 114 aa, Artificial Sequence; identical to SEQ ID NO: 33651
  Description of Artificial Sequence: Synthetic polypeptide
  VL of XENP024437

SEQ ID NO: 35335 - protein, 5 aa, Artificial Sequence
  Description of Artificial Sequence: Synthetic peptide
  XENP024437 vhCDR1
HYGIN

SEQ ID NO: 35336 - protein, 17 aa, Artificial Sequence
  Description of Artificial Sequence: Synthetic peptide
  XENP024437 vhCDR2
WINTYTGEPYYAPKFTG

SEQ ID NO: 35337 - protein, 8 aa, Artificial Sequence
  Description of Artificial Sequence: Synthetic peptide
  XENP024437 vhCDR3
DYYGSSPY

SEQ ID NO: 35338 - protein, 16 aa, Artificial Sequence
  Description of Artificial Sequence: Synthetic peptide
  XENP024437 vlCDR1
KSSQSIVHSNGNTYLE

SEQ ID NO: 35339 - protein, 7 aa, Artificial Sequence
  Description of Artificial Sequence: Synthetic peptide
  XENP024437 vlCDR2
KVSNRFS

SEQ ID NO: 35340 - protein, 9 aa, Artificial Sequence
  Description of Artificial Sequence: Synthetic peptide
  XENP024437 vlCDR3
FQGSHVPNT

SEQ ID NO: 35341 - protein, 251 aa, Artificial Sequence
  Description of Artificial Sequence: Synthetic polypeptide
  XENP024438 1C11_H3.190_L3_scFv
QVQLVQSGSVLKKPGGSVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35342 - protein, 117 aa, Artificial Sequence
  Description of Artificial Sequence: Synthetic polypeptide
  VH of XENP024438
QVQLVQSGSVLKKPGGSVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 35343 - protein, 114 aa, Artificial Sequence; identical to SEQ ID NO: 33651
  Description of Artificial Sequence: Synthetic polypeptide
  VL of XENP024438

SEQ ID NO: 35344 - protein, 5 aa, Artificial Sequence
  Description of Artificial Sequence: Synthetic peptide
  XENP024438 vhCDR1
HYGIN

SEQ ID NO: 35345 - protein, 17 aa, Artificial Sequence
  Description of Artificial Sequence: Synthetic peptide
  XENP024438 vhCDR2
WINTYTGEPYYAPGFTG

SEQ ID NO: 35346 - protein, 8 aa, Artificial Sequence
  Description of Artificial Sequence: Synthetic peptide
  XENP024438 vhCDR3
DYYGSSPY

SEQ ID NO: 35347 - protein, 16 aa, Artificial Sequence
  Description of Artificial Sequence: Synthetic peptide
  XENP024438 vlCDR1
KSSQSIVHSNGNTYLE

SEQ ID NO: 35348 - protein, 7 aa, Artificial Sequence
  Description of Artificial Sequence: Synthetic peptide
  XENP024438 vlCDR2
KVSNRFS

SEQ ID NO: 35349 - protein, 9 aa, Artificial Sequence
  Description of Artificial Sequence: Synthetic peptide
  XENP024438 vlCDR3
FQGSHVPNT

SEQ ID NO: 35350 - protein, 251 aa, Artificial Sequence
  Description of Artificial Sequence: Synthetic polypeptide
  XENP024439 1C11_H3.191_L3_scFv
QVQLVQSGSELVKPGESVKVSCKASGYTFTHYGMNWVRQAPGQGLEWMGWINTYTGEPTYAPGFTGRFVFSLDTSQSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35351 - protein, 117 aa, Artificial Sequence
  Description of Artificial Sequence: Synthetic polypeptide
  VH of XENP024439
QVQLVQSGSELVKPGESVKVSCKASGYTFTHYGMNWVRQAPGQGLEWMGWINTYTGEPTYAPGFTGRFVFSLDTSQSTAYLQINSLKAEDTAVYFCARDYYGSSPYWGQGTLVTVSS

SEQ ID NO: 35352 - protein, 114 aa, Artificial Sequence; identical to SEQ ID NO: 33651
  Description of Artificial Sequence: Synthetic polypeptide
  VL of XENP024439

SEQ ID NO: 35353 - protein, 5 aa, Artificial Sequence
  Description of Artificial Sequence: Synthetic peptide
  XENP024439 vhCDR1
HYGMN

SEQ ID NO: 35354 - protein, 17 aa, Artificial Sequence
  Description of Artificial Sequence: Synthetic peptide
  XENP024439 vhCDR2
WINTYTGEPTYAPGFTG

SEQ ID NO: 35355 - protein, 8 aa, Artificial Sequence
  Description of Artificial Sequence: Synthetic peptide
  XENP024439 vhCDR3
DYYGSSPY

SEQ ID NO: 35356 - protein, 16 aa, Artificial Sequence
  Description of Artificial Sequence: Synthetic peptide
  XENP024439 vlCDR1
KSSQSIVHSNGNTYLE

SEQ ID NO: 35357 - protein, 7 aa, Artificial Sequence
  Description of Artificial Sequence: Synthetic peptide
  XENP024439 vlCDR2
KVSNRFS

SEQ ID NO: 35358 - protein, 9 aa, Artificial Sequence
  Description of Artificial Sequence: Synthetic peptide
  XENP024439 vlCDR3
FQGSHVPNT

SEQ ID NO: 35359 - protein, 251 aa, Artificial Sequence
  Description of Artificial Sequence: Synthetic polypeptide
  XENP024440 1C11_H3.192_L3_scFv
EVQLVQSGSVLKKPGESVKVSCKASGYTFTHYGINWVRQAPGQGLEWMGWINTYTGEPTYADGFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35360 - protein, 117 aa, Artificial Sequence
  Description of Artificial Sequence: Synthetic polypeptide
  VH of XENP024440
EVQLVQSGSVLKKPGESVKVSCKASGYTFTHYGINWVRQAPGQGLEWMGWINTYTGEPTYADGFTERFVFSLDTSVSTAYLQISSLKAEDTAVYFCARDYYGSSPYWGQGTLVTVSS

SEQ ID NO: 35361 - protein, 114 aa, Artificial Sequence; identical to SEQ ID NO: 33651
  Description of Artificial Sequence: Synthetic polypeptide
  VL of XENP024440

SEQ ID NO: 35362 - protein, 5 aa, Artificial Sequence
  Description of Artificial Sequence: Synthetic peptide
  XENP024440 vhCDR1
HYGIN

SEQ ID NO: 35363 - protein, 17 aa, Artificial Sequence
  Description of Artificial Sequence: Synthetic peptide
  XENP024440 vhCDR2
WINTYTGEPTYADGFTE

SEQ ID NO: 35364 - protein, 8 aa, Artificial Sequence
  Description of Artificial Sequence: Synthetic peptide
  XENP024440 vhCDR3
DYYGSSPY

SEQ ID NO: 35365 - protein, 16 aa, Artificial Sequence
  Description of Artificial Sequence: Synthetic peptide
  XENP024440 vlCDR1
KSSQSIVHSNGNTYLE

SEQ ID NO: 35366 - protein, 7 aa, Artificial Sequence
  Description of Artificial Sequence: Synthetic peptide
  XENP024440 vlCDR2
KVSNRFS

SEQ ID NO: 35367 - protein, 9 aa, Artificial Sequence
  Description of Artificial Sequence: Synthetic peptide
  XENP024440 vlCDR3
FQGSHVPNT

SEQ ID NO: 35368 - protein, 251 aa, Artificial Sequence
  Description of Artificial Sequence: Synthetic polypeptide
  XENP024441 1C11_H3.193_L3_scFv
QIQLVQSGSELKKPGASVKVSCKASGYTFTHYGMNWVRQPPGQGLEWIGWINTYTGEPTYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35369 - protein, 117 aa, Artificial Sequence
  Description of Artificial Sequence: Synthetic polypeptide
  VH of XENP024441
QIQLVQSGSELKKPGASVKVSCKASGYTFTHYGMNWVRQPPGQGLEWIGWINTYTGEPTYAPGFTERFVFSLDTSQSTAYLQINSLKAEDTAVYYCARDYYGSSPYWGQGTLVTVSS

SEQ ID NO: 35370 - protein, 114 aa, Artificial Sequence; identical to SEQ ID NO: 33651
  Description of Artificial Sequence: Synthetic polypeptide
  VL of XENP024441

SEQ ID NO: 35371 - protein, 5 aa, Artificial Sequence
  Description of Artificial Sequence: Synthetic peptide
  XENP024441 vhCDR1
HYGMN

SEQ ID NO: 35372 - protein, 17 aa, Artificial Sequence
  Description of Artificial Sequence: Synthetic peptide
  XENP024441 vhCDR2
WINTYTGEPTYAPGFTE

SEQ ID NO: 35373 - protein, 8 aa, Artificial Sequence
  Description of Artificial Sequence: Synthetic peptide
  XENP024441 vhCDR3
DYYGSSPY

SEQ ID NO: 35374 - protein, 16 aa, Artificial Sequence
  Description of Artificial Sequence: Synthetic peptide
  XENP024441 vlCDR1
KSSQSIVHSNGNTYLE

SEQ ID NO: 35375 - protein, 7 aa, Artificial Sequence
  Description of Artificial Sequence: Synthetic peptide
  XENP024441 vlCDR2
KVSNRFS

SEQ ID NO: 35376 - protein, 9 aa, Artificial Sequence
  Description of Artificial Sequence: Synthetic peptide
  XENP024441 vlCDR3
FQGSHVPNT

SEQ ID NO: 35377 - protein, 251 aa, Artificial Sequence
  Description of Artificial Sequence: Synthetic polypeptide
  XENP024442 1C11_H3.194_L3_scFv
EIQLVQSGSVLKKPGASVKVSCKASGYTFTHYGINWVRQAPGQGLEWIGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35378 - protein, 117 aa, Artificial Sequence
  Description of Artificial Sequence: Synthetic polypeptide
  VH of XENP024442
EIQLVQSGSVLKKPGASVKVSCKASGYTFTHYGINWVRQAPGQGLEWIGWINTYTGEPTYADGFTGRFVFSLDTSVSTAYLQISSLKAEDTAVYFCARDYYGSSPYWGQGTLVTVSS

SEQ ID NO: 35379 - protein, 114 aa, Artificial Sequence; identical to SEQ ID NO: 33651
  Description of Artificial Sequence: Synthetic polypeptide
  VL of XENP024442

SEQ ID NO: 35380 - protein, 5 aa, Artificial Sequence
  Description of Artificial Sequence: Synthetic peptide
  XENP024442 vhCDR1
HYGIN

SEQ ID NO: 35381 - protein, 17 aa, Artificial Sequence
  Description of Artificial Sequence: Synthetic peptide
  XENP024442 vhCDR2
WINTYTGEPTYADGFTG

SEQ ID NO: 35382 - protein, 8 aa, Artificial Sequence
  Description of Artificial Sequence: Synthetic peptide
  XENP024442 vhCDR3
DYYGSSPY

SEQ ID NO: 35383 - protein, 16 aa, Artificial Sequence
  Description of Artificial Sequence: Synthetic peptide
  XENP024442 vlCDR1
KSSQSIVHSNGNTYLE

SEQ ID NO: 35384 - protein, 7 aa, Artificial Sequence
  Description of Artificial Sequence: Synthetic peptide
  XENP024442 vlCDR2
KVSNRFS

SEQ ID NO: 35385 - protein, 9 aa, Artificial Sequence
  Description of Artificial Sequence: Synthetic peptide
  XENP024442 vlCDR3
FQGSHVPNT

SEQ ID NO: 35386 - protein, 251 aa, Artificial Sequence
  Description of Artificial Sequence: Synthetic polypeptide
  XENP024443 1C11_H3.195_L3_scFv
QIQLVQSGSELKKPGASVKVSCKASGYTFTHYGMNWVRQPPGQGLEWMGWINTYTGEPYYADGFTGRFVFSLDTSVDTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35387 - protein, 117 aa, Artificial Sequence
  Description of Artificial Sequence: Synthetic polypeptide
  VH of XENP024443
QIQLVQSGSELKKPGASVKVSCKASGYTFTHYGMNWVRQPPGQGLEWMGWINTYTGEPYYADGFTGRFVFSLDTSVDTAYLQINSLKAEDTAVYFCARDYYGSSPYWGQGTLVTVSS

SEQ ID NO: 35388 - protein, 114 aa, Artificial Sequence; identical to SEQ ID NO: 33651
  Description of Artificial Sequence: Synthetic polypeptide
  VL of XENP024443

SEQ ID NO: 35389 - protein, 5 aa, Artificial Sequence
  Description of Artificial Sequence: Synthetic peptide
  XENP024443 vhCDR1
HYGMN

SEQ ID NO: 35390 - protein, 17 aa, Artificial Sequence
  Description of Artificial Sequence: Synthetic peptide
  XENP024443 vhCDR2
WINTYTGEPYYADGFTG

SEQ ID NO: 35391 - protein, 8 aa, Artificial Sequence
  Description of Artificial Sequence: Synthetic peptide
  XENP024443 vhCDR3
DYYGSSPY

SEQ ID NO: 35392 - protein, 16 aa, Artificial Sequence
  Description of Artificial Sequence: Synthetic peptide
  XENP024443 vlCDR1
KSSQSIVHSNGNTYLE

SEQ ID NO: 35393 - protein, 7 aa, Artificial Sequence
  Description of Artificial Sequence: Synthetic peptide
  XENP024443 vlCDR2
KVSNRFS

SEQ ID NO: 35394 - protein, 9 aa, Artificial Sequence
  Description of Artificial Sequence: Synthetic peptide
  XENP024443 vlCDR3
FQGSHVPNT

SEQ ID NO: 35395 - protein, 231 aa, Artificial Sequence
  Description of Artificial Sequence: Synthetic polypeptide
  XENP022835 empty-[CTLA-4]_H3.23_L0.129_scFv Empty-Fc Heavy Chain
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 35396 - protein, 477 aa, Artificial Sequence; identical to SEQ ID NO: 21669
  Description of Artificial Sequence: Synthetic polypeptide
  XENP022835 empty-[CTLA-4]_H3.23_L0.129_scFv scFv-Fc Heavy Chain

SEQ ID NO: 35397 - protein, 118 aa, Artificial Sequence; identical to SEQ ID NO: 2632
  Description of Artificial Sequence: Synthetic polypeptide
  VH of XENP022835

SEQ ID NO: 35398 - protein, 108 aa, Artificial Sequence; identical to SEQ ID NO: 2768
  Description of Artificial Sequence: Synthetic polypeptide
  VL of XENP022835

SEQ ID NO: 35399 - protein, 231 aa, Artificial Sequence; identical to SEQ ID NO: 21532
  Description of Artificial Sequence: Synthetic polypeptide
  Fc chain of XENP022835

SEQ ID NO: 35400 - protein, 5 aa, Artificial Sequence
  Description of Artificial Sequence: Synthetic peptide
  XENP022835 vhCDR1
SYTMH

SEQ ID NO: 35401 - protein, 17 aa, Artificial Sequence
  Description of Artificial Sequence: Synthetic peptide
  XENP022835 vhCDR2
FISYDGNYKYYADSVKG

SEQ ID NO: 35402 - protein, 9 aa, Artificial Sequence
  Description of Artificial Sequence: Synthetic peptide
  XENP022835 vhCDR3
GGHLGPFDL

SEQ ID NO: 35403 - protein, 12 aa, Artificial Sequence
  Description of Artificial Sequence: Synthetic peptide
  XENP022835 vlCDR1
RASQSVGSSYLA

SEQ ID NO: 35404 - protein, 7 aa, Artificial Sequence
  Description of Artificial Sequence: Synthetic peptide
  XENP022835 vlCDR2
GASSRAT

SEQ ID NO: 35405 - protein, 9 aa, Artificial Sequence
  Description of Artificial Sequence: Synthetic peptide
  XENP022835 vlCDR3
QQYGSSPWT

SEQ ID NO: 35406 - protein, 447 aa, Artificial Sequence; identical to SEQ ID NO: 23556
  Description of Artificial Sequence: Synthetic polypeptide
  XENP023552 [CTLA-4]_H3_L0.22_Fab-empty_Fc(216)_IgG1 Fab-Fc Heavy Chain

SEQ ID NO: 35407 - protein, 118 aa, Artificial Sequence; identical to SEQ ID NO: 139
  Description of Artificial Sequence: Synthetic polypeptide
  VH of XENP023552

SEQ ID NO: 35408 - protein, 5 aa, Artificial Sequence
  Description of Artificial Sequence: Synthetic peptide
  XENP023552 vhCDR1
SYTMH

SEQ ID NO: 35409 - protein, 17 aa, Artificial Sequence
  Description of Artificial Sequence: Synthetic peptide
  XENP023552 vhCDR2
FISYDGNNKYYADSVKG

SEQ ID NO: 35410 - protein, 9 aa, Artificial Sequence
  Description of Artificial Sequence: Synthetic peptide
  XENP023552 vhCDR3
TGWLGPFDY

SEQ ID NO: 35411 - protein, 231 aa, Artificial Sequence; identical to SEQ ID NO: 21572
  Description of Artificial Sequence: Synthetic polypeptide
  XENP023552 [CTLA-4]_H3_L0.22_Fab-empty_Fc(216)_IgG1 Empty-Fc Heavy Chain

SEQ ID NO: 35412 - protein, 215 aa, Artificial Sequence; identical to SEQ ID NO: 4504
  Description of Artificial Sequence: Synthetic polypeptide
  XENP023552 [CTLA-4]_H3_L0.22_Fab-empty_Fc(216)_IgG1 Light Chain

SEQ ID NO: 35413 - protein, 108 aa, Artificial Sequence; identical to SEQ ID NO: 1607
  Description of Artificial Sequence: Synthetic polypeptide
  VL of XENP023552

SEQ ID NO: 35414 - protein, 12 aa, Artificial Sequence
  Description of Artificial Sequence: Synthetic peptide
  XENP023552 vlCDR1
RASQSVSSSYLA

SEQ ID NO: 35415 - protein, 7 aa, Artificial Sequence
  Description of Artificial Sequence: Synthetic peptide
  XENP023552 vlCDR2
GAFSRAT

SEQ ID NO: 35416 - protein, 9 aa, Artificial Sequence
  Description of Artificial Sequence: Synthetic peptide
  XENP023552 vlCDR3
QQYGSSPWT

SEQ ID NO: 35417 - protein, 226 aa, Artificial Sequence
  Description of Artificial Sequence: Synthetic polypeptide
  XENP023041 7G8_H3.66_L1.34_Fab Heavy Chain
EVQLVESGGGLVQPGGSLRLSCAASGFTFDEAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35418 - protein, 121 aa, Artificial Sequence
  Description of Artificial Sequence: Synthetic polypeptide
  VH of XENP023041
EVQLVESGGGLVQPGGSLRLSCAASGFTFDEAWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 35419 - protein, 5 aa, Artificial Sequence
  Description of Artificial Sequence: Synthetic peptide
  XENP023041 vhCDR1
EAWMS

SEQ ID NO: 35420 - protein, 19 aa, Artificial Sequence
  Description of Artificial Sequence: Synthetic peptide
  XENP023041 vhCDR2
EISTKANNHATYYAESVKG

SEQ ID NO: 35421 - protein, 10 aa, Artificial Sequence
  Description of Artificial Sequence: Synthetic peptide
  XENP023041 vhCDR3
LATWDWYFDV

SEQ ID NO: 35422 - protein, 218 aa, Artificial Sequence; identical to SEQ ID NO: 22599
  Description of Artificial Sequence: Synthetic polypeptide
  XENP023041 7G8_H3.66_L1.34_Fab Light Chain

SEQ ID NO: 35423 - protein, 111 aa, Artificial Sequence; identical to SEQ ID NO: 22600
  Description of Artificial Sequence: Synthetic polypeptide
  VL of XENP023041

SEQ ID NO: 35424 - protein, 15 aa, Artificial Sequence
  Description of Artificial Sequence: Synthetic peptide
  XENP023041 vlCDR1
RASQSVDYDGDSYMN

SEQ ID NO: 35425 - protein, 7 aa, Artificial Sequence
  Description of Artificial Sequence: Synthetic peptide
  XENP023041 vlCDR2
AASELES

SEQ ID NO: 35426 - protein, 9 aa, Artificial Sequence
  Description of Artificial Sequence: Synthetic peptide
  XENP023041 vlCDR3
QQSNEDPFT

SEQ ID NO: 35427 - protein, 226 aa, Artificial Sequence
  Description of Artificial Sequence: Synthetic polypeptide
  XENP023042 7G8_H3.67_L1.34_Fab Heavy Chain
EVQLVESGGGLVQPGGSLRLSCAASGFTFDDTWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35428 - protein, 121 aa, Artificial Sequence
  Description of Artificial Sequence: Synthetic polypeptide
  VH of XENP023042
EVQLVESGGGLVQPGGSLRLSCAASGFTFDDTWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 35429 - protein, 5 aa, Artificial Sequence
  Description of Artificial Sequence: Synthetic peptide
  XENP023042 vhCDR1
DTWMS

SEQ ID NO: 35430 - protein, 19 aa, Artificial Sequence
  Description of Artificial Sequence: Synthetic peptide
  XENP023042 vhCDR2
EISTKANNHATYYAESVKG

SEQ ID NO: 35431 - protein, 10 aa, Artificial Sequence
  Description of Artificial Sequence: Synthetic peptide
  XENP023042 vhCDR3
LATWDWYFDV

SEQ ID NO: 35432 - protein, 218 aa, Artificial Sequence; identical to SEQ ID NO: 22599
  Description of Artificial Sequence: Synthetic polypeptide
  XENP023042 7G8_H3.67_L1.34_Fab Light Chain

SEQ ID NO: 35433 - protein, 111 aa, Artificial Sequence; identical to SEQ ID NO: 22600
  Description of Artificial Sequence: Synthetic polypeptide
  VL of XENP023042

SEQ ID NO: 35434 - protein, 15 aa, Artificial Sequence
  Description of Artificial Sequence: Synthetic peptide
  XENP023042 vlCDR1
RASQSVDYDGDSYMN

SEQ ID NO: 35435 - protein, 7 aa, Artificial Sequence
  Description of Artificial Sequence: Synthetic peptide
  XENP023042 vlCDR2
AASELES

SEQ ID NO: 35436 - protein, 9 aa, Artificial Sequence
  Description of Artificial Sequence: Synthetic peptide
  XENP023042 vlCDR3
QQSNEDPFT

SEQ ID NO: 35437 - protein, 226 aa, Artificial Sequence
  Description of Artificial Sequence: Synthetic polypeptide
  XENP023043 7G8_H3.68_L1.34_Fab Heavy Chain
EVQLVESGGGLVQPGGSLRLSCAASGFTFDDKWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35438 - protein, 121 aa, Artificial Sequence
  Description of Artificial Sequence: Synthetic polypeptide
  VH of XENP023043
EVQLVESGGGLVQPGGSLRLSCAASGFTFDDKWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 35439 - protein, 5 aa, Artificial Sequence
  Description of Artificial Sequence: Synthetic peptide
  XENP023043 vhCDR1
DKWMS

SEQ ID NO: 35440 - protein, 19 aa, Artificial Sequence
  Description of Artificial Sequence: Synthetic peptide
  XENP023043 vhCDR2
EISTKANNHATYYAESVKG

SEQ ID NO: 35441 - protein, 10 aa, Artificial Sequence
  Description of Artificial Sequence: Synthetic peptide
  XENP023043 vhCDR3
LATWDWYFDV

SEQ ID NO: 35442 - protein, 218 aa, Artificial Sequence; identical to SEQ ID NO: 22599
  Description of Artificial Sequence: Synthetic polypeptide
  XENP023043 7G8_H3.68_L1.34_Fab Light Chain

SEQ ID NO: 35443 - protein, 111 aa, Artificial Sequence; identical to SEQ ID NO: 22600
  Description of Artificial Sequence: Synthetic polypeptide
  VL of XENP023043

SEQ ID NO: 35444 - protein, 15 aa, Artificial Sequence
  Description of Artificial Sequence: Synthetic peptide
  XENP023043 vlCDR1
RASQSVDYDGDSYMN

SEQ ID NO: 35445 - protein, 7 aa, Artificial Sequence
  Description of Artificial Sequence: Synthetic peptide
  XENP023043 vlCDR2
AASELES

SEQ ID NO: 35446 - protein, 9 aa, Artificial Sequence
  Description of Artificial Sequence: Synthetic peptide
  XENP023043 vlCDR3
QQSNEDPFT

SEQ ID NO: 35447 - protein, 226 aa, Artificial Sequence
  Description of Artificial Sequence: Synthetic polypeptide
  XENP023044 7G8_H3.69_L1.34_Fab Heavy Chain
EVQLVESGGGLVQPGGSLRLSCAASGFTFDDAFMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35448 - protein, 121 aa, Artificial Sequence
  Description of Artificial Sequence: Synthetic polypeptide
  VH of XENP023044
EVQLVESGGGLVQPGGSLRLSCAASGFTFDDAFMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 35449 - protein, 5 aa, Artificial Sequence
  Description of Artificial Sequence: Synthetic peptide
  XENP023044 vhCDR1
DAFMS

SEQ ID NO: 35450 - protein, 19 aa, Artificial Sequence
  Description of Artificial Sequence: Synthetic peptide
  XENP023044 vhCDR2
EISTKANNHATYYAESVKG

SEQ ID NO: 35451 - protein, 10 aa, Artificial Sequence
  Description of Artificial Sequence: Synthetic peptide
  XENP023044 vhCDR3
LATWDWYFDV

SEQ ID NO: 35452 - protein, 218 aa, Artificial Sequence; identical to SEQ ID NO: 22599
  Description of Artificial Sequence: Synthetic polypeptide
  XENP023044 7G8_H3.69_L1.34_Fab Light Chain

SEQ ID NO: 35453 - protein, 111 aa, Artificial Sequence; identical to SEQ ID NO: 22600
  Description of Artificial Sequence: Synthetic polypeptide
  VL of XENP023044

SEQ ID NO: 35454 - protein, 15 aa, Artificial Sequence
  Description of Artificial Sequence: Synthetic peptide
  XENP023044 vlCDR1
RASQSVDYDGDSYMN

SEQ ID NO: 35455 - protein, 7 aa, Artificial Sequence
  Description of Artificial Sequence: Synthetic peptide
  XENP023044 vlCDR2
AASELES

SEQ ID NO: 35456 - protein, 9 aa, Artificial Sequence
  Description of Artificial Sequence: Synthetic peptide
  XENP023044 vlCDR3
QQSNEDPFT

SEQ ID NO: 35457 - protein, 226 aa, Artificial Sequence
  Description of Artificial Sequence: Synthetic polypeptide
  XENP023045 7G8_H3.70_L1.34_Fab Heavy Chain
EVQLVESGGGLVQPGGSLRLSCAASGFTFDDAYMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35458 - protein, 121 aa, Artificial Sequence
  Description of Artificial Sequence: Synthetic polypeptide
  VH of XENP023045
EVQLVESGGGLVQPGGSLRLSCAASGFTFDDAYMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 35459 - protein, 5 aa, Artificial Sequence
  Description of Artificial Sequence: Synthetic peptide
  XENP023045 vhCDR1
DAYMS

SEQ ID NO: 35460 - protein, 19 aa, Artificial Sequence
  Description of Artificial Sequence: Synthetic peptide
  XENP023045 vhCDR2
EISTKANNHATYYAESVKG

SEQ ID NO: 35461 - protein, 10 aa, Artificial Sequence
  Description of Artificial Sequence: Synthetic peptide
  XENP023045 vhCDR3
LATWDWYFDV

SEQ ID NO: 35462 - protein, 218 aa, Artificial Sequence; identical to SEQ ID NO: 22599
  Description of Artificial Sequence: Synthetic polypeptide
  XENP023045 7G8_H3.70_L1.34_Fab Light Chain

SEQ ID NO: 35463 - protein, 111 aa, Artificial Sequence; identical to SEQ ID NO: 22600
  Description of Artificial Sequence: Synthetic polypeptide
  VL of XENP023045

SEQ ID NO: 35464 - protein, 15 aa, Artificial Sequence
  Description of Artificial Sequence: Synthetic peptide
  XENP023045 vlCDR1
RASQSVDYDGDSYMN

SEQ ID NO: 35465 - protein, 7 aa, Artificial Sequence
  Description of Artificial Sequence: Synthetic peptide
  XENP023045 vlCDR2
AASELES

SEQ ID NO: 35466 - protein, 9 aa, Artificial Sequence
  Description of Artificial Sequence: Synthetic peptide
  XENP023045 vlCDR3
QQSNEDPFT

SEQ ID NO: 35467 - protein, 226 aa, Artificial Sequence
  Description of Artificial Sequence: Synthetic polypeptide
  XENP023046 7G8_H3.71_L1.34_Fab Heavy Chain
EVQLVESGGGLVQPGGSLRLSCAASGFTFDDAWMSWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35468 - protein, 121 aa, Artificial Sequence
  Description of Artificial Sequence: Synthetic polypeptide
  VH of XENP023046
EVQLVESGGGLVQPGGSLRLSCAASGFTFDDAWMSWVRQAPGKGLEWVAEISTKAYNHATYYAESVKGRFTISRDDSKSSVYLQMNSLRAEDTAVYYCTRLATWDWYFDVWGQGTTVTVSS

SEQ ID NO: 35469 - protein, 5 aa, Artificial Sequence
  Description of Artificial Sequence: Synthetic peptide
  XENP023046 vhCDR1
DAWMS

SEQ ID NO: 35470 - protein, 19 aa, Artificial Sequence
  Description of Artificial Sequence: Synthetic peptide
  XENP023046 vhCDR2
EISTKAYNHATYYAESVKG

SEQ ID NO: 35471 - protein, 10 aa, Artificial Sequence
  Description of Artificial Sequence: Synthetic peptide
  XENP023046 vhCDR3
LATWDWYFDV

SEQ ID NO: 35472 - protein, 218 aa, Artificial Sequence; identical to SEQ ID NO: 22599
  Description of Artificial Sequence: Synthetic polypeptide
  XENP023046 7G8_H3.71_L1.34_Fab Light Chain

SEQ ID NO: 35473 - protein, 111 aa, Artificial Sequence; identical to SEQ ID NO: 22600
  Description of Artificial Sequence: Synthetic polypeptide
  VL of XENP023046

SEQ ID NO: 35474 - protein, 15 aa, Artificial Sequence
  Description of Artificial Sequence: Synthetic peptide
  XENP023046 vlCDR1
RASQSVDYDGDSYMN

SEQ ID NO: 35475 - protein, 7 aa, Artificial Sequence
  Description of Artificial Sequence: Synthetic peptide
  XENP023046 vlCDR2
AASELES

SEQ ID NO: 35476 - protein, 9 aa, Artificial Sequence
  Description of Artificial Sequence: Synthetic peptide
  XENP023046 vlCDR3
QQSNEDPFT

SEQ ID NO: 35477 - protein, 226 aa, Artificial Sequence
  Description of Artificial Sequence: Synthetic polypeptide
  XENP023047 7G8_H3.72_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATFDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35478 - protein, 121 aa, Artificial Sequence
  Description of Artificial Sequence: Synthetic polypeptide
  VH of XENP023047
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATFDWYFDVWGQGTTVTVSS

SEQ ID NO: 35479 - protein, 5 aa, Artificial Sequence
  Description of Artificial Sequence: Synthetic peptide
  XENP023047 vhCDR1
DAWMS

SEQ ID NO: 35480 - protein, 19 aa, Artificial Sequence
  Description of Artificial Sequence: Synthetic peptide
  XENP023047 vhCDR2
EISTKANNHATYYAESVKG

SEQ ID NO: 35481 - protein, 10 aa, Artificial Sequence
  Description of Artificial Sequence: Synthetic peptide
  XENP023047 vhCDR3
LATFDWYFDV

SEQ ID NO: 35482 - protein, 218 aa, Artificial Sequence; identical to SEQ ID NO: 22599
  Description of Artificial Sequence: Synthetic polypeptide
  XENP023047 7G8_H3.72_L1.34_Fab Light Chain

SEQ ID NO: 35483 - protein, 111 aa, Artificial Sequence; identical to SEQ ID NO: 22600
  Description of Artificial Sequence: Synthetic polypeptide
  VL of XENP023047

SEQ ID NO: 35484 - protein, 15 aa, Artificial Sequence
  Description of Artificial Sequence: Synthetic peptide
  XENP023047 vlCDR1
RASQSVDYDGDSYMN

SEQ ID NO: 35485 - protein, 7 aa, Artificial Sequence
  Description of Artificial Sequence: Synthetic peptide
  XENP023047 vlCDR2
AASELES

SEQ ID NO: 35486 - protein, 9 aa, Artificial Sequence
  Description of Artificial Sequence: Synthetic peptide
  XENP023047 vlCDR3
QQSNEDPFT

SEQ ID NO: 35487 - protein, 226 aa, Artificial Sequence
  Description of Artificial Sequence: Synthetic polypeptide
  XENP023048 7G8_H3.73_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATYDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35488 - protein, 121 aa, Artificial Sequence
  Description of Artificial Sequence: Synthetic polypeptide
  VH of XENP023048
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATYDWYFDVWGQGTTVTVSS

SEQ ID NO: 35489 - protein, 5 aa, Artificial Sequence
  Description of Artificial Sequence: Synthetic peptide
  XENP023048 vhCDR1
DAWMS

SEQ ID NO: 35490 - protein, 19 aa, Artificial Sequence
  Description of Artificial Sequence: Synthetic peptide
  XENP023048 vhCDR2
EISTKANNHATYYAESVKG

SEQ ID NO: 35491 - protein, 10 aa, Artificial Sequence
  Description of Artificial Sequence: Synthetic peptide
  XENP023048 vhCDR3
LATYDWYFDV

SEQ ID NO: 35492 - protein, 218 aa, Artificial Sequence; identical to SEQ ID NO: 22599
  Description of Artificial Sequence: Synthetic polypeptide
  XENP023048 7G8_H3.73_L1.34_Fab Light Chain

SEQ ID NO: 35493 - protein, 111 aa, Artificial Sequence; identical to SEQ ID NO: 22600
  Description of Artificial Sequence: Synthetic polypeptide
  VL of XENP023048

SEQ ID NO: 35494 - protein, 15 aa, Artificial Sequence
  Description of Artificial Sequence: Synthetic peptide
  XENP023048 vlCDR1
RASQSVDYDGDSYMN

SEQ ID NO: 35495 - protein, 7 aa, Artificial Sequence
  Description of Artificial Sequence: Synthetic peptide
  XENP023048 vlCDR2
AASELES

SEQ ID NO: 35496 - protein, 9 aa, Artificial Sequence
  Description of Artificial Sequence: Synthetic peptide
  XENP023048 vlCDR3
QQSNEDPFT

SEQ ID NO: 35497 - protein, 226 aa, Artificial Sequence
  Description of Artificial Sequence: Synthetic polypeptide
  XENP023049 7G8_H3.74_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35498 - protein, 121 aa, Artificial Sequence
  Description of Artificial Sequence: Synthetic polypeptide
  VH of XENP023049
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDFYFDVWGQGTTVTVSS

SEQ ID NO: 35499 - protein, 5 aa, Artificial Sequence
  Description of Artificial Sequence: Synthetic peptide
  XENP023049 vhCDR1
DAWMS

SEQ ID NO: 35500 - protein, 19 aa, Artificial Sequence
  Description of Artificial Sequence: Synthetic peptide
  XENP023049 vhCDR2
EISTKANNHATYYAESVKG

SEQ ID NO: 35501 - protein, 10 aa, Artificial Sequence
  Description of Artificial Sequence: Synthetic peptide
  XENP023049 vhCDR3
LATWDFYFDV

SEQ ID NO: 35502 - protein, 218 aa, Artificial Sequence; identical to SEQ ID NO: 22599
  Description of Artificial Sequence: Synthetic polypeptide
  XENP023049 7G8_H3.74_L1.34_Fab Light Chain

SEQ ID NO: 35503 - protein, 111 aa, Artificial Sequence; identical to SEQ ID NO: 22600
  Description of Artificial Sequence: Synthetic polypeptide
  VL of XENP023049

SEQ ID NO: 35504 - protein, 15 aa, Artificial Sequence
  Description of Artificial Sequence: Synthetic peptide
  XENP023049 vlCDR1
RASQSVDYDGDSYMN

SEQ ID NO: 35505 - protein, 7 aa, Artificial Sequence
  Description of Artificial Sequence: Synthetic peptide
  XENP023049 vlCDR2
AASELES

SEQ ID NO: 35506 - protein, 9 aa, Artificial Sequence
  Description of Artificial Sequence: Synthetic peptide
  XENP023049 vlCDR3
QQSNEDPFT

SEQ ID NO: 35507 - protein, 226 aa, Artificial Sequence
  Description of Artificial Sequence: Synthetic polypeptide
  XENP023050 7G8_H3.75_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDYYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35508 - protein, 121 aa, Artificial Sequence
  Description of Artificial Sequence: Synthetic polypeptide
  VH of XENP023050
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDYYFDVWGQGTTVTVSS

SEQ ID NO: 35509 - protein, 5 aa, Artificial Sequence
  Description of Artificial Sequence: Synthetic peptide
  XENP023050 vhCDR1
DAWMS

SEQ ID NO: 35510 - protein, 19 aa, Artificial Sequence
  Description of Artificial Sequence: Synthetic peptide
  XENP023050 vhCDR2
EISTKANNHATYYAESVKG

SEQ ID NO: 35511 - protein, 10 aa, Artificial Sequence
  Description of Artificial Sequence: Synthetic peptide
  XENP023050 vhCDR3
LATWDYYFDV

SEQ ID NO: 35512 - protein, 218 aa, Artificial Sequence; identical to SEQ ID NO: 22599
  Description of Artificial Sequence: Synthetic polypeptide
  XENP023050 7G8_H3.75_L1.34_Fab Light Chain

SEQ ID NO: 35513 - protein, 111 aa, Artificial Sequence; identical to SEQ ID NO: 22600
  Description of Artificial Sequence: Synthetic polypeptide
  VL of XENP023050

SEQ ID NO: 35514 - protein, 15 aa, Artificial Sequence
  Description of Artificial Sequence: Synthetic peptide
  XENP023050 vlCDR1
RASQSVDYDGDSYMN

SEQ ID NO: 35515 - protein, 7 aa, Artificial Sequence
  Description of Artificial Sequence: Synthetic peptide
  XENP023050 vlCDR2
AASELES

SEQ ID NO: 35516 - protein, 9 aa, Artificial Sequence
  Description of Artificial Sequence: Synthetic peptide
  XENP023050 vlCDR3
QQSNEDPFT

SEQ ID NO: 35517 - protein, 226 aa, Artificial Sequence; identical to SEQ ID NO: 32254
  Description of Artificial Sequence: Synthetic polypeptide
  XENP023051 7G8_H3.30_L1.38_Fab Heavy Chain

SEQ ID NO: 35518 - protein, 121 aa, Artificial Sequence; identical to SEQ ID NO: 22485
  Description of Artificial Sequence: Synthetic polypeptide
  VH of XENP023051

SEQ ID NO: 35519 - protein, 5 aa, Artificial Sequence
  Description of Artificial Sequence: Synthetic peptide
  XENP023051 vhCDR1
DAWMS

SEQ ID NO: 35520 - protein, 19 aa, Artificial Sequence
  Description of Artificial Sequence: Synthetic peptide
  XENP023051 vhCDR2
EISTKANNHATYYAESVKG

SEQ ID NO: 35521 - protein, 10 aa, Artificial Sequence
  Description of Artificial Sequence: Synthetic peptide
  XENP023051 vhCDR3
LATWDWYFDV

SEQ ID NO: 35522 - protein, 218 aa, Artificial Sequence
  Description of Artificial Sequence: Synthetic polypeptide
  XENP023051 7G8_H3.30_L1.38_Fab Light Chain
DIVLTQSPSSLSASVGDRVTITCRASQSVDYEGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35523 - protein, 111 aa, Artificial Sequence
  Description of Artificial Sequence: Synthetic polypeptide
  VL of XENP023051
DIVLTQSPSSLSASVGDRVTITCRASQSVDYEGDSYMNWYQQKPGKPPKLLIYAASELESGIPARFSGSGSGTDFTLTISSLQPEDFATYYCQQSNEDPFTFGSGTKLEIK

SEQ ID NO: 35524 - protein, 15 aa, Artificial Sequence
  Description of Artificial Sequence: Synthetic peptide
  XENP023051 vlCDR1
RASQSVDYEGDSYMN

SEQ ID NO: 35525 - protein, 7 aa, Artificial Sequence
  Description of Artificial Sequence: Synthetic peptide
  XENP023051 vlCDR2
AASELES

SEQ ID NO: 35526 - protein, 9 aa, Artificial Sequence
  Description of Artificial Sequence: Synthetic peptide
  XENP023051 vlCDR3
QQSNEDPFT

SEQ ID NO: 35527 - protein, 226 aa, Artificial Sequence; identical to SEQ ID NO: 32254
  Description of Artificial Sequence: Synthetic polypeptide
  XENP023052 7G8_H3.30_L1.39_Fab Heavy Chain

SEQ ID NO: 35528 - protein, 121 aa, Artificial Sequence; identical to SEQ ID NO: 22485
  Description of Artificial Sequence: Synthetic polypeptide
  VH of XENP023052

SEQ ID NO: 35529 - protein, 5 aa, Artificial Sequence
  Description of Artificial Sequence: Synthetic peptide
  XENP023052 vhCDR1
DAWMS

SEQ ID NO: 35530 - protein, 19 aa, Artificial Sequence
  Description of Artificial Sequence: Synthetic peptide
  XENP023052 vhCDR2
EISTKANNHATYYAESVKG

SEQ ID NO: 35531 - protein, 10 aa, Artificial Sequence
  Description of Artificial Sequence: Synthetic peptide
  XENP023052 vhCDR3
LATWDWYFDV

SEQ ID NO: 35532 - protein, 218 aa, Artificial Sequence
  Description of Artificial Sequence: Synthetic polypeptide
  XENP023052 7G8_H3.30_L1.39_Fab Light Chain
DIVLTQSPSSLSASVGDRVTITCRASQSVDYYGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35533 - protein, 111 aa, Artificial Sequence
  Description of Artificial Sequence: Synthetic polypeptide
  VL of XENP023052
DIVLTQSPSSLSASVGDRVTITCRASQSVDYYGDSYMNWYQQKPGKPPKLLIYAASELESGIPARFSGSGSGTDFTLTISSLQPEDFATYYCQQSNEDPFTFGSGTKLEIK

SEQ ID NO: 35534 - protein, 15 aa, Artificial Sequence
  Description of Artificial Sequence: Synthetic peptide
  XENP023052 vlCDR1
RASQSVDYYGDSYMN

SEQ ID NO: 35535 - protein, 7 aa, Artificial Sequence
  Description of Artificial Sequence: Synthetic peptide
  XENP023052 vlCDR2
AASELES

SEQ ID NO: 35536 - protein, 9 aa, Artificial Sequence
  Description of Artificial Sequence: Synthetic peptide
  XENP023052 vlCDR3
QQSNEDPFT

SEQ ID NO: 35537 - protein, 226 aa, Artificial Sequence; identical to SEQ ID NO: 32254
  Description of Artificial Sequence: Synthetic polypeptide
  XENP023053 7G8_H3.30_L1.40_Fab Heavy Chain

SEQ ID NO: 35538 - protein, 121 aa, Artificial Sequence; identical to SEQ ID NO: 22485
  Description of Artificial Sequence: Synthetic polypeptide
  VH of XENP023053

SEQ ID NO: 35539 - protein, 5 aa, Artificial Sequence
  Description of Artificial Sequence: Synthetic peptide
  XENP023053 vhCDR1
DAWMS

SEQ ID NO: 35540 - protein, 19 aa, Artificial Sequence
  Description of Artificial Sequence: Synthetic peptide
  XENP023053 vhCDR2
EISTKANNHATYYAESVKG

SEQ ID NO: 35541 - protein, 10 aa, Artificial Sequence
  Description of Artificial Sequence: Synthetic peptide
  XENP023053 vhCDR3
LATWDWYFDV

SEQ ID NO: 35542 - protein, 218 aa, Artificial Sequence
  Description of Artificial Sequence: Synthetic polypeptide
  XENP023053 7G8_H3.30_L1.40_Fab Light Chain
DIVLTQSPSSLSASVGDRVTITCRASQSVDYDADSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35543 - protein, 111 aa, Artificial Sequence
  Description of Artificial Sequence: Synthetic polypeptide
  VL of XENP023053
DIVLTQSPSSLSASVGDRVTITCRASQSVDYDADSYMNWYQQKPGKPPKLLIYAASELESGIPARFSGSGSGTDFTLTISSLQPEDFATYYCQQSNEDPFTFGSGTKLEIK

SEQ ID NO: 35544 - protein, 15 aa, Artificial Sequence
  Description of Artificial Sequence: Synthetic peptide
  XENP023053 vlCDR1
RASQSVDYDADSYMN

SEQ ID NO: 35545 - protein, 7 aa, Artificial Sequence
  Description of Artificial Sequence: Synthetic peptide
  XENP023053 vlCDR2
AASELES

SEQ ID NO: 35546 - protein, 9 aa, Artificial Sequence
  Description of Artificial Sequence: Synthetic peptide
  XENP023053 vlCDR3
QQSNEDPFT

SEQ ID NO: 35547 - protein, 226 aa, Artificial Sequence; identical to SEQ ID NO: 32254
  Description of Artificial Sequence: Synthetic polypeptide
  XENP023054 7G8_H3.30_L1.41_Fab Heavy Chain

SEQ ID NO: 35548 - protein, 121 aa, Artificial Sequence; identical to SEQ ID NO: 22485
  Description of Artificial Sequence: Synthetic polypeptide
  VH of XENP023054

SEQ ID NO: 35549 - protein, 5 aa, Artificial Sequence
  Description of Artificial Sequence: Synthetic peptide
  XENP023054 vhCDR1
DAWMS

SEQ ID NO: 35550 - protein, 19 aa, Artificial Sequence
  Description of Artificial Sequence: Synthetic peptide
  XENP023054 vhCDR2
EISTKANNHATYYAESVKG

SEQ ID NO: 35551 - protein, 10 aa, Artificial Sequence
  Description of Artificial Sequence: Synthetic peptide
  XENP023054 vhCDR3
LATWDWYFDV

SEQ ID NO: 35552 - protein, 218 aa, Artificial Sequence
  Description of Artificial Sequence: Synthetic polypeptide
  XENP023054 7G8_H3.30_L1.41_Fab Light Chain
DIVLTQSPSSLSASVGDRVTITCRASQSVDYDQDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35553 - protein, 111 aa, Artificial Sequence
  Description of Artificial Sequence: Synthetic polypeptide
  VL of XENP023054
DIVLTQSPSSLSASVGDRVTITCRASQSVDYDQDSYMNWYQQKPGKPPKLLIYAASELESGIPARFSGSGSGTDFTLTISSLQPEDFATYYCQQSNEDPFTFGSGTKLEIK

SEQ ID NO: 35554 - protein, 15 aa, Artificial Sequence
  Description of Artificial Sequence: Synthetic peptide
  XENP023054 vlCDR1
RASQSVDYDQDSYMN

SEQ ID NO: 35555 - protein, 7 aa, Artificial Sequence
  Description of Artificial Sequence: Synthetic peptide
  XENP023054 vlCDR2
AASELES

SEQ ID NO: 35556 - protein, 9 aa, Artificial Sequence
  Description of Artificial Sequence: Synthetic peptide
  XENP023054 vlCDR3
QQSNEDPFT

SEQ ID NO: 35557 - protein, 226 aa, Artificial Sequence; identical to SEQ ID NO: 32254
  Description of Artificial Sequence: Synthetic polypeptide
  XENP023055 7G8_H3.30_L1.42_Fab Heavy Chain

SEQ ID NO: 35558 - protein, 121 aa, Artificial Sequence; identical to SEQ ID NO: 22485
  Description of Artificial Sequence: Synthetic polypeptide
  VH of XENP023055

SEQ ID NO: 35559 - protein, 5 aa, Artificial Sequence
  Description of Artificial Sequence: Synthetic peptide
  XENP023055 vhCDR1
DAWMS

SEQ ID NO: 35560 - protein, 19 aa, Artificial Sequence
  Description of Artificial Sequence: Synthetic peptide
  XENP023055 vhCDR2
EISTKANNHATYYAESVKG

SEQ ID NO: 35561 - protein, 10 aa, Artificial Sequence
  Description of Artificial Sequence: Synthetic peptide
  XENP023055 vhCDR3
LATWDWYFDV

SEQ ID NO: 35562 - protein, 218 aa, Artificial Sequence
  Description of Artificial Sequence: Synthetic polypeptide
  XENP023055 7G8_H3.30_L1.42_Fab Light Chain
DIVLTQSPSSLSASVGDRVTITCRASQSVDYDDDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35563 - protein, 111 aa, Artificial Sequence
  Description of Artificial Sequence: Synthetic polypeptide
  VL of XENP023055
DIVLTQSPSSLSASVGDRVTITCRASQSVDYDDDSYMNWYQQKPGKPPKLLIYAASELESGIPARFSGSGSGTDFTLTISSLQPEDFATYYCQQSNEDPFTFGSGTKLEIK

SEQ ID NO: 35564 - protein, 15 aa, Artificial Sequence
  Description of Artificial Sequence: Synthetic peptide
  XENP023055 vlCDR1
RASQSVDYDDDSYMN

SEQ ID NO: 35565 - protein, 7 aa, Artificial Sequence
  Description of Artificial Sequence: Synthetic peptide
  XENP023055 vlCDR2
AASELES

SEQ ID NO: 35566 - protein, 9 aa, Artificial Sequence
  Description of Artificial Sequence: Synthetic peptide
  XENP023055 vlCDR3
QQSNEDPFT

SEQ ID NO: 35567 - protein, 226 aa, Artificial Sequence; identical to SEQ ID NO: 32254
  Description of Artificial Sequence: Synthetic polypeptide
  XENP023056 7G8_H3.30_L1.43_Fab Heavy Chain

SEQ ID NO: 35568 - protein, 121 aa, Artificial Sequence; identical to SEQ ID NO: 22485
  Description of Artificial Sequence: Synthetic polypeptide
  VH of XENP023056

SEQ ID NO: 35569 - protein, 5 aa, Artificial Sequence
  Description of Artificial Sequence: Synthetic peptide
  XENP023056 vhCDR1
DAWMS

SEQ ID NO: 35570 - protein, 19 aa, Artificial Sequence
  Description of Artificial Sequence: Synthetic peptide
  XENP023056 vhCDR2
EISTKANNHATYYAESVKG

SEQ ID NO: 35571 - protein, 10 aa, Artificial Sequence
  Description of Artificial Sequence: Synthetic peptide
  XENP023056 vhCDR3
LATWDWYFDV

SEQ ID NO: 35572 - protein, 218 aa, Artificial Sequence
  Description of Artificial Sequence: Synthetic polypeptide
  XENP023056 7G8_H3.30_L1.43_Fab Light Chain
DIVLTQSPSSLSASVGDRVTITCRASQSVDYDYDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35573 - protein, 111 aa, Artificial Sequence
  Description of Artificial Sequence: Synthetic polypeptide
  VL of XENP023056
DIVLTQSPSSLSASVGDRVTITCRASQSVDYDYDSYMNWYQQKPGKPPKLLIYAASELESGIPARFSGSGSGTDFTLTISSLQPEDFATYYCQQSNEDPFTFGSGTKLEIK

SEQ ID NO: 35574 - protein, 15 aa, Artificial Sequence
  Description of Artificial Sequence: Synthetic peptide
  XENP023056 vlCDR1
RASQSVDYDYDSYMN

SEQ ID NO: 35575 - protein, 7 aa, Artificial Sequence
  Description of Artificial Sequence: Synthetic peptide
  XENP023056 vlCDR2
AASELES

SEQ ID NO: 35576 - protein, 9 aa, Artificial Sequence
  Description of Artificial Sequence: Synthetic peptide
  XENP023056 vlCDR3
QQSNEDPFT

SEQ ID NO: 35577 - protein, 226 aa, Artificial Sequence; identical to SEQ ID NO: 35417
  Description of Artificial Sequence: Synthetic polypeptide
  XENP023220 7G8_H3.66_L1.39_Fab Heavy Chain

SEQ ID NO: 35578 - protein, 121 aa, Artificial Sequence; identical to SEQ ID NO: 35418
  Description of Artificial Sequence: Synthetic polypeptide
  VH of XENP023220

SEQ ID NO: 35579 - protein, 5 aa, Artificial Sequence
  Description of Artificial Sequence: Synthetic peptide
  XENP023220 vhCDR1
EAWMS

SEQ ID NO: 35580 - protein, 19 aa, Artificial Sequence
  Description of Artificial Sequence: Synthetic peptide
  XENP023220 vhCDR2
EISTKANNHATYYAESVKG

SEQ ID NO: 35581 - protein, 10 aa, Artificial Sequence
  Description of Artificial Sequence: Synthetic peptide
  XENP023220 vhCDR3
LATWDWYFDV

SEQ ID NO: 35582 - protein, 218 aa, Artificial Sequence; identical to SEQ ID NO: 35532
  Description of Artificial Sequence: Synthetic polypeptide
  XENP023220 7G8_H3.66_L1.39_Fab Light Chain

SEQ ID NO: 35583 - protein, 111 aa, Artificial Sequence; identical to SEQ ID NO: 35533
  Description of Artificial Sequence: Synthetic polypeptide
  VL of XENP023220

SEQ ID NO: 35584 - protein, 15 aa, Artificial Sequence
  Description of Artificial Sequence: Synthetic peptide
  XENP023220 vlCDR1
RASQSVDYYGDSYMN

SEQ ID NO: 35585 - protein, 7 aa, Artificial Sequence
  Description of Artificial Sequence: Synthetic peptide
  XENP023220 vlCDR2
AASELES

SEQ ID NO: 35586 - protein, 9 aa, Artificial Sequence
  Description of Artificial Sequence: Synthetic peptide
  XENP023220 vlCDR3
QQSNEDPFT

SEQ ID NO: 35587 - protein, 226 aa, Artificial Sequence; identical to SEQ ID NO: 35427
  Description of Artificial Sequence: Synthetic polypeptide
  XENP023221 7G8_H3.67_L1.39_Fab Heavy Chain

SEQ ID NO: 35588 - protein, 121 aa, Artificial Sequence; identical to SEQ ID NO: 35428
  Description of Artificial Sequence: Synthetic polypeptide
  VH of XENP023221

SEQ ID NO: 35589 - protein, 5 aa, Artificial Sequence
  Description of Artificial Sequence: Synthetic peptide
  XENP023221 vhCDR1
DTWMS

SEQ ID NO: 35590 - protein, 19 aa, Artificial Sequence
  Description of Artificial Sequence: Synthetic peptide
  XENP023221 vhCDR2
EISTKANNHATYYAESVKG

SEQ ID NO: 35591 - protein, 10 aa, Artificial Sequence
  Description of Artificial Sequence: Synthetic peptide
  XENP023221 vhCDR3
LATWDWYFDV

SEQ ID NO: 35592 - protein, 218 aa, Artificial Sequence; identical to SEQ ID NO: 35532
  Description of Artificial Sequence: Synthetic polypeptide
  XENP023221 7G8_H3.67_L1.39_Fab Light Chain

SEQ ID NO: 35593 - protein, 111 aa, Artificial Sequence; identical to SEQ ID NO: 35533
  Description of Artificial Sequence: Synthetic polypeptide
  VL of XENP023221

SEQ ID NO: 35594 - protein, 15 aa, Artificial Sequence
  Description of Artificial Sequence: Synthetic peptide
  XENP023221 vlCDR1
RASQSVDYYGDSYMN

SEQ ID NO: 35595 - protein, 7 aa, Artificial Sequence
  Description of Artificial Sequence: Synthetic peptide
  XENP023221 vlCDR2
AASELES

SEQ ID NO: 35596 - protein, 9 aa, Artificial Sequence
  Description of Artificial Sequence: Synthetic peptide
  XENP023221 vlCDR3
QQSNEDPFT

SEQ ID NO: 35597 - protein, 226 aa, Artificial Sequence; identical to SEQ ID NO: 35467
  Description of Artificial Sequence: Synthetic polypeptide
  XENP023222 7G8_H3.71_L1.39_Fab Heavy Chain

SEQ ID NO: 35598 - protein, 121 aa, Artificial Sequence; identical to SEQ ID NO: 35468
  Description of Artificial Sequence: Synthetic polypeptide
  VH of XENP023222

SEQ ID NO: 35599 - protein, 5 aa, Artificial Sequence
  Description of Artificial Sequence: Synthetic peptide
  XENP023222 vhCDR1
DAWMS

SEQ ID NO: 35600 - protein, 19 aa, Artificial Sequence
  Description of Artificial Sequence: Synthetic peptide
  XENP023222 vhCDR2
EISTKAYNHATYYAESVKG

SEQ ID NO: 35601 - protein, 10 aa, Artificial Sequence
  Description of Artificial Sequence: Synthetic peptide
  XENP023222 vhCDR3
LATWDWYFDV

SEQ ID NO: 35602 - protein, 218 aa, Artificial Sequence; identical to SEQ ID NO: 35532
  Description of Artificial Sequence: Synthetic polypeptide
  XENP023222 7G8_H3.71_L1.39_Fab Light Chain

SEQ ID NO: 35603 - protein, 111 aa, Artificial Sequence; identical to SEQ ID NO: 35533
  Description of Artificial Sequence: Synthetic polypeptide
  VL of XENP023222

SEQ ID NO: 35604 - protein, 15 aa, Artificial Sequence
  Description of Artificial Sequence: Synthetic peptide
  XENP023222 vlCDR1
RASQSVDYYGDSYMN

SEQ ID NO: 35605 - protein, 7 aa, Artificial Sequence
  Description of Artificial Sequence: Synthetic peptide
  XENP023222 vlCDR2
AASELES

SEQ ID NO: 35606 - protein, 9 aa, Artificial Sequence
  Description of Artificial Sequence: Synthetic peptide
  XENP023222 vlCDR3
QQSNEDPFT

SEQ ID NO: 35607 - protein, 450 aa, Artificial Sequence
  Description of Artificial Sequence: Synthetic polypeptide
  XENP022841 7G8_H3.30_L1.34_Fab-[CTLA-4]_H3.23_L0.129_scFv Fab -Fc Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 35608 - protein, 121 aa, Artificial Sequence; identical to SEQ ID NO: 22485
  Description of Artificial Sequence: Synthetic polypeptide
  VH of XENP022841

SEQ ID NO: 35609 - protein, 5 aa, Artificial Sequence
  Description of Artificial Sequence: Synthetic peptide
  XENP022841 vhCDR1
DAWMS

SEQ ID NO: 35610 - protein, 19 aa, Artificial Sequence
  Description of Artificial Sequence: Synthetic peptide
  XENP022841 vhCDR2
EISTKANNHATYYAESVKG

SEQ ID NO: 35611 - protein, 10 aa, Artificial Sequence
  Description of Artificial Sequence: Synthetic peptide
  XENP022841 vhCDR3
LATWDWYFDV

SEQ ID NO: 35612 - protein, 477 aa, Artificial Sequence
  Description of Artificial Sequence: Synthetic polypeptide
  XENP022841 7G8_H3.30_L1.34_Fab-[CTLA-4]_H3.23_L0.129_scFv scFv-Fc Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 35613 - protein, 118 aa, Artificial Sequence; identical to SEQ ID NO: 2632
  Description of Artificial Sequence: Synthetic polypeptide
  VH of XENP022841

SEQ ID NO: 35614 - protein, 108 aa, Artificial Sequence; identical to SEQ ID NO: 2768
  Description of Artificial Sequence: Synthetic polypeptide
  VL of XENP022841

SEQ ID NO: 35615 - protein, 231 aa, Artificial Sequence; identical to SEQ ID NO: 21572
  Description of Artificial Sequence: Synthetic polypeptide
  Fc chain of XENP022841

SEQ ID NO: 35616 - protein, 5 aa, Artificial Sequence
  Description of Artificial Sequence: Synthetic peptide
  XENP022841 vhCDR1
SYTMH

SEQ ID NO: 35617 - protein, 17 aa, Artificial Sequence
  Description of Artificial Sequence: Synthetic peptide
  XENP022841 vhCDR2
FISYDGNYKYYADSVKG

SEQ ID NO: 35618 - protein, 9 aa, Artificial Sequence
  Description of Artificial Sequence: Synthetic peptide
  XENP022841 vhCDR3
GGHLGPFDL

SEQ ID NO: 35619 - protein, 12 aa, Artificial Sequence
  Description of Artificial Sequence: Synthetic peptide
  XENP022841 vlCDR1
RASQSVGSSYLA

SEQ ID NO: 35620 - protein, 7 aa, Artificial Sequence
  Description of Artificial Sequence: Synthetic peptide
  XENP022841 vlCDR2
GASSRAT

SEQ ID NO: 35621 - protein, 9 aa, Artificial Sequence
  Description of Artificial Sequence: Synthetic peptide
  XENP022841 vlCDR3
QQYGSSPWT

SEQ ID NO: 35622 - protein, 218 aa, Artificial Sequence; identical to SEQ ID NO: 22599
  Description of Artificial Sequence: Synthetic polypeptide
  XENP022841 7G8_H3.30_L1.34_Fab-[CTLA-4]_H3.23_L0.129_scFv Light Chain

SEQ ID NO: 35623 - protein, 111 aa, Artificial Sequence; identical to SEQ ID NO: 22600
  Description of Artificial Sequence: Synthetic polypeptide
  VL of XENP022841

SEQ ID NO: 35624 - protein, 15 aa, Artificial Sequence
  Description of Artificial Sequence: Synthetic peptide
  XENP022841 vlCDR1
RASQSVDYDGDSYMN

SEQ ID NO: 35625 - protein, 7 aa, Artificial Sequence
  Description of Artificial Sequence: Synthetic peptide
  XENP022841 vlCDR2
AASELES

SEQ ID NO: 35626 - protein, 9 aa, Artificial Sequence
  Description of Artificial Sequence: Synthetic peptide
  XENP022841 vlCDR3
QQSNEDPFT

SEQ ID NO: 35627 - protein, 450 aa, Artificial Sequence; identical to SEQ ID NO: 35607
  Description of Artificial Sequence: Synthetic polypeptide
  XENP022842 7G8_H3.30_L1.36_Fab-[CTLA-4]_H3.23_L0.129_scFv Fab-Fc Heavy Chain

SEQ ID NO: 35628 - protein, 121 aa, Artificial Sequence; identical to SEQ ID NO: 22485
  Description of Artificial Sequence: Synthetic polypeptide
  VH of XENP022842

SEQ ID NO: 35629 - protein, 5 aa, Artificial Sequence
  Description of Artificial Sequence: Synthetic peptide
  XENP022842 vhCDR1
DAWMS

SEQ ID NO: 35630 - protein, 19 aa, Artificial Sequence
  Description of Artificial Sequence: Synthetic peptide
  XENP022842 vhCDR2
EISTKANNHATYYAESVKG

SEQ ID NO: 35631 - protein, 10 aa, Artificial Sequence
  Description of Artificial Sequence: Synthetic peptide
  XENP022842 vhCDR3
LATWDWYFDV

SEQ ID NO: 35632 - protein, 477 aa, Artificial Sequence; identical to SEQ ID NO: 35612
  Description of Artificial Sequence: Synthetic polypeptide
  XENP022842 7G8_H3.30_L1.36_Fab-[CTLA-4]_H3.23_L0.129_scFv sc Fv-Fc Heavy Chain

SEQ ID NO: 35633 - protein, 118 aa, Artificial Sequence; identical to SEQ ID NO: 2632
  Description of Artificial Sequence: Synthetic polypeptide
  VH of XENP022842

SEQ ID NO: 35634 - protein, 108 aa, Artificial Sequence; identical to SEQ ID NO: 2768
  Description of Artificial Sequence: Synthetic polypeptide
  VL of XENP022842

SEQ ID NO: 35635 - protein, 231 aa, Artificial Sequence; identical to SEQ ID NO: 21572
  Description of Artificial Sequence: Synthetic polypeptide
  Fc chain of XENP022842

SEQ ID NO: 35636 - protein, 5 aa, Artificial Sequence
  Description of Artificial Sequence: Synthetic peptide
  XENP022842 vhCDR1
SYTMH

SEQ ID NO: 35637 - protein, 17 aa, Artificial Sequence
  Description of Artificial Sequence: Synthetic peptide
  XENP022842 vhCDR2
FISYDGNYKYYADSVKG

SEQ ID NO: 35638 - protein, 9 aa, Artificial Sequence
  Description of Artificial Sequence: Synthetic peptide
  XENP022842 vhCDR3
GGHLGPFDL

SEQ ID NO: 35639 - protein, 12 aa, Artificial Sequence
  Description of Artificial Sequence: Synthetic peptide
  XENP022842 vlCDR1
RASQSVGSSYLA

SEQ ID NO: 35640 - protein, 7 aa, Artificial Sequence
  Description of Artificial Sequence: Synthetic peptide
  XENP022842 vlCDR2
GASSRAT

SEQ ID NO: 35641 - protein, 9 aa, Artificial Sequence
  Description of Artificial Sequence: Synthetic peptide
  XENP022842 vlCDR3
QQYGSSPWT

SEQ ID NO: 35642 - protein, 218 aa, Artificial Sequence; identical to SEQ ID NO: 22619
  Description of Artificial Sequence: Synthetic polypeptide
  XENP022842 7G8_H3.30_L1.36_Fab-[CTLA-4]_H3.23_L0.129_scFv Light Chain

SEQ ID NO: 35643 - protein, 111 aa, Artificial Sequence; identical to SEQ ID NO: 22620
  Description of Artificial Sequence: Synthetic polypeptide
  VL of XENP022842

SEQ ID NO: 35644 - protein, 15 aa, Artificial Sequence
  Description of Artificial Sequence: Synthetic peptide
  XENP022842 vlCDR1
RASQSVDHDGDSYMN

SEQ ID NO: 35645 - protein, 7 aa, Artificial Sequence
  Description of Artificial Sequence: Synthetic peptide
  XENP022842 vlCDR2
AASELES

SEQ ID NO: 35646 - protein, 9 aa, Artificial Sequence
  Description of Artificial Sequence: Synthetic peptide
  XENP022842 vlCDR3
QQSNEDPFT

SEQ ID NO: 35647 - protein, 447 aa, Artificial Sequence
  Description of Artificial Sequence: Synthetic polypeptide
  XENP022843 2A11_H1.144_L2.142_Fab-[CTLA-4]_H3.23_L0.129_scFv Fab-Fc Heavy Chain
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 35648 - protein, 118 aa, Artificial Sequence; identical to SEQ ID NO: 22085
  Description of Artificial Sequence: Synthetic polypeptide
  VH of XENP022843

SEQ ID NO: 35649 - protein, 5 aa, Artificial Sequence
  Description of Artificial Sequence: Synthetic peptide
  XENP022843 vhCDR1
DYFMH

SEQ ID NO: 35650 - protein, 17 aa, Artificial Sequence
  Description of Artificial Sequence: Synthetic peptide
  XENP022843 vhCDR2
WIDPELGDTEYAPKFQG

SEQ ID NO: 35651 - protein, 9 aa, Artificial Sequence
  Description of Artificial Sequence: Synthetic peptide
  XENP022843 vhCDR3
RGVYQALDY

SEQ ID NO: 35652 - protein, 477 aa, Artificial Sequence; identical to SEQ ID NO: 35612
  Description of Artificial Sequence: Synthetic polypeptide
  XENP022843 2A11_H1.144_L2.142_Fab-[CTLA-4]_H3.23_L0.129_scFv scFv-Fc Heavy Chain

SEQ ID NO: 35653 - protein, 118 aa, Artificial Sequence; identical to SEQ ID NO: 2632
  Description of Artificial Sequence: Synthetic polypeptide
  VH of XENP022843

SEQ ID NO: 35654 - protein, 108 aa, Artificial Sequence; identical to SEQ ID NO: 2768
  Description of Artificial Sequence: Synthetic polypeptide
  VL of XENP022843

SEQ ID NO: 35655 - protein, 231 aa, Artificial Sequence; identical to SEQ ID NO: 21572
  Description of Artificial Sequence: Synthetic polypeptide
  Fc chain of XENP022843

SEQ ID NO: 35656 - protein, 5 aa, Artificial Sequence
  Description of Artificial Sequence: Synthetic peptide
  XENP022843 vhCDR1
SYTMH

SEQ ID NO: 35657 - protein, 17 aa, Artificial Sequence
  Description of Artificial Sequence: Synthetic peptide
  XENP022843 vhCDR2
FISYDGNYKYYADSVKG

SEQ ID NO: 35658 - protein, 9 aa, Artificial Sequence
  Description of Artificial Sequence: Synthetic peptide
  XENP022843 vhCDR3
GGHLGPFDL

SEQ ID NO: 35659 - protein, 12 aa, Artificial Sequence
  Description of Artificial Sequence: Synthetic peptide
  XENP022843 vlCDR1
RASQSVGSSYLA

SEQ ID NO: 35660 - protein, 7 aa, Artificial Sequence
  Description of Artificial Sequence: Synthetic peptide
  XENP022843 vlCDR2
GASSRAT

SEQ ID NO: 35661 - protein, 9 aa, Artificial Sequence
  Description of Artificial Sequence: Synthetic peptide
  XENP022843 vlCDR3
QQYGSSPWT

SEQ ID NO: 35662 - protein, 214 aa, Artificial Sequence; identical to SEQ ID NO: 22279
  Description of Artificial Sequence: Synthetic polypeptide
  XENP022843 2A11_H1.144_L2.142_Fab-[CTLA-4]_H3.23_L0.129_scFv Light Chain

SEQ ID NO: 35663 - protein, 107 aa, Artificial Sequence; identical to SEQ ID NO: 22280
  Description of Artificial Sequence: Synthetic polypeptide
  VL of XENP022843

SEQ ID NO: 35664 - protein, 11 aa, Artificial Sequence
  Description of Artificial Sequence: Synthetic peptide
  XENP022843 vlCDR1
QASQDIGNYLN

SEQ ID NO: 35665 - protein, 7 aa, Artificial Sequence
  Description of Artificial Sequence: Synthetic peptide
  XENP022843 vlCDR2
FTSYLHS

SEQ ID NO: 35666 - protein, 9 aa, Artificial Sequence
  Description of Artificial Sequence: Synthetic peptide
  XENP022843 vlCDR3
QQGNTLPYT

SEQ ID NO: 35667 - protein, 447 aa, Artificial Sequence; identical to SEQ ID NO: 35647
  Description of Artificial Sequence: Synthetic polypeptide
  XENP022844 2A11_H1.144_L2.113_Fab-[CTLA-4]_H3.23_L0.129_scFv Fab-Fc Heavy Chain

SEQ ID NO: 35668 - protein, 118 aa, Artificial Sequence; identical to SEQ ID NO: 22085
  Description of Artificial Sequence: Synthetic polypeptide
  VH of XENP022844

SEQ ID NO: 35669 - protein, 5 aa, Artificial Sequence
  Description of Artificial Sequence: Synthetic peptide
  XENP022844 vhCDR1
DYFMH

SEQ ID NO: 35670 - protein, 17 aa, Artificial Sequence
  Description of Artificial Sequence: Synthetic peptide
  XENP022844 vhCDR2
WIDPELGDTEYAPKFQG

SEQ ID NO: 35671 - protein, 9 aa, Artificial Sequence
  Description of Artificial Sequence: Synthetic peptide
  XENP022844 vhCDR3
RGVYQALDY

SEQ ID NO: 35672 - protein, 477 aa, Artificial Sequence; identical to SEQ ID NO: 35612
  Description of Artificial Sequence: Synthetic polypeptide
  XENP022844 2A11_H1.144_L2.113_Fab-[CTLA-4]_H3.23_L0.129_scFv scFv-Fc Heavy Chain

SEQ ID NO: 35673 - protein, 118 aa, Artificial Sequence; identical to SEQ ID NO: 2632
  Description of Artificial Sequence: Synthetic polypeptide
  VH of XENP022844

SEQ ID NO: 35674 - protein, 108 aa, Artificial Sequence; identical to SEQ ID NO: 2768
  Description of Artificial Sequence: Synthetic polypeptide
  VL of XENP022844

SEQ ID NO: 35675 - protein, 231 aa, Artificial Sequence; identical to SEQ ID NO: 21572
  Description of Artificial Sequence: Synthetic polypeptide
  Fc chain of XENP022844

SEQ ID NO: 35676 - protein, 5 aa, Artificial Sequence
  Description of Artificial Sequence: Synthetic peptide
  XENP022844 vhCDR1
SYTMH

SEQ ID NO: 35677 - protein, 17 aa, Artificial Sequence
  Description of Artificial Sequence: Synthetic peptide
  XENP022844 vhCDR2
FISYDGNYKYYADSVKG

SEQ ID NO: 35678 - protein, 9 aa, Artificial Sequence
  Description of Artificial Sequence: Synthetic peptide
  XENP022844 vhCDR3
GGHLGPFDL

SEQ ID NO: 35679 - protein, 12 aa, Artificial Sequence
  Description of Artificial Sequence: Synthetic peptide
  XENP022844 vlCDR1
RASQSVGSSYLA

SEQ ID NO: 35680 - protein, 7 aa, Artificial Sequence
  Description of Artificial Sequence: Synthetic peptide
  XENP022844 vlCDR2
GASSRAT

SEQ ID NO: 35681 - protein, 9 aa, Artificial Sequence
  Description of Artificial Sequence: Synthetic peptide
  XENP022844 vlCDR3
QQYGSSPWT

SEQ ID NO: 35682 - protein, 214 aa, Artificial Sequence; identical to SEQ ID NO: 22079
  Description of Artificial Sequence: Synthetic polypeptide
  XENP022844 2A11_H1.144_L2.113_Fab-[CTLA-4]_H3.23_L0.129_scFv Light Chain

SEQ ID NO: 35683 - protein, 107 aa, Artificial Sequence; identical to SEQ ID NO: 22080
  Description of Artificial Sequence: Synthetic polypeptide
  VL of XENP022844

SEQ ID NO: 35684 - protein, 11 aa, Artificial Sequence
  Description of Artificial Sequence: Synthetic peptide
  XENP022844 vlCDR1
QASQDIGNYLN

SEQ ID NO: 35685 - protein, 7 aa, Artificial Sequence
  Description of Artificial Sequence: Synthetic peptide
  XENP022844 vlCDR2
FTSYLHS

SEQ ID NO: 35686 - protein, 9 aa, Artificial Sequence
  Description of Artificial Sequence: Synthetic peptide
  XENP022844 vlCDR3
QQGNTLPYT

SEQ ID NO: 35687 - protein, 447 aa, Artificial Sequence; identical to SEQ ID NO: 21564
  Description of Artificial Sequence: Synthetic polypeptide
  XENP022845 2A11_H1_L2.113_Fab-[CTLA-4]_H3.23_L0.129_scFv Fab -Fc Heavy Chain

SEQ ID NO: 35688 - protein, 118 aa, Artificial Sequence; identical to SEQ ID NO: 17236
  Description of Artificial Sequence: Synthetic polypeptide
  VH of XENP022845

SEQ ID NO: 35689 - protein, 5 aa, Artificial Sequence
  Description of Artificial Sequence: Synthetic peptide
  XENP022845 vhCDR1
DYYMH

SEQ ID NO: 35690 - protein, 17 aa, Artificial Sequence
  Description of Artificial Sequence: Synthetic peptide
  XENP022845 vhCDR2
WIDPENGDTEYAPKFQG

SEQ ID NO: 35691 - protein, 9 aa, Artificial Sequence
  Description of Artificial Sequence: Synthetic peptide
  XENP022845 vhCDR3
RGVRQALDY

SEQ ID NO: 35692 - protein, 477 aa, Artificial Sequence; identical to SEQ ID NO: 35612
  Description of Artificial Sequence: Synthetic polypeptide
  XENP022845 2A11_H1_L2.113_Fab-[CTLA-4]_H3.23_L0.129_scFv scFv -Fc Heavy Chain

SEQ ID NO: 35693 - protein, 118 aa, Artificial Sequence; identical to SEQ ID NO: 2632
  Description of Artificial Sequence: Synthetic polypeptide
  VH of XENP022845

SEQ ID NO: 35694 - protein, 108 aa, Artificial Sequence; identical to SEQ ID NO: 2768
  Description of Artificial Sequence: Synthetic polypeptide
  VL of XENP022845

SEQ ID NO: 35695 - protein, 231 aa, Artificial Sequence; identical to SEQ ID NO: 21572
  Description of Artificial Sequence: Synthetic polypeptide
  Fc chain of XENP022845

SEQ ID NO: 35696 - protein, 5 aa, Artificial Sequence
  Description of Artificial Sequence: Synthetic peptide
  XENP022845 vhCDR1
SYTMH

SEQ ID NO: 35697 - protein, 17 aa, Artificial Sequence
  Description of Artificial Sequence: Synthetic peptide
  XENP022845 vhCDR2
FISYDGNYKYYADSVKG

SEQ ID NO: 35698 - protein, 9 aa, Artificial Sequence
  Description of Artificial Sequence: Synthetic peptide
  XENP022845 vhCDR3
GGHLGPFDL

SEQ ID NO: 35699 - protein, 12 aa, Artificial Sequence
  Description of Artificial Sequence: Synthetic peptide
  XENP022845 vlCDR1
RASQSVGSSYLA

SEQ ID NO: 35700 - protein, 7 aa, Artificial Sequence
  Description of Artificial Sequence: Synthetic peptide
  XENP022845 vlCDR2
GASSRAT

SEQ ID NO: 35701 - protein, 9 aa, Artificial Sequence
  Description of Artificial Sequence: Synthetic peptide
  XENP022845 vlCDR3
QQYGSSPWT

SEQ ID NO: 35702 - protein, 214 aa, Artificial Sequence; identical to SEQ ID NO: 22079
  Description of Artificial Sequence: Synthetic polypeptide
  XENP022845 2A11_H1_L2.113_Fab-[CTLA-4]_H3.23_L0.129_scFv Light Chain

SEQ ID NO: 35703 - protein, 107 aa, Artificial Sequence; identical to SEQ ID NO: 22080
  Description of Artificial Sequence: Synthetic polypeptide
  VL of XENP022845

SEQ ID NO: 35704 - protein, 11 aa, Artificial Sequence
  Description of Artificial Sequence: Synthetic peptide
  XENP022845 vlCDR1
QASQDIGNYLN

SEQ ID NO: 35705 - protein, 7 aa, Artificial Sequence
  Description of Artificial Sequence: Synthetic peptide
  XENP022845 vlCDR2
FTSYLHS

SEQ ID NO: 35706 - protein, 9 aa, Artificial Sequence
  Description of Artificial Sequence: Synthetic peptide
  XENP022845 vlCDR3
QQGNTLPYT

SEQ ID NO: 35707 - protein, 447 aa, Artificial Sequence
  Description of Artificial Sequence: Synthetic polypeptide
  XENP022846 2A11_H1.125_L2.126_Fab-[CTLA-4]_H3.23_L0.129_scFv Fab-Fc Heavy Chain
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 35708 - protein, 118 aa, Artificial Sequence; identical to SEQ ID NO: 22065
  Description of Artificial Sequence: Synthetic polypeptide
  VH of XENP022846

SEQ ID NO: 35709 - protein, 5 aa, Artificial Sequence
  Description of Artificial Sequence: Synthetic peptide
  XENP022846 vhCDR1
HYFMH

SEQ ID NO: 35710 - protein, 17 aa, Artificial Sequence
  Description of Artificial Sequence: Synthetic peptide
  XENP022846 vhCDR2
WIDPYLGDTEYAPKFQG

SEQ ID NO: 35711 - protein, 9 aa, Artificial Sequence
  Description of Artificial Sequence: Synthetic peptide
  XENP022846 vhCDR3
RGVYQALDY

SEQ ID NO: 35712 - protein, 477 aa, Artificial Sequence; identical to SEQ ID NO: 35612
  Description of Artificial Sequence: Synthetic polypeptide
  XENP022846 2A11_H1.125_L2.126_Fab-[CTLA-4]_H3.23_L0.129_scFv scFv-Fc Heavy Chain

SEQ ID NO: 35713 - protein, 118 aa, Artificial Sequence; identical to SEQ ID NO: 2632
  Description of Artificial Sequence: Synthetic polypeptide
  VH of XENP022846

SEQ ID NO: 35714 - protein, 108 aa, Artificial Sequence; identical to SEQ ID NO: 2768
  Description of Artificial Sequence: Synthetic polypeptide
  VL of XENP022846

SEQ ID NO: 35715 - protein, 231 aa, Artificial Sequence; identical to SEQ ID NO: 21572
  Description of Artificial Sequence: Synthetic polypeptide
  Fc chain of XENP022846

SEQ ID NO: 35716 - protein, 5 aa, Artificial Sequence
  Description of Artificial Sequence: Synthetic peptide
  XENP022846 vhCDR1
SYTMH

SEQ ID NO: 35717 - protein, 17 aa, Artificial Sequence
  Description of Artificial Sequence: Synthetic peptide
  XENP022846 vhCDR2
FISYDGNYKYYADSVKG

SEQ ID NO: 35718 - protein, 9 aa, Artificial Sequence
  Description of Artificial Sequence: Synthetic peptide
  XENP022846 vhCDR3
GGHLGPFDL

SEQ ID NO: 35719 - protein, 12 aa, Artificial Sequence
  Description of Artificial Sequence: Synthetic peptide
  XENP022846 vlCDR1
RASQSVGSSYLA

SEQ ID NO: 35720 - protein, 7 aa, Artificial Sequence
  Description of Artificial Sequence: Synthetic peptide
  XENP022846 vlCDR2
GASSRAT

SEQ ID NO: 35721 - protein, 9 aa, Artificial Sequence
  Description of Artificial Sequence: Synthetic peptide
  XENP022846 vlCDR3
QQYGSSPWT

SEQ ID NO: 35722 - protein, 214 aa, Artificial Sequence; identical to SEQ ID NO: 22259
  Description of Artificial Sequence: Synthetic polypeptide
  XENP022846 2A11_H1.125_L2.126_Fab-[CTLA-4]_H3.23_L0.129_scFv Light Chain

SEQ ID NO: 35723 - protein, 107 aa, Artificial Sequence; identical to SEQ ID NO: 22260
  Description of Artificial Sequence: Synthetic polypeptide
  VL of XENP022846

SEQ ID NO: 35724 - protein, 11 aa, Artificial Sequence
  Description of Artificial Sequence: Synthetic peptide
  XENP022846 vlCDR1
QASQDIGNYLN

SEQ ID NO: 35725 - protein, 7 aa, Artificial Sequence
  Description of Artificial Sequence: Synthetic peptide
  XENP022846 vlCDR2
FTSYLHS

SEQ ID NO: 35726 - protein, 9 aa, Artificial Sequence
  Description of Artificial Sequence: Synthetic peptide
  XENP022846 vlCDR3
QEGNTLPYT

SEQ ID NO: 35727 - protein, 450 aa, Artificial Sequence
  Description of Artificial Sequence: Synthetic polypeptide
  XENP023223 7G8_H3.66_L1.34_Fab-[CTLA-4]_H3.23_L0.129_scFv Fab -Fc Heavy Chain
EVQLVESGGGLVQPGGSLRLSCAASGFTFDEAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 35728 - protein, 121 aa, Artificial Sequence; identical to SEQ ID NO: 35418
  Description of Artificial Sequence: Synthetic polypeptide
  VH of XENP023223

SEQ ID NO: 35729 - protein, 5 aa, Artificial Sequence
  Description of Artificial Sequence: Synthetic peptide
  XENP023223 vhCDR1
EAWMS

SEQ ID NO: 35730 - protein, 19 aa, Artificial Sequence
  Description of Artificial Sequence: Synthetic peptide
  XENP023223 vhCDR2
EISTKANNHATYYAESVKG

SEQ ID NO: 35731 - protein, 10 aa, Artificial Sequence
  Description of Artificial Sequence: Synthetic peptide
  XENP023223 vhCDR3
LATWDWYFDV

SEQ ID NO: 35732 - protein, 477 aa, Artificial Sequence; identical to SEQ ID NO: 21669
  Description of Artificial Sequence: Synthetic polypeptide
  XENP023223 7G8_H3.66_L1.34_Fab-[CTLA-4]_H3.23_L0.129_scFv scFv -Fc Heavy Chain

SEQ ID NO: 35733 - protein, 118 aa, Artificial Sequence; identical to SEQ ID NO: 2632
  Description of Artificial Sequence: Synthetic polypeptide
  VH of XENP023223

SEQ ID NO: 35734 - protein, 108 aa, Artificial Sequence; identical to SEQ ID NO: 2768
  Description of Artificial Sequence: Synthetic polypeptide
  VL of XENP023223

SEQ ID NO: 35735 - protein, 231 aa, Artificial Sequence; identical to SEQ ID NO: 21532
  Description of Artificial Sequence: Synthetic polypeptide
  Fc chain of XENP023223

SEQ ID NO: 35736 - protein, 5 aa, Artificial Sequence
  Description of Artificial Sequence: Synthetic peptide
  XENP023223 vhCDR1
SYTMH

SEQ ID NO: 35737 - protein, 17 aa, Artificial Sequence
  Description of Artificial Sequence: Synthetic peptide
  XENP023223 vhCDR2
FISYDGNYKYYADSVKG

SEQ ID NO: 35738 - protein, 9 aa, Artificial Sequence
  Description of Artificial Sequence: Synthetic peptide
  XENP023223 vhCDR3
GGHLGPFDL

SEQ ID NO: 35739 - protein, 12 aa, Artificial Sequence
  Description of Artificial Sequence: Synthetic peptide
  XENP023223 vlCDR1
RASQSVGSSYLA

SEQ ID NO: 35740 - protein, 7 aa, Artificial Sequence
  Description of Artificial Sequence: Synthetic peptide
  XENP023223 vlCDR2
GASSRAT

SEQ ID NO: 35741 - protein, 9 aa, Artificial Sequence
  Description of Artificial Sequence: Synthetic peptide
  XENP023223 vlCDR3
QQYGSSPWT

SEQ ID NO: 35742 - protein, 218 aa, Artificial Sequence; identical to SEQ ID NO: 22599
  Description of Artificial Sequence: Synthetic polypeptide
  XENP023223 7G8_H3.66_L1.34_Fab-[CTLA-4]_H3.23_L0.129_scFv Light Chain

SEQ ID NO: 35743 - protein, 111 aa, Artificial Sequence; identical to SEQ ID NO: 22600
  Description of Artificial Sequence: Synthetic polypeptide
  VL of XENP023223

SEQ ID NO: 35744 - protein, 15 aa, Artificial Sequence
  Description of Artificial Sequence: Synthetic peptide
  XENP023223 vlCDR1
RASQSVDYDGDSYMN

SEQ ID NO: 35745 - protein, 7 aa, Artificial Sequence
  Description of Artificial Sequence: Synthetic peptide
  XENP023223 vlCDR2
AASELES

SEQ ID NO: 35746 - protein, 9 aa, Artificial Sequence
  Description of Artificial Sequence: Synthetic peptide
  XENP023223 vlCDR3
QQSNEDPFT

SEQ ID NO: 35747 - protein, 450 aa, Artificial Sequence
  Description of Artificial Sequence: Synthetic polypeptide
  XENP023224 7G8_H3.67_L1.34_Fab-[CTLA-4]_H3.23_L0.129_scFv Fab -Fc Heavy Chain
EVQLVESGGGLVQPGGSLRLSCAASGFTFDDTWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 35748 - protein, 121 aa, Artificial Sequence; identical to SEQ ID NO: 35428
  Description of Artificial Sequence: Synthetic polypeptide
  VH of XENP023224

SEQ ID NO: 35749 - protein, 5 aa, Artificial Sequence
  Description of Artificial Sequence: Synthetic peptide
  XENP023224 vhCDR1
DTWMS

SEQ ID NO: 35750 - protein, 19 aa, Artificial Sequence
  Description of Artificial Sequence: Synthetic peptide
  XENP023224 vhCDR2
EISTKANNHATYYAESVKG

SEQ ID NO: 35751 - protein, 10 aa, Artificial Sequence
  Description of Artificial Sequence: Synthetic peptide
  XENP023224 vhCDR3
LATWDWYFDV

SEQ ID NO: 35752 - protein, 477 aa, Artificial Sequence; identical to SEQ ID NO: 21669
  Description of Artificial Sequence: Synthetic polypeptide
  XENP023224 7G8_H3.67_L1.34_Fab-[CTLA-4]_H3.23_L0.129_scFv scFv -Fc Heavy Chain

SEQ ID NO: 35753 - protein, 118 aa, Artificial Sequence; identical to SEQ ID NO: 2632
  Description of Artificial Sequence: Synthetic polypeptide
  VH of XENP023224

SEQ ID NO: 35754 - protein, 108 aa, Artificial Sequence; identical to SEQ ID NO: 2768
  Description of Artificial Sequence: Synthetic polypeptide
  VL of XENP023224

SEQ ID NO: 35755 - protein, 231 aa, Artificial Sequence; identical to SEQ ID NO: 21532
  Description of Artificial Sequence: Synthetic polypeptide
  Fc chain of XENP023224

SEQ ID NO: 35756 - protein, 5 aa, Artificial Sequence
  Description of Artificial Sequence: Synthetic peptide
  XENP023224 vhCDR1
SYTMH

SEQ ID NO: 35757 - protein, 17 aa, Artificial Sequence
  Description of Artificial Sequence: Synthetic peptide
  XENP023224 vhCDR2
FISYDGNYKYYADSVKG

SEQ ID NO: 35758 - protein, 9 aa, Artificial Sequence
  Description of Artificial Sequence: Synthetic peptide
  XENP023224 vhCDR3
GGHLGPFDL

SEQ ID NO: 35759 - protein, 12 aa, Artificial Sequence
  Description of Artificial Sequence: Synthetic peptide
  XENP023224 vlCDR1
RASQSVGSSYLA

SEQ ID NO: 35760 - protein, 7 aa, Artificial Sequence
  Description of Artificial Sequence: Synthetic peptide
  XENP023224 vlCDR2
GASSRAT

SEQ ID NO: 35761 - protein, 9 aa, Artificial Sequence
  Description of Artificial Sequence: Synthetic peptide
  XENP023224 vlCDR3
QQYGSSPWT

SEQ ID NO: 35762 - protein, 218 aa, Artificial Sequence; identical to SEQ ID NO: 22599
  Description of Artificial Sequence: Synthetic polypeptide
  XENP023224 7G8_H3.67_L1.34_Fab-[CTLA-4]_H3.23_L0.129_scFv Light Chain

SEQ ID NO: 35763 - protein, 111 aa, Artificial Sequence; identical to SEQ ID NO: 22600
  Description of Artificial Sequence: Synthetic polypeptide
  VL of XENP023224

SEQ ID NO: 35764 - protein, 15 aa, Artificial Sequence
  Description of Artificial Sequence: Synthetic peptide
  XENP023224 vlCDR1
RASQSVDYDGDSYMN

SEQ ID NO: 35765 - protein, 7 aa, Artificial Sequence
  Description of Artificial Sequence: Synthetic peptide
  XENP023224 vlCDR2
AASELES

SEQ ID NO: 35766 - protein, 9 aa, Artificial Sequence
  Description of Artificial Sequence: Synthetic peptide
  XENP023224 vlCDR3
QQSNEDPFT

SEQ ID NO: 35767 - protein, 450 aa, Artificial Sequence
  Description of Artificial Sequence: Synthetic polypeptide
  XENP023225 7G8_H3.71_L1.34_Fab-[CTLA-4]_H3.23_L0.129_scFv Fab-Fc Heavy Chain
EVQLVESGGGLVQPGGSLRLSCAASGFTFDDAWMSWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 35768 - protein, 121 aa, Artificial Sequence; identical to SEQ ID NO: 35468
  Description of Artificial Sequence: Synthetic polypeptide
  VH of XENP023225

SEQ ID NO: 35769 - protein, 5 aa, Artificial Sequence
  Description of Artificial Sequence: Synthetic peptide
  XENP023225 vhCDR1
DAWMS

SEQ ID NO: 35770 - protein, 19 aa, Artificial Sequence
  Description of Artificial Sequence: Synthetic peptide
  XENP023225 vhCDR2
EISTKAYNHATYYAESVKG

SEQ ID NO: 35771 - protein, 10 aa, Artificial Sequence
  Description of Artificial Sequence: Synthetic peptide
  XENP023225 vhCDR3
LATWDWYFDV

SEQ ID NO: 35772 - protein, 477 aa, Artificial Sequence; identical to SEQ ID NO: 21669
  Description of Artificial Sequence: Synthetic polypeptide
  XENP023225 7G8_H3.71_L1.34_Fab-[CTLA-4]_H3.23_L0.129_scFv scFv -Fc Heavy Chain

SEQ ID NO: 35773 - protein, 118 aa, Artificial Sequence; identical to SEQ ID NO: 2632
  Description of Artificial Sequence: Synthetic polypeptide
  VH of XENP023225

SEQ ID NO: 35774 - protein, 108 aa, Artificial Sequence; identical to SEQ ID NO: 2768
  Description of Artificial Sequence: Synthetic polypeptide
  VL of XENP023225

SEQ ID NO: 35775 - protein, 231 aa, Artificial Sequence; identical to SEQ ID NO: 21532
  Description of Artificial Sequence: Synthetic polypeptide
  Fc chain of XENP023225

SEQ ID NO: 35776 - protein, 5 aa, Artificial Sequence
  Description of Artificial Sequence: Synthetic peptide
  XENP023225 vhCDR1
SYTMH

SEQ ID NO: 35777 - protein, 17 aa, Artificial Sequence
  Description of Artificial Sequence: Synthetic peptide
  XENP023225 vhCDR2
FISYDGNYKYYADSVKG

SEQ ID NO: 35778 - protein, 9 aa, Artificial Sequence
  Description of Artificial Sequence: Synthetic peptide
  XENP023225 vhCDR3
GGHLGPFDL

SEQ ID NO: 35779 - protein, 12 aa, Artificial Sequence
  Description of Artificial Sequence: Synthetic peptide
  XENP023225 vlCDR1
RASQSVGSSYLA

SEQ ID NO: 35780 - protein, 7 aa, Artificial Sequence
  Description of Artificial Sequence: Synthetic peptide
  XENP023225 vlCDR2
GASSRAT

SEQ ID NO: 35781 - protein, 9 aa, Artificial Sequence
  Description of Artificial Sequence: Synthetic peptide
  XENP023225 vlCDR3
QQYGSSPWT

SEQ ID NO: 35782 - protein, 218 aa, Artificial Sequence; identical to SEQ ID NO: 22599
  Description of Artificial Sequence: Synthetic polypeptide
  XENP023225 7G8_H3.71_L1.34_Fab-[CTLA-4]_H3.23_L0.129_scFv Light Chain

SEQ ID NO: 35783 - protein, 111 aa, Artificial Sequence; identical to SEQ ID NO: 22600
  Description of Artificial Sequence: Synthetic polypeptide
  VL of XENP023225

SEQ ID NO: 35784 - protein, 15 aa, Artificial Sequence
  Description of Artificial Sequence: Synthetic peptide
  XENP023225 vlCDR1
RASQSVDYDGDSYMN

SEQ ID NO: 35785 - protein, 7 aa, Artificial Sequence
  Description of Artificial Sequence: Synthetic peptide
  XENP023225 vlCDR2
AASELES

SEQ ID NO: 35786 - protein, 9 aa, Artificial Sequence
  Description of Artificial Sequence: Synthetic peptide
  XENP023225 vlCDR3
QQSNEDPFT

SEQ ID NO: 35787 - protein, 450 aa, Artificial Sequence; identical to SEQ ID NO: 22484
  Description of Artificial Sequence: Synthetic polypeptide
  XENP023226 7G8_H3.30_L1.39_Fab-[CTLA-4]_H3.23_L0.129_scFv Fab- Fc Heavy Chain

SEQ ID NO: 35788 - protein, 121 aa, Artificial Sequence; identical to SEQ ID NO: 22485
  Description of Artificial Sequence: Synthetic polypeptide
  VH of XENP023226

SEQ ID NO: 35789 - protein, 5 aa, Artificial Sequence
  Description of Artificial Sequence: Synthetic peptide
  XENP023226 vhCDR1
DAWMS

SEQ ID NO: 35790 - protein, 19 aa, Artificial Sequence
  Description of Artificial Sequence: Synthetic peptide
  XENP023226 vhCDR2
EISTKANNHATYYAESVKG

SEQ ID NO: 35791 - protein, 10 aa, Artificial Sequence
  Description of Artificial Sequence: Synthetic peptide
  XENP023226 vhCDR3
LATWDWYFDV

SEQ ID NO: 35792 - protein, 477 aa, Artificial Sequence; identical to SEQ ID NO: 21669
  Description of Artificial Sequence: Synthetic polypeptide
  XENP023226 7G8_H3.30_L1.39_Fab-[CTLA-4]_H3.23_L0.129_scFv scFv -Fc Heavy Chain

SEQ ID NO: 35793 - protein, 118 aa, Artificial Sequence; identical to SEQ ID NO: 2632
  Description of Artificial Sequence: Synthetic polypeptide
  VH of XENP023226

SEQ ID NO: 35794 - protein, 108 aa, Artificial Sequence; identical to SEQ ID NO: 2768
  Description of Artificial Sequence: Synthetic polypeptide
  VL of XENP023226

SEQ ID NO: 35795 - protein, 231 aa, Artificial Sequence; identical to SEQ ID NO: 21532
  Description of Artificial Sequence: Synthetic polypeptide
  Fc chain of XENP023226

SEQ ID NO: 35796 - protein, 5 aa, Artificial Sequence
  Description of Artificial Sequence: Synthetic peptide
  XENP023226 vhCDR1
SYTMH

SEQ ID NO: 35797 - protein, 17 aa, Artificial Sequence
  Description of Artificial Sequence: Synthetic peptide
  XENP023226 vhCDR2
FISYDGNYKYYADSVKG

SEQ ID NO: 35798 - protein, 9 aa, Artificial Sequence
  Description of Artificial Sequence: Synthetic peptide
  XENP023226 vhCDR3
GGHLGPFDL

SEQ ID NO: 35799 - protein, 12 aa, Artificial Sequence
  Description of Artificial Sequence: Synthetic peptide
  XENP023226 vlCDR1
RASQSVGSSYLA

SEQ ID NO: 35800 - protein, 7 aa, Artificial Sequence
  Description of Artificial Sequence: Synthetic peptide
  XENP023226 vlCDR2
GASSRAT

SEQ ID NO: 35801 - protein, 9 aa, Artificial Sequence
  Description of Artificial Sequence: Synthetic peptide
  XENP023226 vlCDR3
QQYGSSPWT

SEQ ID NO: 35802 - protein, 218 aa, Artificial Sequence; identical to SEQ ID NO: 35532
  Description of Artificial Sequence: Synthetic polypeptide
  XENP023226 7G8_H3.30_L1.39_Fab-[CTLA-4]_H3.23_L0.129_scFv Light Chain

SEQ ID NO: 35803 - protein, 111 aa, Artificial Sequence; identical to SEQ ID NO: 35533
  Description of Artificial Sequence: Synthetic polypeptide
  VL of XENP023226

SEQ ID NO: 35804 - protein, 15 aa, Artificial Sequence
  Description of Artificial Sequence: Synthetic peptide
  XENP023226 vlCDR1
RASQSVDYYGDSYMN

SEQ ID NO: 35805 - protein, 7 aa, Artificial Sequence
  Description of Artificial Sequence: Synthetic peptide
  XENP023226 vlCDR2
AASELES

SEQ ID NO: 35806 - protein, 9 aa, Artificial Sequence
  Description of Artificial Sequence: Synthetic peptide
  XENP023226 vlCDR3
QQSNEDPFT

SEQ ID NO: 35807 - protein, 450 aa, Artificial Sequence; identical to SEQ ID NO: 35727
  Description of Artificial Sequence: Synthetic polypeptide
  XENP023227 7G8_H3.66_L1.39_Fab-[CTLA-4]_H3.23_L0.129_scFv Fab -Fc Heavy Chain

SEQ ID NO: 35808 - protein, 121 aa, Artificial Sequence; identical to SEQ ID NO: 35418
  Description of Artificial Sequence: Synthetic polypeptide
  VH of XENP023227

SEQ ID NO: 35809 - protein, 5 aa, Artificial Sequence
  Description of Artificial Sequence: Synthetic peptide
  XENP023227 vhCDR1
EAWMS

SEQ ID NO: 35810 - protein, 19 aa, Artificial Sequence
  Description of Artificial Sequence: Synthetic peptide
  XENP023227 vhCDR2
EISTKANNHATYYAESVKG

SEQ ID NO: 35811 - protein, 10 aa, Artificial Sequence
  Description of Artificial Sequence: Synthetic peptide
  XENP023227 vhCDR3
LATWDWYFDV

SEQ ID NO: 35812 - protein, 477 aa, Artificial Sequence; identical to SEQ ID NO: 21669
  Description of Artificial Sequence: Synthetic polypeptide
  XENP023227 7G8_H3.66_L1.39_Fab-[CTLA-4]_H3.23_L0.129_scFv scFv -Fc Heavy Chain

SEQ ID NO: 35813 - protein, 118 aa, Artificial Sequence; identical to SEQ ID NO: 2632
  Description of Artificial Sequence: Synthetic polypeptide
  VH of XENP023227

SEQ ID NO: 35814 - protein, 108 aa, Artificial Sequence; identical to SEQ ID NO: 2768
  Description of Artificial Sequence: Synthetic polypeptide
  VL of XENP023227

SEQ ID NO: 35815 - protein, 231 aa, Artificial Sequence; identical to SEQ ID NO: 21532
  Description of Artificial Sequence: Synthetic polypeptide
  Fc chain of XENP023227

SEQ ID NO: 35816 - protein, 5 aa, Artificial Sequence
  Description of Artificial Sequence: Synthetic peptide
  XENP023227 vhCDR1
SYTMH

SEQ ID NO: 35817 - protein, 17 aa, Artificial Sequence
  Description of Artificial Sequence: Synthetic peptide
  XENP023227 vhCDR2
FISYDGNYKYYADSVKG

SEQ ID NO: 35818 - protein, 9 aa, Artificial Sequence
  Description of Artificial Sequence: Synthetic peptide
  XENP023227 vhCDR3
GGHLGPFDL

SEQ ID NO: 35819 - protein, 12 aa, Artificial Sequence
  Description of Artificial Sequence: Synthetic peptide
  XENP023227 vlCDR1
RASQSVGSSYLA

SEQ ID NO: 35820 - protein, 7 aa, Artificial Sequence
  Description of Artificial Sequence: Synthetic peptide
  XENP023227 vlCDR2
GASSRAT

SEQ ID NO: 35821 - protein, 9 aa, Artificial Sequence
  Description of Artificial Sequence: Synthetic peptide
  XENP023227 vlCDR3
QQYGSSPWT

SEQ ID NO: 35822 - protein, 218 aa, Artificial Sequence; identical to SEQ ID NO: 35532
  Description of Artificial Sequence: Synthetic polypeptide
  XENP023227 7G8_H3.66_L1.39_Fab-[CTLA-4]_H3.23_L0.129_scFv Light Chain

SEQ ID NO: 35823 - protein, 111 aa, Artificial Sequence; identical to SEQ ID NO: 35533
  Description of Artificial Sequence: Synthetic polypeptide
  VL of XENP023227

SEQ ID NO: 35824 - protein, 15 aa, Artificial Sequence
  Description of Artificial Sequence: Synthetic peptide
  XENP023227 vlCDR1
RASQSVDYYGDSYMN

SEQ ID NO: 35825 - protein, 7 aa, Artificial Sequence
  Description of Artificial Sequence: Synthetic peptide
  XENP023227 vlCDR2
AASELES

SEQ ID NO: 35826 - protein, 9 aa, Artificial Sequence
  Description of Artificial Sequence: Synthetic peptide
  XENP023227 vlCDR3
QQSNEDPFT

SEQ ID NO: 35827 - protein, 450 aa, Artificial Sequence; identical to SEQ ID NO: 35747
  Description of Artificial Sequence: Synthetic polypeptide
  XENP023228 7G8_H3.67_L1.39_Fab-[CTLA-4]_H3.23_L0.129_scFv Fab- Fc Heavy Chain

SEQ ID NO: 35828 - protein, 121 aa, Artificial Sequence; identical to SEQ ID NO: 35428
  Description of Artificial Sequence: Synthetic polypeptide
  VH of XENP023228

SEQ ID NO: 35829 - protein, 5 aa, Artificial Sequence
  Description of Artificial Sequence: Synthetic peptide
  XENP023228 vhCDR1
DTWMS

SEQ ID NO: 35830 - protein, 19 aa, Artificial Sequence
  Description of Artificial Sequence: Synthetic peptide
  XENP023228 vhCDR2
EISTKANNHATYYAESVKG

SEQ ID NO: 35831 - protein, 10 aa, Artificial Sequence
  Description of Artificial Sequence: Synthetic peptide
  XENP023228 vhCDR3
LATWDWYFDV

SEQ ID NO: 35832 - protein, 477 aa, Artificial Sequence; identical to SEQ ID NO: 21669
  Description of Artificial Sequence: Synthetic polypeptide
  XENP023228 7G8_H3.67_L1.39_Fab-[CTLA-4]_H3.23_L0.129_scFv scFv -Fc Heavy Chain

SEQ ID NO: 35833 - protein, 118 aa, Artificial Sequence; identical to SEQ ID NO: 2632
  Description of Artificial Sequence: Synthetic polypeptide
  VH of XENP023228

SEQ ID NO: 35834 - protein, 108 aa, Artificial Sequence; identical to SEQ ID NO: 2768
  Description of Artificial Sequence: Synthetic polypeptide
  VL of XENP023228

SEQ ID NO: 35835 - protein, 231 aa, Artificial Sequence; identical to SEQ ID NO: 21532
  Description of Artificial Sequence: Synthetic polypeptide
  Fc chain of XENP023228

SEQ ID NO: 35836 - protein, 5 aa, Artificial Sequence
  Description of Artificial Sequence: Synthetic peptide
  XENP023228 vhCDR1
SYTMH

SEQ ID NO: 35837 - protein, 17 aa, Artificial Sequence
  Description of Artificial Sequence: Synthetic peptide
  XENP023228 vhCDR2
FISYDGNYKYYADSVKG

SEQ ID NO: 35838 - protein, 9 aa, Artificial Sequence
  Description of Artificial Sequence: Synthetic peptide
  XENP023228 vhCDR3
GGHLGPFDL

SEQ ID NO: 35839 - protein, 12 aa, Artificial Sequence
  Description of Artificial Sequence: Synthetic peptide
  XENP023228 vlCDR1
RASQSVGSSYLA

SEQ ID NO: 35840 - protein, 7 aa, Artificial Sequence
  Description of Artificial Sequence: Synthetic peptide
  XENP023228 vlCDR2
GASSRAT

SEQ ID NO: 35841 - protein, 9 aa, Artificial Sequence
  Description of Artificial Sequence: Synthetic peptide
  XENP023228 vlCDR3
QQYGSSPWT

SEQ ID NO: 35842 - protein, 218 aa, Artificial Sequence; identical to SEQ ID NO: 35532
  Description of Artificial Sequence: Synthetic polypeptide
  XENP023228 7G8_H3.67_L1.39_Fab-[CTLA-4]_H3.23_L0.129_scFv Light Chain

SEQ ID NO: 35843 - protein, 111 aa, Artificial Sequence; identical to SEQ ID NO: 35533
  Description of Artificial Sequence: Synthetic polypeptide
  VL of XENP023228

SEQ ID NO: 35844 - protein, 15 aa, Artificial Sequence
  Description of Artificial Sequence: Synthetic peptide
  XENP023228 vlCDR1
RASQSVDYYGDSYMN

SEQ ID NO: 35845 - protein, 7 aa, Artificial Sequence
  Description of Artificial Sequence: Synthetic peptide
  XENP023228 vlCDR2
AASELES

SEQ ID NO: 35846 - protein, 9 aa, Artificial Sequence
  Description of Artificial Sequence: Synthetic peptide
  XENP023228 vlCDR3
QQSNEDPFT

SEQ ID NO: 35847 - protein, 450 aa, Artificial Sequence; identical to SEQ ID NO: 35767
  Description of Artificial Sequence: Synthetic polypeptide
  XENP023229 7G8_H3.71_L1.39_Fab-[CTLA-4]_H3.23_L0.129_scFv Fab -Fc Heavy Chain

SEQ ID NO: 35848 - protein, 121 aa, Artificial Sequence; identical to SEQ ID NO: 35468
  Description of Artificial Sequence: Synthetic polypeptide
  VH of XENP023229

SEQ ID NO: 35849 - protein, 5 aa, Artificial Sequence
  Description of Artificial Sequence: Synthetic peptide
  XENP023229 vhCDR1
DAWMS

SEQ ID NO: 35850 - protein, 19 aa, Artificial Sequence
  Description of Artificial Sequence: Synthetic peptide
  XENP023229 vhCDR2
EISTKAYNHATYYAESVKG

SEQ ID NO: 35851 - protein, 10 aa, Artificial Sequence
  Description of Artificial Sequence: Synthetic peptide
  XENP023229 vhCDR3
LATWDWYFDV

SEQ ID NO: 35852 - protein, 477 aa, Artificial Sequence; identical to SEQ ID NO: 21669
  Description of Artificial Sequence: Synthetic polypeptide
  XENP023229 7G8_H3.71_L1.39_Fab-[CTLA-4]_H3.23_L0.129_scFv scFv -Fc Heavy Chain

SEQ ID NO: 35853 - protein, 118 aa, Artificial Sequence; identical to SEQ ID NO: 2632
  Description of Artificial Sequence: Synthetic polypeptide
  VH of XENP023229

SEQ ID NO: 35854 - protein, 108 aa, Artificial Sequence; identical to SEQ ID NO: 2768
  Description of Artificial Sequence: Synthetic polypeptide
  VL of XENP023229

SEQ ID NO: 35855 - protein, 231 aa, Artificial Sequence; identical to SEQ ID NO: 21532
  Description of Artificial Sequence: Synthetic polypeptide
  Fc chain of XENP023229

SEQ ID NO: 35856 - protein, 5 aa, Artificial Sequence
  Description of Artificial Sequence: Synthetic peptide
  XENP023229 vhCDR1
SYTMH

SEQ ID NO: 35857 - protein, 17 aa, Artificial Sequence
  Description of Artificial Sequence: Synthetic peptide
  XENP023229 vhCDR2
FISYDGNYKYYADSVKG

SEQ ID NO: 35858 - protein, 9 aa, Artificial Sequence
  Description of Artificial Sequence: Synthetic peptide
  XENP023229 vhCDR3
GGHLGPFDL

SEQ ID NO: 35859 - protein, 12 aa, Artificial Sequence
  Description of Artificial Sequence: Synthetic peptide
  XENP023229 vlCDR1
RASQSVGSSYLA

SEQ ID NO: 35860 - protein, 7 aa, Artificial Sequence
  Description of Artificial Sequence: Synthetic peptide
  XENP023229 vlCDR2
GASSRAT

SEQ ID NO: 35861 - protein, 9 aa, Artificial Sequence
  Description of Artificial Sequence: Synthetic peptide
  XENP023229 vlCDR3
QQYGSSPWT

SEQ ID NO: 35862 - protein, 218 aa, Artificial Sequence; identical to SEQ ID NO: 35532
  Description of Artificial Sequence: Synthetic polypeptide
  XENP023229 7G8_H3.71_L1.39_Fab-[CTLA-4]_H3.23_L0.129_scFv Light Chain

SEQ ID NO: 35863 - protein, 111 aa, Artificial Sequence; identical to SEQ ID NO: 35533
  Description of Artificial Sequence: Synthetic polypeptide
  VL of XENP023229

SEQ ID NO: 35864 - protein, 15 aa, Artificial Sequence
  Description of Artificial Sequence: Synthetic peptide
  XENP023229 vlCDR1
RASQSVDYYGDSYMN

SEQ ID NO: 35865 - protein, 7 aa, Artificial Sequence
  Description of Artificial Sequence: Synthetic peptide
  XENP023229 vlCDR2
AASELES

SEQ ID NO: 35866 - protein, 9 aa, Artificial Sequence
  Description of Artificial Sequence: Synthetic peptide
  XENP023229 vlCDR3
QQSNEDPFT

SEQ ID NO: 35867 - protein, 447 aa, Artificial Sequence; identical to SEQ ID NO: 22084
  Description of Artificial Sequence: Synthetic polypeptide
  XENP022718 2A11_H1.144_L2_Fab-1G6_L1.194_H1.279_scFv Fab-Fc Heavy Chain

SEQ ID NO: 35868 - protein, 118 aa, Artificial Sequence; identical to SEQ ID NO: 22085
  Description of Artificial Sequence: Synthetic polypeptide
  VH of XENP022718

SEQ ID NO: 35869 - protein, 5 aa, Artificial Sequence
  Description of Artificial Sequence: Synthetic peptide
  XENP022718 vhCDR1
DYFMH

SEQ ID NO: 35870 - protein, 17 aa, Artificial Sequence
  Description of Artificial Sequence: Synthetic peptide
  XENP022718 vhCDR2
WIDPELGDTEYAPKFQG

SEQ ID NO: 35871 - protein, 9 aa, Artificial Sequence
  Description of Artificial Sequence: Synthetic peptide
  XENP022718 vhCDR3
RGVYQALDY

SEQ ID NO: 35872 - protein, 480 aa, Artificial Sequence; identical to SEQ ID NO: 23221
  Description of Artificial Sequence: Synthetic polypeptide
  XENP022718 2A11_H1.144_L2_Fab-1G6_L1.194_H1.279_scFv scFv-Fc Heavy Chain

SEQ ID NO: 35873 - protein, 107 aa, Artificial Sequence; identical to SEQ ID NO: 10999
  Description of Artificial Sequence: Synthetic polypeptide
  VH of XENP022718

SEQ ID NO: 35874 - protein, 122 aa, Artificial Sequence; identical to SEQ ID NO: 10908
  Description of Artificial Sequence: Synthetic polypeptide
  VL of XENP022718

SEQ ID NO: 35875 - protein, 231 aa, Artificial Sequence; identical to SEQ ID NO: 21532
  Description of Artificial Sequence: Synthetic polypeptide
  Fc chain of XENP022718

SEQ ID NO: 35876 - protein, 11 aa, Artificial Sequence
  Description of Artificial Sequence: Synthetic peptide
  XENP022718 vhCDR1
RASQSVGNDVA

SEQ ID NO: 35877 - protein, 7 aa, Artificial Sequence
  Description of Artificial Sequence: Synthetic peptide
  XENP022718 vhCDR2
YASHRYT

SEQ ID NO: 35878 - protein, 9 aa, Artificial Sequence
  Description of Artificial Sequence: Synthetic peptide
  XENP022718 vhCDR3
QQDFSSPRT

SEQ ID NO: 35879 - protein, 5 aa, Artificial Sequence
  Description of Artificial Sequence: Synthetic peptide
  XENP022718 vlCDR1
NYWMN

SEQ ID NO: 35880 - protein, 19 aa, Artificial Sequence
  Description of Artificial Sequence: Synthetic peptide
  XENP022718 vlCDR2
EIRLYSNNYATHYAESVKG

SEQ ID NO: 35881 - protein, 11 aa, Artificial Sequence
  Description of Artificial Sequence: Synthetic peptide
  XENP022718 vlCDR3
YYGNYGGYFDV

SEQ ID NO: 35882 - protein, 214 aa, Artificial Sequence; identical to SEQ ID NO: 17250
  Description of Artificial Sequence: Synthetic polypeptide
  XENP022718 2A11_H1.144_L2_Fab-1G6_L1.194_H1.279_scFv Light Chain

SEQ ID NO: 35883 - protein, 107 aa, Artificial Sequence; identical to SEQ ID NO: 17251
  Description of Artificial Sequence: Synthetic polypeptide
  VL of XENP022718

SEQ ID NO: 35884 - protein, 11 aa, Artificial Sequence
  Description of Artificial Sequence: Synthetic peptide
  XENP022718 vlCDR1
QASQDIGNYLN

SEQ ID NO: 35885 - protein, 7 aa, Artificial Sequence
  Description of Artificial Sequence: Synthetic peptide
  XENP022718 vlCDR2
YTSRLHS

SEQ ID NO: 35886 - protein, 9 aa, Artificial Sequence
  Description of Artificial Sequence: Synthetic peptide
  XENP022718 vlCDR3
QQGNTLPYT

SEQ ID NO: 35887 - protein, 447 aa, Artificial Sequence; identical to SEQ ID NO: 17235
  Description of Artificial Sequence: Synthetic polypeptide
  XENP022719 2A11_H1_L2.50_Fab-1G6_L1.194_H1.279_scFv Fab-Fc Heavy Chain

SEQ ID NO: 35888 - protein, 118 aa, Artificial Sequence; identical to SEQ ID NO: 17236
  Description of Artificial Sequence: Synthetic polypeptide
  VH of XENP022719

SEQ ID NO: 35889 - protein, 5 aa, Artificial Sequence
  Description of Artificial Sequence: Synthetic peptide
  XENP022719 vhCDR1
DYYMH

SEQ ID NO: 35890 - protein, 17 aa, Artificial Sequence
  Description of Artificial Sequence: Synthetic peptide
  XENP022719 vhCDR2
WIDPENGDTEYAPKFQG

SEQ ID NO: 35891 - protein, 9 aa, Artificial Sequence
  Description of Artificial Sequence: Synthetic peptide
  XENP022719 vhCDR3
RGVRQALDY

SEQ ID NO: 35892 - protein, 480 aa, Artificial Sequence; identical to SEQ ID NO: 23221
  Description of Artificial Sequence: Synthetic polypeptide
  XENP022719 2A11_H1_L2.50_Fab-1G6_L1.194_H1.279_scFv scFv-Fc Heavy Chain

SEQ ID NO: 35893 - protein, 107 aa, Artificial Sequence; identical to SEQ ID NO: 10999
  Description of Artificial Sequence: Synthetic polypeptide
  VH of XENP022719

SEQ ID NO: 35894 - protein, 122 aa, Artificial Sequence; identical to SEQ ID NO: 10908
  Description of Artificial Sequence: Synthetic polypeptide
  VL of XENP022719

SEQ ID NO: 35895 - protein, 231 aa, Artificial Sequence; identical to SEQ ID NO: 21532
  Description of Artificial Sequence: Synthetic polypeptide
  Fc chain of XENP022719

SEQ ID NO: 35896 - protein, 11 aa, Artificial Sequence
  Description of Artificial Sequence: Synthetic peptide
  XENP022719 vhCDR1
RASQSVGNDVA

SEQ ID NO: 35897 - protein, 7 aa, Artificial Sequence
  Description of Artificial Sequence: Synthetic peptide
  XENP022719 vhCDR2
YASHRYT

SEQ ID NO: 35898 - protein, 9 aa, Artificial Sequence
  Description of Artificial Sequence: Synthetic peptide
  XENP022719 vhCDR3
QQDFSSPRT

SEQ ID NO: 35899 - protein, 5 aa, Artificial Sequence
  Description of Artificial Sequence: Synthetic peptide
  XENP022719 vlCDR1
NYWMN

SEQ ID NO: 35900 - protein, 19 aa, Artificial Sequence
  Description of Artificial Sequence: Synthetic peptide
  XENP022719 vlCDR2
EIRLYSNNYATHYAESVKG

SEQ ID NO: 35901 - protein, 11 aa, Artificial Sequence
  Description of Artificial Sequence: Synthetic peptide
  XENP022719 vlCDR3
YYGNYGGYFDV

SEQ ID NO: 35902 - protein, 214 aa, Artificial Sequence; identical to SEQ ID NO: 22059
  Description of Artificial Sequence: Synthetic polypeptide
  XENP022719 2A11_H1_L2.50_Fab-1G6_L1.194_H1.279_scFv Light Chain

SEQ ID NO: 35903 - protein, 107 aa, Artificial Sequence; identical to SEQ ID NO: 22060
  Description of Artificial Sequence: Synthetic polypeptide
  VL of XENP022719

SEQ ID NO: 35904 - protein, 11 aa, Artificial Sequence
  Description of Artificial Sequence: Synthetic peptide
  XENP022719 vlCDR1
QASQDIGNYLN

SEQ ID NO: 35905 - protein, 7 aa, Artificial Sequence
  Description of Artificial Sequence: Synthetic peptide
  XENP022719 vlCDR2
YTSYLHS

SEQ ID NO: 35906 - protein, 9 aa, Artificial Sequence
  Description of Artificial Sequence: Synthetic peptide
  XENP022719 vlCDR3
QQGNTLPYT

SEQ ID NO: 35907 - protein, 447 aa, Artificial Sequence; identical to SEQ ID NO: 17235
  Description of Artificial Sequence: Synthetic polypeptide
  XENP022720 2A11_H1_L2.113_Fab-1G6_L1.194_H1.279_scFv Fab-Fc Heavy Chain

SEQ ID NO: 35908 - protein, 118 aa, Artificial Sequence; identical to SEQ ID NO: 17236
  Description of Artificial Sequence: Synthetic polypeptide
  VH of XENP022720

SEQ ID NO: 35909 - protein, 5 aa, Artificial Sequence
  Description of Artificial Sequence: Synthetic peptide
  XENP022720 vhCDR1
DYYMH

SEQ ID NO: 35910 - protein, 17 aa, Artificial Sequence
  Description of Artificial Sequence: Synthetic peptide
  XENP022720 vhCDR2
WIDPENGDTEYAPKFQG

SEQ ID NO: 35911 - protein, 9 aa, Artificial Sequence
  Description of Artificial Sequence: Synthetic peptide
  XENP022720 vhCDR3
RGVRQALDY

SEQ ID NO: 35912 - protein, 480 aa, Artificial Sequence; identical to SEQ ID NO: 23221
  Description of Artificial Sequence: Synthetic polypeptide
  XENP022720 2A11_H1_L2.113_Fab-1G6_L1.194_H1.279_scFv scFv-Fc Heavy Chain

SEQ ID NO: 35913 - protein, 107 aa, Artificial Sequence; identical to SEQ ID NO: 10999
  Description of Artificial Sequence: Synthetic polypeptide
  VH of XENP022720

SEQ ID NO: 35914 - protein, 122 aa, Artificial Sequence; identical to SEQ ID NO: 10908
  Description of Artificial Sequence: Synthetic polypeptide
  VL of XENP022720

SEQ ID NO: 35915 - protein, 231 aa, Artificial Sequence; identical to SEQ ID NO: 21532
  Description of Artificial Sequence: Synthetic polypeptide
  Fc chain of XENP022720

SEQ ID NO: 35916 - protein, 11 aa, Artificial Sequence
  Description of Artificial Sequence: Synthetic peptide
  XENP022720 vhCDR1
RASQSVGNDVA

SEQ ID NO: 35917 - protein, 7 aa, Artificial Sequence
  Description of Artificial Sequence: Synthetic peptide
  XENP022720 vhCDR2
YASHRYT

SEQ ID NO: 35918 - protein, 9 aa, Artificial Sequence
  Description of Artificial Sequence: Synthetic peptide
  XENP022720 vhCDR3
QQDFSSPRT

SEQ ID NO: 35919 - protein, 5 aa, Artificial Sequence
  Description of Artificial Sequence: Synthetic peptide
  XENP022720 vlCDR1
NYWMN

SEQ ID NO: 35920 - protein, 19 aa, Artificial Sequence
  Description of Artificial Sequence: Synthetic peptide
  XENP022720 vlCDR2
EIRLYSNNYATHYAESVKG

SEQ ID NO: 35921 - protein, 11 aa, Artificial Sequence
  Description of Artificial Sequence: Synthetic peptide
  XENP022720 vlCDR3
YYGNYGGYFDV

SEQ ID NO: 35922 - protein, 214 aa, Artificial Sequence; identical to SEQ ID NO: 22079
  Description of Artificial Sequence: Synthetic polypeptide
  XENP022720 2A11_H1_L2.113_Fab-1G6_L1.194_H1.279_scFv Light Chain

SEQ ID NO: 35923 - protein, 107 aa, Artificial Sequence; identical to SEQ ID NO: 22080
  Description of Artificial Sequence: Synthetic polypeptide
  VL of XENP022720

SEQ ID NO: 35924 - protein, 11 aa, Artificial Sequence
  Description of Artificial Sequence: Synthetic peptide
  XENP022720 vlCDR1
QASQDIGNYLN

SEQ ID NO: 35925 - protein, 7 aa, Artificial Sequence
  Description of Artificial Sequence: Synthetic peptide
  XENP022720 vlCDR2
FTSYLHS

SEQ ID NO: 35926 - protein, 9 aa, Artificial Sequence
  Description of Artificial Sequence: Synthetic peptide
  XENP022720 vlCDR3
QQGNTLPYT

SEQ ID NO: 35927 - protein, 450 aa, Artificial Sequence; identical to SEQ ID NO: 35607
  Description of Artificial Sequence: Synthetic polypeptide
  XENP022847 7G8_H3.30_L1.34_Fab-1G6_L1.194_H1.279_scFv Fab-Fc Heavy Chain

SEQ ID NO: 35928 - protein, 121 aa, Artificial Sequence; identical to SEQ ID NO: 22485
  Description of Artificial Sequence: Synthetic polypeptide
  VH of XENP022847

SEQ ID NO: 35929 - protein, 5 aa, Artificial Sequence
  Description of Artificial Sequence: Synthetic peptide
  XENP022847 vhCDR1
DAWMS

SEQ ID NO: 35930 - protein, 19 aa, Artificial Sequence
  Description of Artificial Sequence: Synthetic peptide
  XENP022847 vhCDR2
EISTKANNHATYYAESVKG

SEQ ID NO: 35931 - protein, 10 aa, Artificial Sequence
  Description of Artificial Sequence: Synthetic peptide
  XENP022847 vhCDR3
LATWDWYFDV

SEQ ID NO: 35932 - protein, 480 aa, Artificial Sequence; identical to SEQ ID NO: 23581
  Description of Artificial Sequence: Synthetic polypeptide
  XENP022847 7G8_H3.30_L1.34_Fab-1G6_L1.194_H1.279_scFv scFv-Fc Heavy Chain

SEQ ID NO: 35933 - protein, 107 aa, Artificial Sequence; identical to SEQ ID NO: 10999
  Description of Artificial Sequence: Synthetic polypeptide
  VH of XENP022847

SEQ ID NO: 35934 - protein, 122 aa, Artificial Sequence; identical to SEQ ID NO: 10908
  Description of Artificial Sequence: Synthetic polypeptide
  VL of XENP022847

SEQ ID NO: 35935 - protein, 231 aa, Artificial Sequence; identical to SEQ ID NO: 21572
  Description of Artificial Sequence: Synthetic polypeptide
  Fc chain of XENP022847

SEQ ID NO: 35936 - protein, 11 aa, Artificial Sequence
  Description of Artificial Sequence: Synthetic peptide
  XENP022847 vhCDR1
RASQSVGNDVA

SEQ ID NO: 35937 - protein, 7 aa, Artificial Sequence
  Description of Artificial Sequence: Synthetic peptide
  XENP022847 vhCDR2
YASHRYT

SEQ ID NO: 35938 - protein, 9 aa, Artificial Sequence
  Description of Artificial Sequence: Synthetic peptide
  XENP022847 vhCDR3
QQDFSSPRT

SEQ ID NO: 35939 - protein, 5 aa, Artificial Sequence
  Description of Artificial Sequence: Synthetic peptide
  XENP022847 vlCDR1
NYWMN

SEQ ID NO: 35940 - protein, 19 aa, Artificial Sequence
  Description of Artificial Sequence: Synthetic peptide
  XENP022847 vlCDR2
EIRLYSNNYATHYAESVKG

SEQ ID NO: 35941 - protein, 11 aa, Artificial Sequence
  Description of Artificial Sequence: Synthetic peptide
  XENP022847 vlCDR3
YYGNYGGYFDV

SEQ ID NO: 35942 - protein, 218 aa, Artificial Sequence; identical to SEQ ID NO: 22599
  Description of Artificial Sequence: Synthetic polypeptide
  XENP022847 7G8_H3.30_L1.34_Fab-1G6_L1.194_H1.279_scFv Light Chain

SEQ ID NO: 35943 - protein, 111 aa, Artificial Sequence; identical to SEQ ID NO: 22600
  Description of Artificial Sequence: Synthetic polypeptide
  VL of XENP022847

SEQ ID NO: 35944 - protein, 15 aa, Artificial Sequence
  Description of Artificial Sequence: Synthetic peptide
  XENP022847 vlCDR1
RASQSVDYDGDSYMN

SEQ ID NO: 35945 - protein, 7 aa, Artificial Sequence
  Description of Artificial Sequence: Synthetic peptide
  XENP022847 vlCDR2
AASELES

SEQ ID NO: 35946 - protein, 9 aa, Artificial Sequence
  Description of Artificial Sequence: Synthetic peptide
  XENP022847 vlCDR3
QQSNEDPFT

SEQ ID NO: 35947 - protein, 450 aa, Artificial Sequence; identical to SEQ ID NO: 35607
  Description of Artificial Sequence: Synthetic polypeptide
  XENP022848 7G8_H3.30_L1.36_Fab-1G6_L1.194_H1.279_scFv Fab-Fc Heavy Chain

SEQ ID NO: 35948 - protein, 121 aa, Artificial Sequence; identical to SEQ ID NO: 22485
  Description of Artificial Sequence: Synthetic polypeptide
  VH of XENP022848

SEQ ID NO: 35949 - protein, 5 aa, Artificial Sequence
  Description of Artificial Sequence: Synthetic peptide
  XENP022848 vhCDR1
DAWMS

SEQ ID NO: 35950 - protein, 19 aa, Artificial Sequence
  Description of Artificial Sequence: Synthetic peptide
  XENP022848 vhCDR2
EISTKANNHATYYAESVKG

SEQ ID NO: 35951 - protein, 10 aa, Artificial Sequence
  Description of Artificial Sequence: Synthetic peptide
  XENP022848 vhCDR3
LATWDWYFDV

SEQ ID NO: 35952 - protein, 480 aa, Artificial Sequence; identical to SEQ ID NO: 23581
  Description of Artificial Sequence: Synthetic polypeptide
  XENP022848 7G8_H3.30_L1.36_Fab-1G6_L1.194_H1.279_scFv scFv-Fc Heavy Chain

SEQ ID NO: 35953 - protein, 107 aa, Artificial Sequence; identical to SEQ ID NO: 10999
  Description of Artificial Sequence: Synthetic polypeptide
  VH of XENP022848

SEQ ID NO: 35954 - protein, 122 aa, Artificial Sequence; identical to SEQ ID NO: 10908
  Description of Artificial Sequence: Synthetic polypeptide
  VL of XENP022848

SEQ ID NO: 35955 - protein, 231 aa, Artificial Sequence; identical to SEQ ID NO: 21572
  Description of Artificial Sequence: Synthetic polypeptide
  Fc chain of XENP022848

SEQ ID NO: 35956 - protein, 11 aa, Artificial Sequence
  Description of Artificial Sequence: Synthetic peptide
  XENP022848 vhCDR1
RASQSVGNDVA

SEQ ID NO: 35957 - protein, 7 aa, Artificial Sequence
  Description of Artificial Sequence: Synthetic peptide
  XENP022848 vhCDR2
YASHRYT

SEQ ID NO: 35958 - protein, 9 aa, Artificial Sequence
  Description of Artificial Sequence: Synthetic peptide
  XENP022848 vhCDR3
QQDFSSPRT

SEQ ID NO: 35959 - protein, 5 aa, Artificial Sequence
  Description of Artificial Sequence: Synthetic peptide
  XENP022848 vlCDR1
NYWMN

SEQ ID NO: 35960 - protein, 19 aa, Artificial Sequence
  Description of Artificial Sequence: Synthetic peptide
  XENP022848 vlCDR2
EIRLYSNNYATHYAESVKG

SEQ ID NO: 35961 - protein, 11 aa, Artificial Sequence
  Description of Artificial Sequence: Synthetic peptide
  XENP022848 vlCDR3
YYGNYGGYFDV

SEQ ID NO: 35962 - protein, 218 aa, Artificial Sequence; identical to SEQ ID NO: 22619
  Description of Artificial Sequence: Synthetic polypeptide
  XENP022848 7G8_H3.30_L1.36_Fab-1G6_L1.194_H1.279_scFv Light Chain

SEQ ID NO: 35963 - protein, 111 aa, Artificial Sequence; identical to SEQ ID NO: 22620
  Description of Artificial Sequence: Synthetic polypeptide
  VL of XENP022848

SEQ ID NO: 35964 - protein, 15 aa, Artificial Sequence
  Description of Artificial Sequence: Synthetic peptide
  XENP022848 vlCDR1
RASQSVDHDGDSYMN

SEQ ID NO: 35965 - protein, 7 aa, Artificial Sequence
  Description of Artificial Sequence: Synthetic peptide
  XENP022848 vlCDR2
AASELES

SEQ ID NO: 35966 - protein, 9 aa, Artificial Sequence
  Description of Artificial Sequence: Synthetic peptide
  XENP022848 vlCDR3
QQSNEDPFT

SEQ ID NO: 35967 - protein, 447 aa, Artificial Sequence; identical to SEQ ID NO: 35647
  Description of Artificial Sequence: Synthetic polypeptide
  XENP022849 2A11_H1.144_L2.142_Fab-1G6_L1.194_H1.279_scFv Fab-Fc Heavy Chain

SEQ ID NO: 35968 - protein, 118 aa, Artificial Sequence; identical to SEQ ID NO: 22085
  Description of Artificial Sequence: Synthetic polypeptide
  VH of XENP022849

SEQ ID NO: 35969 - protein, 5 aa, Artificial Sequence
  Description of Artificial Sequence: Synthetic peptide
  XENP022849 vhCDR1
DYFMH

SEQ ID NO: 35970 - protein, 17 aa, Artificial Sequence
  Description of Artificial Sequence: Synthetic peptide
  XENP022849 vhCDR2
WIDPELGDTEYAPKFQG

SEQ ID NO: 35971 - protein, 9 aa, Artificial Sequence
  Description of Artificial Sequence: Synthetic peptide
  XENP022849 vhCDR3
RGVYQALDY

SEQ ID NO: 35972 - protein, 480 aa, Artificial Sequence; identical to SEQ ID NO: 23581
  Description of Artificial Sequence: Synthetic polypeptide
  XENP022849 2A11_H1.144_L2.142_Fab-1G6_L1.194_H1.279_scFv scFv-Fc Heavy Chain

SEQ ID NO: 35973 - protein, 107 aa, Artificial Sequence; identical to SEQ ID NO: 10999
  Description of Artificial Sequence: Synthetic polypeptide
  VH of XENP022849

SEQ ID NO: 35974 - protein, 122 aa, Artificial Sequence; identical to SEQ ID NO: 10908
  Description of Artificial Sequence: Synthetic polypeptide
  VL of XENP022849

SEQ ID NO: 35975 - protein, 231 aa, Artificial Sequence; identical to SEQ ID NO: 21572
  Description of Artificial Sequence: Synthetic polypeptide
  Fc chain of XENP022849

SEQ ID NO: 35976 - protein, 11 aa, Artificial Sequence
  Description of Artificial Sequence: Synthetic peptide
  XENP022849 vhCDR1
RASQSVGNDVA

SEQ ID NO: 35977 - protein, 7 aa, Artificial Sequence
  Description of Artificial Sequence: Synthetic peptide
  XENP022849 vhCDR2
YASHRYT

SEQ ID NO: 35978 - protein, 9 aa, Artificial Sequence
  Description of Artificial Sequence: Synthetic peptide
  XENP022849 vhCDR3
QQDFSSPRT

SEQ ID NO: 35979 - protein, 5 aa, Artificial Sequence
  Description of Artificial Sequence: Synthetic peptide
  XENP022849 vlCDR1
NYWMN

SEQ ID NO: 35980 - protein, 19 aa, Artificial Sequence
  Description of Artificial Sequence: Synthetic peptide
  XENP022849 vlCDR2
EIRLYSNNYATHYAESVKG

SEQ ID NO: 35981 - protein, 11 aa, Artificial Sequence
  Description of Artificial Sequence: Synthetic peptide
  XENP022849 vlCDR3
YYGNYGGYFDV

SEQ ID NO: 35982 - protein, 214 aa, Artificial Sequence; identical to SEQ ID NO: 22279
  Description of Artificial Sequence: Synthetic polypeptide
  XENP022849 2A11_H1.144_L2.142_Fab-1G6_L1.194_H1.279_scFv Light Chain

SEQ ID NO: 35983 - protein, 107 aa, Artificial Sequence; identical to SEQ ID NO: 22280
  Description of Artificial Sequence: Synthetic polypeptide
  VL of XENP022849

SEQ ID NO: 35984 - protein, 11 aa, Artificial Sequence
  Description of Artificial Sequence: Synthetic peptide
  XENP022849 vlCDR1
QASQDIGNYLN

SEQ ID NO: 35985 - protein, 7 aa, Artificial Sequence
  Description of Artificial Sequence: Synthetic peptide
  XENP022849 vlCDR2
FTSYLHS

SEQ ID NO: 35986 - protein, 9 aa, Artificial Sequence
  Description of Artificial Sequence: Synthetic peptide
  XENP022849 vlCDR3
QQGNTLPYT

SEQ ID NO: 35987 - protein, 447 aa, Artificial Sequence; identical to SEQ ID NO: 35647
  Description of Artificial Sequence: Synthetic polypeptide
  XENP022850 2A11_H1.144_L2.113_Fab-1G6_L1.194_H1.279_scFv Fab -Fc Heavy Chain

SEQ ID NO: 35988 - protein, 118 aa, Artificial Sequence; identical to SEQ ID NO: 22085
  Description of Artificial Sequence: Synthetic polypeptide
  VH of XENP022850

SEQ ID NO: 35989 - protein, 5 aa, Artificial Sequence
  Description of Artificial Sequence: Synthetic peptide
  XENP022850 vhCDR1
DYFMH

SEQ ID NO: 35990 - protein, 17 aa, Artificial Sequence
  Description of Artificial Sequence: Synthetic peptide
  XENP022850 vhCDR2
WIDPELGDTEYAPKFQG

SEQ ID NO: 35991 - protein, 9 aa, Artificial Sequence
  Description of Artificial Sequence: Synthetic peptide
  XENP022850 vhCDR3
RGVYQALDY

SEQ ID NO: 35992 - protein, 480 aa, Artificial Sequence; identical to SEQ ID NO: 23581
  Description of Artificial Sequence: Synthetic polypeptide
  XENP022850 2A11_H1.144_L2.113_Fab-1G6_L1.194_H1.279_scFv scFv -Fc Heavy Chain

SEQ ID NO: 35993 - protein, 107 aa, Artificial Sequence; identical to SEQ ID NO: 10999
  Description of Artificial Sequence: Synthetic polypeptide
  VH of XENP022850

SEQ ID NO: 35994 - protein, 122 aa, Artificial Sequence; identical to SEQ ID NO: 10908
  Description of Artificial Sequence: Synthetic polypeptide
  VL of XENP022850

SEQ ID NO: 35995 - protein, 231 aa, Artificial Sequence; identical to SEQ ID NO: 21572
  Description of Artificial Sequence: Synthetic polypeptide
  Fc chain of XENP022850

SEQ ID NO: 35996 - protein, 11 aa, Artificial Sequence
  Description of Artificial Sequence: Synthetic peptide
  XENP022850 vhCDR1
RASQSVGNDVA

SEQ ID NO: 35997 - protein, 7 aa, Artificial Sequence
  Description of Artificial Sequence: Synthetic peptide
  XENP022850 vhCDR2
YASHRYT

SEQ ID NO: 35998 - protein, 9 aa, Artificial Sequence
  Description of Artificial Sequence: Synthetic peptide
  XENP022850 vhCDR3
QQDFSSPRT

SEQ ID NO: 35999 - protein, 5 aa, Artificial Sequence
  Description of Artificial Sequence: Synthetic peptide
  XENP022850 vlCDR1
NYWMN

SEQ ID NO: 36000 - protein, 19 aa, Artificial Sequence
  Description of Artificial Sequence: Synthetic peptide
  XENP022850 vlCDR2
EIRLYSNNYATHYAESVKG

SEQ ID NO: 36001 - protein, 11 aa, Artificial Sequence
  Description of Artificial Sequence: Synthetic peptide
  XENP022850 vlCDR3
YYGNYGGYFDV

SEQ ID NO: 36002 - protein, 214 aa, Artificial Sequence; identical to SEQ ID NO: 22079
  Description of Artificial Sequence: Synthetic polypeptide
  XENP022850 2A11_H1.144_L2.113_Fab-1G6_L1.194_H1.279_scFv Light Chain

SEQ ID NO: 36003 - protein, 107 aa, Artificial Sequence; identical to SEQ ID NO: 22080
  Description of Artificial Sequence: Synthetic polypeptide
  VL of XENP022850

SEQ ID NO: 36004 - protein, 11 aa, Artificial Sequence
  Description of Artificial Sequence: Synthetic peptide
  XENP022850 vlCDR1
QASQDIGNYLN

SEQ ID NO: 36005 - protein, 7 aa, Artificial Sequence
  Description of Artificial Sequence: Synthetic peptide
  XENP022850 vlCDR2
FTSYLHS

SEQ ID NO: 36006 - protein, 9 aa, Artificial Sequence
  Description of Artificial Sequence: Synthetic peptide
  XENP022850 vlCDR3
QQGNTLPYT

SEQ ID NO: 36007 - protein, 447 aa, Artificial Sequence; identical to SEQ ID NO: 35707
  Description of Artificial Sequence: Synthetic polypeptide
  XENP022851 2A11_H1.125_L2.126_Fab-1G6_L1.194_H1.279_scFv Fab-Fc Heavy Chain

SEQ ID NO: 36008 - protein, 118 aa, Artificial Sequence; identical to SEQ ID NO: 22065
  Description of Artificial Sequence: Synthetic polypeptide
  VH of XENP022851

SEQ ID NO: 36009 - protein, 5 aa, Artificial Sequence
  Description of Artificial Sequence: Synthetic peptide
  XENP022851 vhCDR1
HYFMH

SEQ ID NO: 36010 - protein, 17 aa, Artificial Sequence
  Description of Artificial Sequence: Synthetic peptide
  XENP022851 vhCDR2
WIDPYLGDTEYAPKFQG

SEQ ID NO: 36011 - protein, 9 aa, Artificial Sequence
  Description of Artificial Sequence: Synthetic peptide
  XENP022851 vhCDR3
RGVYQALDY

SEQ ID NO: 36012 - protein, 480 aa, Artificial Sequence; identical to SEQ ID NO: 23581
  Description of Artificial Sequence: Synthetic polypeptide
  XENP022851 2A11_H1.125_L2.126_Fab-1G6_L1.194_H1.279_scFv scFv-Fc Heavy Chain

SEQ ID NO: 36013 - protein, 107 aa, Artificial Sequence; identical to SEQ ID NO: 10999
  Description of Artificial Sequence: Synthetic polypeptide
  VH of XENP022851

SEQ ID NO: 36014 - protein, 122 aa, Artificial Sequence; identical to SEQ ID NO: 10908
  Description of Artificial Sequence: Synthetic polypeptide
  VL of XENP022851

SEQ ID NO: 36015 - protein, 231 aa, Artificial Sequence; identical to SEQ ID NO: 21572
  Description of Artificial Sequence: Synthetic polypeptide
  Fc chain of XENP022851

SEQ ID NO: 36016 - protein, 11 aa, Artificial Sequence
  Description of Artificial Sequence: Synthetic peptide
  XENP022851 vhCDR1
RASQSVGNDVA

SEQ ID NO: 36017 - protein, 7 aa, Artificial Sequence
  Description of Artificial Sequence: Synthetic peptide
  XENP022851 vhCDR2
YASHRYT

SEQ ID NO: 36018 - protein, 9 aa, Artificial Sequence
  Description of Artificial Sequence: Synthetic peptide
  XENP022851 vhCDR3
QQDFSSPRT

SEQ ID NO: 36019 - protein, 5 aa, Artificial Sequence
  Description of Artificial Sequence: Synthetic peptide
  XENP022851 vlCDR1
NYWMN

SEQ ID NO: 36020 - protein, 19 aa, Artificial Sequence
  Description of Artificial Sequence: Synthetic peptide
  XENP022851 vlCDR2
EIRLYSNNYATHYAESVKG

SEQ ID NO: 36021 - protein, 11 aa, Artificial Sequence
  Description of Artificial Sequence: Synthetic peptide
  XENP022851 vlCDR3
YYGNYGGYFDV

SEQ ID NO: 36022 - protein, 214 aa, Artificial Sequence; identical to SEQ ID NO: 22259
  Description of Artificial Sequence: Synthetic polypeptide
  XENP022851 2A11_H1.125_L2.126_Fab-1G6_L1.194_H1.279_scFv Light Chain

SEQ ID NO: 36023 - protein, 107 aa, Artificial Sequence; identical to SEQ ID NO: 22260
  Description of Artificial Sequence: Synthetic polypeptide
  VL of XENP022851

SEQ ID NO: 36024 - protein, 11 aa, Artificial Sequence
  Description of Artificial Sequence: Synthetic peptide
  XENP022851 vlCDR1
QASQDIGNYLN

SEQ ID NO: 36025 - protein, 7 aa, Artificial Sequence
  Description of Artificial Sequence: Synthetic peptide
  XENP022851 vlCDR2
FTSYLHS

SEQ ID NO: 36026 - protein, 9 aa, Artificial Sequence
  Description of Artificial Sequence: Synthetic peptide
  XENP022851 vlCDR3
QEGNTLPYT

SEQ ID NO: 36027 - protein, 447 aa, Artificial Sequence; identical to SEQ ID NO: 21564
  Description of Artificial Sequence: Synthetic polypeptide
  XENP022852 2A11_H1_L2.113_Fab-1G6_L1.194_H1.279_scFv Fab-Fc Heavy Chain

SEQ ID NO: 36028 - protein, 118 aa, Artificial Sequence; identical to SEQ ID NO: 17236
  Description of Artificial Sequence: Synthetic polypeptide
  VH of XENP022852

SEQ ID NO: 36029 - protein, 5 aa, Artificial Sequence
  Description of Artificial Sequence: Synthetic peptide
  XENP022852 vhCDR1
DYYMH

SEQ ID NO: 36030 - protein, 17 aa, Artificial Sequence
  Description of Artificial Sequence: Synthetic peptide
  XENP022852 vhCDR2
WIDPENGDTEYAPKFQG

SEQ ID NO: 36031 - protein, 9 aa, Artificial Sequence
  Description of Artificial Sequence: Synthetic peptide
  XENP022852 vhCDR3
RGVRQALDY

SEQ ID NO: 36032 - protein, 480 aa, Artificial Sequence; identical to SEQ ID NO: 23581
  Description of Artificial Sequence: Synthetic polypeptide
  XENP022852 2A11_H1_L2.113_Fab-1G6_L1.194_H1.279_scFv scFv-Fc Heavy Chain

SEQ ID NO: 36033 - protein, 107 aa, Artificial Sequence; identical to SEQ ID NO: 10999
  Description of Artificial Sequence: Synthetic polypeptide
  VH of XENP022852

SEQ ID NO: 36034 - protein, 122 aa, Artificial Sequence; identical to SEQ ID NO: 10908
  Description of Artificial Sequence: Synthetic polypeptide
  VL of XENP022852

SEQ ID NO: 36035 - protein, 231 aa, Artificial Sequence; identical to SEQ ID NO: 21572
  Description of Artificial Sequence: Synthetic polypeptide
  Fc chain of XENP022852

SEQ ID NO: 36036 - protein, 11 aa, Artificial Sequence
  Description of Artificial Sequence: Synthetic peptide
  XENP022852 vhCDR1
RASQSVGNDVA

SEQ ID NO: 36037 - protein, 7 aa, Artificial Sequence
  Description of Artificial Sequence: Synthetic peptide
  XENP022852 vhCDR2
YASHRYT

SEQ ID NO: 36038 - protein, 9 aa, Artificial Sequence
  Description of Artificial Sequence: Synthetic peptide
  XENP022852 vhCDR3
QQDFSSPRT

SEQ ID NO: 36039 - protein, 5 aa, Artificial Sequence
  Description of Artificial Sequence: Synthetic peptide
  XENP022852 vlCDR1
NYWMN

SEQ ID NO: 36040 - protein, 19 aa, Artificial Sequence
  Description of Artificial Sequence: Synthetic peptide
  XENP022852 vlCDR2
EIRLYSNNYATHYAESVKG

SEQ ID NO: 36041 - protein, 11 aa, Artificial Sequence
  Description of Artificial Sequence: Synthetic peptide
  XENP022852 vlCDR3
YYGNYGGYFDV

SEQ ID NO: 36042 - protein, 214 aa, Artificial Sequence; identical to SEQ ID NO: 22079
  Description of Artificial Sequence: Synthetic polypeptide
  XENP022852 2A11_H1_L2.113_Fab-1G6_L1.194_H1.279_scFv Light Chain

SEQ ID NO: 36043 - protein, 107 aa, Artificial Sequence; identical to SEQ ID NO: 22080
  Description of Artificial Sequence: Synthetic polypeptide
  VL of XENP022852

SEQ ID NO: 36044 - protein, 11 aa, Artificial Sequence
  Description of Artificial Sequence: Synthetic peptide
  XENP022852 vlCDR1
QASQDIGNYLN

SEQ ID NO: 36045 - protein, 7 aa, Artificial Sequence
  Description of Artificial Sequence: Synthetic peptide
  XENP022852 vlCDR2
FTSYLHS

SEQ ID NO: 36046 - protein, 9 aa, Artificial Sequence
  Description of Artificial Sequence: Synthetic peptide
  XENP022852 vlCDR3
QQGNTLPYT

SEQ ID NO: 36047 - protein, 447 aa, Artificial Sequence; identical to SEQ ID NO: 17235
  Description of Artificial Sequence: Synthetic polypeptide
  XENP023349 2A11_H1L2_Fab-1C11_H3L3_scFv Fab-Fc Heavy Chain

SEQ ID NO: 36048 - protein, 118 aa, Artificial Sequence; identical to SEQ ID NO: 17236
  Description of Artificial Sequence: Synthetic polypeptide
  VH of XENP023349

SEQ ID NO: 36049 - protein, 5 aa, Artificial Sequence
  Description of Artificial Sequence: Synthetic peptide
  XENP023349 vhCDR1
DYYMH

SEQ ID NO: 36050 - protein, 17 aa, Artificial Sequence
  Description of Artificial Sequence: Synthetic peptide
  XENP023349 vhCDR2
WIDPENGDTEYAPKFQG

SEQ ID NO: 36051 - protein, 9 aa, Artificial Sequence
  Description of Artificial Sequence: Synthetic peptide
  XENP023349 vhCDR3
RGVRQALDY

SEQ ID NO: 36052 - protein, 480 aa, Artificial Sequence
  Description of Artificial Sequence: Synthetic polypeptide
  XENP023349 2A11_H1L2_Fab-1C11_H3L3_scFv scFv-Fc Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36053 - protein, 117 aa, Artificial Sequence; identical to SEQ ID NO: 33034
  Description of Artificial Sequence: Synthetic polypeptide
  VH of XENP023349

SEQ ID NO: 36054 - protein, 112 aa, Artificial Sequence; identical to SEQ ID NO: 33009
  Description of Artificial Sequence: Synthetic polypeptide
  VL of XENP023349

SEQ ID NO: 36055 - protein, 231 aa, Artificial Sequence; identical to SEQ ID NO: 21532
  Description of Artificial Sequence: Synthetic polypeptide
  Fc chain of XENP023349

SEQ ID NO: 36056 - protein, 5 aa, Artificial Sequence
  Description of Artificial Sequence: Synthetic peptide
  XENP023349 vhCDR1
HYGMN

SEQ ID NO: 36057 - protein, 17 aa, Artificial Sequence
  Description of Artificial Sequence: Synthetic peptide
  XENP023349 vhCDR2
WINTYTGEPTYADGFTG

SEQ ID NO: 36058 - protein, 8 aa, Artificial Sequence
  Description of Artificial Sequence: Synthetic peptide
  XENP023349 vhCDR3
DYYGSSPY

SEQ ID NO: 36059 - protein, 16 aa, Artificial Sequence
  Description of Artificial Sequence: Synthetic peptide
  XENP023349 vlCDR1
KSSQSIVHSNGNTYLE

SEQ ID NO: 36060 - protein, 7 aa, Artificial Sequence
  Description of Artificial Sequence: Synthetic peptide
  XENP023349 vlCDR2
KVSNRFS

SEQ ID NO: 36061 - protein, 9 aa, Artificial Sequence
  Description of Artificial Sequence: Synthetic peptide
  XENP023349 vlCDR3
FQGSHVPNT

SEQ ID NO: 36062 - protein, 214 aa, Artificial Sequence; identical to SEQ ID NO: 17250
  Description of Artificial Sequence: Synthetic polypeptide
  XENP023349 2A11_H1L2_Fab-1C11_H3L3_scFv Light Chain

SEQ ID NO: 36063 - protein, 107 aa, Artificial Sequence; identical to SEQ ID NO: 17251
  Description of Artificial Sequence: Synthetic polypeptide
  VL of XENP023349

SEQ ID NO: 36064 - protein, 11 aa, Artificial Sequence
  Description of Artificial Sequence: Synthetic peptide
  XENP023349 vlCDR1
QASQDIGNYLN

SEQ ID NO: 36065 - protein, 7 aa, Artificial Sequence
  Description of Artificial Sequence: Synthetic peptide
  XENP023349 vlCDR2
YTSRLHS

SEQ ID NO: 36066 - protein, 9 aa, Artificial Sequence
  Description of Artificial Sequence: Synthetic peptide
  XENP023349 vlCDR3
QQGNTLPYT

SEQ ID NO: 36067 - protein, 447 aa, Artificial Sequence; identical to SEQ ID NO: 22084
  Description of Artificial Sequence: Synthetic polypeptide
  XENP023350 2A11_H1.144_L2.142_Fab-1C11_H3L3_scFv Fab-Fc Heavy Chain

SEQ ID NO: 36068 - protein, 118 aa, Artificial Sequence; identical to SEQ ID NO: 22085
  Description of Artificial Sequence: Synthetic polypeptide
  VH of XENP023350

SEQ ID NO: 36069 - protein, 5 aa, Artificial Sequence
  Description of Artificial Sequence: Synthetic peptide
  XENP023350 vhCDR1
DYFMH

SEQ ID NO: 36070 - protein, 17 aa, Artificial Sequence
  Description of Artificial Sequence: Synthetic peptide
  XENP023350 vhCDR2
WIDPELGDTEYAPKFQG

SEQ ID NO: 36071 - protein, 9 aa, Artificial Sequence
  Description of Artificial Sequence: Synthetic peptide
  XENP023350 vhCDR3
RGVYQALDY

SEQ ID NO: 36072 - protein, 480 aa, Artificial Sequence; identical to SEQ ID NO: 36052
  Description of Artificial Sequence: Synthetic polypeptide
  XENP023350 2A11_H1.144_L2.142_Fab-1C11_H3L3_scFv scFv-Fc Heavy Chain

SEQ ID NO: 36073 - protein, 117 aa, Artificial Sequence; identical to SEQ ID NO: 33034
  Description of Artificial Sequence: Synthetic polypeptide
  VH of XENP023350

SEQ ID NO: 36074 - protein, 112 aa, Artificial Sequence; identical to SEQ ID NO: 33009
  Description of Artificial Sequence: Synthetic polypeptide
  VL of XENP023350

SEQ ID NO: 36075 - protein, 231 aa, Artificial Sequence; identical to SEQ ID NO: 21532
  Description of Artificial Sequence: Synthetic polypeptide
  Fc chain of XENP023350

SEQ ID NO: 36076 - protein, 5 aa, Artificial Sequence
  Description of Artificial Sequence: Synthetic peptide
  XENP023350 vhCDR1
HYGMN

SEQ ID NO: 36077 - protein, 17 aa, Artificial Sequence
  Description of Artificial Sequence: Synthetic peptide
  XENP023350 vhCDR2
WINTYTGEPTYADGFTG

SEQ ID NO: 36078 - protein, 8 aa, Artificial Sequence
  Description of Artificial Sequence: Synthetic peptide
  XENP023350 vhCDR3
DYYGSSPY

SEQ ID NO: 36079 - protein, 16 aa, Artificial Sequence
  Description of Artificial Sequence: Synthetic peptide
  XENP023350 vlCDR1
KSSQSIVHSNGNTYLE

SEQ ID NO: 36080 - protein, 7 aa, Artificial Sequence
  Description of Artificial Sequence: Synthetic peptide
  XENP023350 vlCDR2
KVSNRFS

SEQ ID NO: 36081 - protein, 9 aa, Artificial Sequence
  Description of Artificial Sequence: Synthetic peptide
  XENP023350 vlCDR3
FQGSHVPNT

SEQ ID NO: 36082 - protein, 214 aa, Artificial Sequence; identical to SEQ ID NO: 22279
  Description of Artificial Sequence: Synthetic polypeptide
  XENP023350 2A11_H1.144_L2.142_Fab-1C11_H3L3_scFv Light Chain

SEQ ID NO: 36083 - protein, 107 aa, Artificial Sequence; identical to SEQ ID NO: 22280
  Description of Artificial Sequence: Synthetic polypeptide
  VL of XENP023350

SEQ ID NO: 36084 - protein, 11 aa, Artificial Sequence
  Description of Artificial Sequence: Synthetic peptide
  XENP023350 vlCDR1
QASQDIGNYLN

SEQ ID NO: 36085 - protein, 7 aa, Artificial Sequence
  Description of Artificial Sequence: Synthetic peptide
  XENP023350 vlCDR2
FTSYLHS

SEQ ID NO: 36086 - protein, 9 aa, Artificial Sequence
  Description of Artificial Sequence: Synthetic peptide
  XENP023350 vlCDR3
QQGNTLPYT

SEQ ID NO: 36087 - protein, 447 aa, Artificial Sequence; identical to SEQ ID NO: 17235
  Description of Artificial Sequence: Synthetic polypeptide
  XENP023351 2A11_H1L2_Fab-2E9_H1L1_scFv Fab-Fc Heavy Chain

SEQ ID NO: 36088 - protein, 118 aa, Artificial Sequence; identical to SEQ ID NO: 17236
  Description of Artificial Sequence: Synthetic polypeptide
  VH of XENP023351

SEQ ID NO: 36089 - protein, 5 aa, Artificial Sequence
  Description of Artificial Sequence: Synthetic peptide
  XENP023351 vhCDR1
DYYMH

SEQ ID NO: 36090 - protein, 17 aa, Artificial Sequence
  Description of Artificial Sequence: Synthetic peptide
  XENP023351 vhCDR2
WIDPENGDTEYAPKFQG

SEQ ID NO: 36091 - protein, 9 aa, Artificial Sequence
  Description of Artificial Sequence: Synthetic peptide
  XENP023351 vhCDR3
RGVRQALDY

SEQ ID NO: 36092 - protein, 478 aa, Artificial Sequence
  Description of Artificial Sequence: Synthetic polypeptide
  XENP023351 2A11_H1L2_Fab-2E9_H1L1_scFv scFv-Fc Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSGKPGSGKPGSGKPGSGKPGSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36093 - protein, 120 aa, Artificial Sequence; identical to SEQ ID NO: 11412
  Description of Artificial Sequence: Synthetic polypeptide
  VH of XENP023351

SEQ ID NO: 36094 - protein, 107 aa, Artificial Sequence; identical to SEQ ID NO: 11413
  Description of Artificial Sequence: Synthetic polypeptide
  VL of XENP023351

SEQ ID NO: 36095 - protein, 231 aa, Artificial Sequence; identical to SEQ ID NO: 21532
  Description of Artificial Sequence: Synthetic polypeptide
  Fc chain of XENP023351

SEQ ID NO: 36096 - protein, 5 aa, Artificial Sequence
  Description of Artificial Sequence: Synthetic peptide
  XENP023351 vhCDR1
NYWLG

SEQ ID NO: 36097 - protein, 17 aa, Artificial Sequence
  Description of Artificial Sequence: Synthetic peptide
  XENP023351 vhCDR2
NFYPGSSNTYYNEKFQG

SEQ ID NO: 36098 - protein, 11 aa, Artificial Sequence
  Description of Artificial Sequence: Synthetic peptide
  XENP023351 vhCDR3
HYGTNYRYFDV

SEQ ID NO: 36099 - protein, 11 aa, Artificial Sequence
  Description of Artificial Sequence: Synthetic peptide
  XENP023351 vlCDR1
RASQSVSNDVA

SEQ ID NO: 36100 - protein, 7 aa, Artificial Sequence
  Description of Artificial Sequence: Synthetic peptide
  XENP023351 vlCDR2
YASNRYT

SEQ ID NO: 36101 - protein, 9 aa, Artificial Sequence
  Description of Artificial Sequence: Synthetic peptide
  XENP023351 vlCDR3
QQDYSSPYT

SEQ ID NO: 36102 - protein, 214 aa, Artificial Sequence; identical to SEQ ID NO: 17250
  Description of Artificial Sequence: Synthetic polypeptide
  XENP023351 2A11_H1L2_Fab-2E9_H1L1_scFv Light Chain

SEQ ID NO: 36103 - protein, 107 aa, Artificial Sequence; identical to SEQ ID NO: 17251
  Description of Artificial Sequence: Synthetic polypeptide
  VL of XENP023351

SEQ ID NO: 36104 - protein, 11 aa, Artificial Sequence
  Description of Artificial Sequence: Synthetic peptide
  XENP023351 vlCDR1
QASQDIGNYLN

SEQ ID NO: 36105 - protein, 7 aa, Artificial Sequence
  Description of Artificial Sequence: Synthetic peptide
  XENP023351 vlCDR2
YTSRLHS

SEQ ID NO: 36106 - protein, 9 aa, Artificial Sequence
  Description of Artificial Sequence: Synthetic peptide
  XENP023351 vlCDR3
QQGNTLPYT

SEQ ID NO: 36107 - protein, 447 aa, Artificial Sequence; identical to SEQ ID NO: 22084
  Description of Artificial Sequence: Synthetic polypeptide
  XENP023352 2A11_H1.144_L2.142_Fab-2E9_H1L1_scFv Fab-Fc Heavy Chain

SEQ ID NO: 36108 - protein, 118 aa, Artificial Sequence; identical to SEQ ID NO: 22085
  Description of Artificial Sequence: Synthetic polypeptide
  VH of XENP023352

SEQ ID NO: 36109 - protein, 5 aa, Artificial Sequence
  Description of Artificial Sequence: Synthetic peptide
  XENP023352 vhCDR1
DYFMH

SEQ ID NO: 36110 - protein, 17 aa, Artificial Sequence
  Description of Artificial Sequence: Synthetic peptide
  XENP023352 vhCDR2
WIDPELGDTEYAPKFQG

SEQ ID NO: 36111 - protein, 9 aa, Artificial Sequence
  Description of Artificial Sequence: Synthetic peptide
  XENP023352 vhCDR3
RGVYQALDY

SEQ ID NO: 36112 - protein, 458 aa, Artificial Sequence
  Description of Artificial Sequence: Synthetic polypeptide
  XENP023352 2A11_H1.144_L2.142_Fab-2E9_H1L1_scFv scFv-Fc Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36113 - protein, 120 aa, Artificial Sequence; identical to SEQ ID NO: 11412
  Description of Artificial Sequence: Synthetic polypeptide
  VH of XENP023352

SEQ ID NO: 36114 - protein, 107 aa, Artificial Sequence; identical to SEQ ID NO: 11413
  Description of Artificial Sequence: Synthetic polypeptide
  VL of XENP023352

SEQ ID NO: 36115 - protein, 231 aa, Artificial Sequence; identical to SEQ ID NO: 21532
  Description of Artificial Sequence: Synthetic polypeptide
  Fc chain of XENP023352

SEQ ID NO: 36116 - protein, 5 aa, Artificial Sequence
  Description of Artificial Sequence: Synthetic peptide
  XENP023352 vhCDR1
NYWLG

SEQ ID NO: 36117 - protein, 17 aa, Artificial Sequence
  Description of Artificial Sequence: Synthetic peptide
  XENP023352 vhCDR2
NFYPGSSNTYYNEKFQG

SEQ ID NO: 36118 - protein, 11 aa, Artificial Sequence
  Description of Artificial Sequence: Synthetic peptide
  XENP023352 vhCDR3
HYGTNYRYFDV

SEQ ID NO: 36119 - protein, 11 aa, Artificial Sequence
  Description of Artificial Sequence: Synthetic peptide
  XENP023352 vlCDR1
RASQSVSNDVA

SEQ ID NO: 36120 - protein, 7 aa, Artificial Sequence
  Description of Artificial Sequence: Synthetic peptide
  XENP023352 vlCDR2
YASNRYT

SEQ ID NO: 36121 - protein, 9 aa, Artificial Sequence
  Description of Artificial Sequence: Synthetic peptide
  XENP023352 vlCDR3
QQDYSSPYT

SEQ ID NO: 36122 - protein, 214 aa, Artificial Sequence; identical to SEQ ID NO: 22279
  Description of Artificial Sequence: Synthetic polypeptide
  XENP023352 2A11_H1.144_L2.142_Fab-2E9_H1L1_scFv Light Chain

SEQ ID NO: 36123 - protein, 107 aa, Artificial Sequence; identical to SEQ ID NO: 22280
  Description of Artificial Sequence: Synthetic polypeptide
  VL of XENP023352

SEQ ID NO: 36124 - protein, 11 aa, Artificial Sequence
  Description of Artificial Sequence: Synthetic peptide
  XENP023352 vlCDR1
QASQDIGNYLN

SEQ ID NO: 36125 - protein, 7 aa, Artificial Sequence
  Description of Artificial Sequence: Synthetic peptide
  XENP023352 vlCDR2
FTSYLHS

SEQ ID NO: 36126 - protein, 9 aa, Artificial Sequence
  Description of Artificial Sequence: Synthetic peptide
  XENP023352 vlCDR3
QQGNTLPYT

SEQ ID NO: 36127 - protein, 446 aa, Artificial Sequence
  Description of Artificial Sequence: Synthetic polypeptide
  XENP022856 1C11_H3L3_IgG1_PVA_/S267K/M428L/N434S Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 36128 - protein, 117 aa, Artificial Sequence; identical to SEQ ID NO: 33034
  Description of Artificial Sequence: Synthetic polypeptide
  VH of XENP022856

SEQ ID NO: 36129 - protein, 5 aa, Artificial Sequence
  Description of Artificial Sequence: Synthetic peptide
  XENP022856 vhCDR1
HYGMN

SEQ ID NO: 36130 - protein, 17 aa, Artificial Sequence
  Description of Artificial Sequence: Synthetic peptide
  XENP022856 vhCDR2
WINTYTGEPTYADGFTG

SEQ ID NO: 36131 - protein, 8 aa, Artificial Sequence
  Description of Artificial Sequence: Synthetic peptide
  XENP022856 vhCDR3
DYYGSSPY

SEQ ID NO: 36132 - protein, 219 aa, Artificial Sequence; identical to SEQ ID NO: 33008
  Description of Artificial Sequence: Synthetic polypeptide
  XENP022856 1C11_H3L3_IgG1_PVA_/S267K/M428L/N434S Light Chain

SEQ ID NO: 36133 - protein, 112 aa, Artificial Sequence; identical to SEQ ID NO: 33009
  Description of Artificial Sequence: Synthetic polypeptide
  VL of XENP022856

SEQ ID NO: 36134 - protein, 16 aa, Artificial Sequence
  Description of Artificial Sequence: Synthetic peptide
  XENP022856 vlCDR1
KSSQSIVHSNGNTYLE

SEQ ID NO: 36135 - protein, 7 aa, Artificial Sequence
  Description of Artificial Sequence: Synthetic peptide
  XENP022856 vlCDR2
KVSNRFS

SEQ ID NO: 36136 - protein, 9 aa, Artificial Sequence
  Description of Artificial Sequence: Synthetic peptide
  XENP022856 vlCDR3
FQGSHVPNT

SEQ ID NO: 36137 - protein, 449 aa, Artificial Sequence
  Description of Artificial Sequence: Synthetic polypeptide
  XENP022857 2E9_H1L1_IgG1_PVA_/S267K/M428L/N434S Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 36138 - protein, 120 aa, Artificial Sequence; identical to SEQ ID NO: 11412
  Description of Artificial Sequence: Synthetic polypeptide
  VH of XENP022857

SEQ ID NO: 36139 - protein, 5 aa, Artificial Sequence
  Description of Artificial Sequence: Synthetic peptide
  XENP022857 vhCDR1
NYWLG

SEQ ID NO: 36140 - protein, 17 aa, Artificial Sequence
  Description of Artificial Sequence: Synthetic peptide
  XENP022857 vhCDR2
NFYPGSSNTYYNEKFQG

SEQ ID NO: 36141 - protein, 11 aa, Artificial Sequence
  Description of Artificial Sequence: Synthetic peptide
  XENP022857 vhCDR3
HYGTNYRYFDV

SEQ ID NO: 36142 - protein, 214 aa, Artificial Sequence; identical to SEQ ID NO: 17080
  Description of Artificial Sequence: Synthetic polypeptide
  XENP022857 2E9_H1L1_IgG1_PVA_/S267K/M428L/N434S Light Chain

SEQ ID NO: 36143 - protein, 107 aa, Artificial Sequence; identical to SEQ ID NO: 11413
  Description of Artificial Sequence: Synthetic polypeptide
  VL of XENP022857

SEQ ID NO: 36144 - protein, 11 aa, Artificial Sequence
  Description of Artificial Sequence: Synthetic peptide
  XENP022857 vlCDR1
RASQSVSNDVA

SEQ ID NO: 36145 - protein, 7 aa, Artificial Sequence
  Description of Artificial Sequence: Synthetic peptide
  XENP022857 vlCDR2
YASNRYT

SEQ ID NO: 36146 - protein, 9 aa, Artificial Sequence
  Description of Artificial Sequence: Synthetic peptide
  XENP022857 vlCDR3
QQDYSSPYT

SEQ ID NO: 36147 - protein, 447 aa, Artificial Sequence
  Description of Artificial Sequence: Synthetic polypeptide
  XENP022858 9C6_H1.1_L1_Fab-1G6_L1.194_H1.279_scFv Fab-Fc Heavy Chain
QVQLKESGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 36148 - protein, 118 aa, Artificial Sequence; identical to SEQ ID NO: 21205
  Description of Artificial Sequence: Synthetic polypeptide
  VH of XENP022858

SEQ ID NO: 36149 - protein, 5 aa, Artificial Sequence
  Description of Artificial Sequence: Synthetic peptide
  XENP022858 vhCDR1
GYGVN

SEQ ID NO: 36150 - protein, 16 aa, Artificial Sequence
  Description of Artificial Sequence: Synthetic peptide
  XENP022858 vhCDR2
MIWIDGSTDYNSKFQG

SEQ ID NO: 36151 - protein, 10 aa, Artificial Sequence
  Description of Artificial Sequence: Synthetic peptide
  XENP022858 vhCDR3
DRPDGRAMDY

SEQ ID NO: 36152 - protein, 480 aa, Artificial Sequence; identical to SEQ ID NO: 23581
  Description of Artificial Sequence: Synthetic polypeptide
  XENP022858 9C6_H1.1_L1_Fab-1G6_L1.194_H1.279_scFv scFv-Fc Heavy Chain

SEQ ID NO: 36153 - protein, 107 aa, Artificial Sequence; identical to SEQ ID NO: 10999
  Description of Artificial Sequence: Synthetic polypeptide
  VH of XENP022858

SEQ ID NO: 36154 - protein, 122 aa, Artificial Sequence; identical to SEQ ID NO: 10908
  Description of Artificial Sequence: Synthetic polypeptide
  VL of XENP022858

SEQ ID NO: 36155 - protein, 231 aa, Artificial Sequence; identical to SEQ ID NO: 21572
  Description of Artificial Sequence: Synthetic polypeptide
  Fc chain of XENP022858

SEQ ID NO: 36156 - protein, 11 aa, Artificial Sequence
  Description of Artificial Sequence: Synthetic peptide
  XENP022858 vhCDR1
RASQSVGNDVA

SEQ ID NO: 36157 - protein, 7 aa, Artificial Sequence
  Description of Artificial Sequence: Synthetic peptide
  XENP022858 vhCDR2
YASHRYT

SEQ ID NO: 36158 - protein, 9 aa, Artificial Sequence
  Description of Artificial Sequence: Synthetic peptide
  XENP022858 vhCDR3
QQDFSSPRT

SEQ ID NO: 36159 - protein, 5 aa, Artificial Sequence
  Description of Artificial Sequence: Synthetic peptide
  XENP022858 vlCDR1
NYWMN

SEQ ID NO: 36160 - protein, 19 aa, Artificial Sequence
  Description of Artificial Sequence: Synthetic peptide
  XENP022858 vlCDR2
EIRLYSNNYATHYAESVKG

SEQ ID NO: 36161 - protein, 11 aa, Artificial Sequence
  Description of Artificial Sequence: Synthetic peptide
  XENP022858 vlCDR3
YYGNYGGYFDV

SEQ ID NO: 36162 - protein, 213 aa, Artificial Sequence; identical to SEQ ID NO: 21050
  Description of Artificial Sequence: Synthetic polypeptide
  XENP022858 9C6_H1.1_L1_Fab-1G6_L1.194_H1.279_scFv Light Chain

SEQ ID NO: 36163 - protein, 106 aa, Artificial Sequence; identical to SEQ ID NO: 21051
  Description of Artificial Sequence: Synthetic polypeptide
  VL of XENP022858

SEQ ID NO: 36164 - protein, 11 aa, Artificial Sequence
  Description of Artificial Sequence: Synthetic peptide
  XENP022858 vlCDR1
KASQSVSNDVA

SEQ ID NO: 36165 - protein, 7 aa, Artificial Sequence
  Description of Artificial Sequence: Synthetic peptide
  XENP022858 vlCDR2
YASNRYT

SEQ ID NO: 36166 - protein, 8 aa, Artificial Sequence
  Description of Artificial Sequence: Synthetic peptide
  XENP022858 vlCDR3
QQDYSSPT

SEQ ID NO: 36167 - protein, 446 aa, Artificial Sequence
  Description of Artificial Sequence: Synthetic polypeptide
  XENP022726 1C11_H1L3_Fab-[CTLA-4]_H3.23_L0.129_scFv Fab-Fc Heavy Chain
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 36168 - protein, 117 aa, Artificial Sequence; identical to SEQ ID NO: 33004
  Description of Artificial Sequence: Synthetic polypeptide
  VH of XENP022726

SEQ ID NO: 36169 - protein, 5 aa, Artificial Sequence
  Description of Artificial Sequence: Synthetic peptide
  XENP022726 vhCDR1
HYGMN

SEQ ID NO: 36170 - protein, 17 aa, Artificial Sequence
  Description of Artificial Sequence: Synthetic peptide
  XENP022726 vhCDR2
WINTYTGEPTYADKFQG

SEQ ID NO: 36171 - protein, 8 aa, Artificial Sequence
  Description of Artificial Sequence: Synthetic peptide
  XENP022726 vhCDR3
DYYGSSPY

SEQ ID NO: 36172 - protein, 477 aa, Artificial Sequence; identical to SEQ ID NO: 21669
  Description of Artificial Sequence: Synthetic polypeptide
  XENP022726 1C11_H1L3_Fab-[CTLA-4]_H3.23_L0.129_scFv scFv-Fc Heavy Chain

SEQ ID NO: 36173 - protein, 118 aa, Artificial Sequence; identical to SEQ ID NO: 2632
  Description of Artificial Sequence: Synthetic polypeptide
  VH of XENP022726

SEQ ID NO: 36174 - protein, 108 aa, Artificial Sequence; identical to SEQ ID NO: 2768
  Description of Artificial Sequence: Synthetic polypeptide
  VL of XENP022726

SEQ ID NO: 36175 - protein, 231 aa, Artificial Sequence; identical to SEQ ID NO: 21532
  Description of Artificial Sequence: Synthetic polypeptide
  Fc chain of XENP022726

SEQ ID NO: 36176 - protein, 5 aa, Artificial Sequence
  Description of Artificial Sequence: Synthetic peptide
  XENP022726 vhCDR1
SYTMH

SEQ ID NO: 36177 - protein, 17 aa, Artificial Sequence
  Description of Artificial Sequence: Synthetic peptide
  XENP022726 vhCDR2
FISYDGNYKYYADSVKG

SEQ ID NO: 36178 - protein, 9 aa, Artificial Sequence
  Description of Artificial Sequence: Synthetic peptide
  XENP022726 vhCDR3
GGHLGPFDL

SEQ ID NO: 36179 - protein, 12 aa, Artificial Sequence
  Description of Artificial Sequence: Synthetic peptide
  XENP022726 vlCDR1
RASQSVGSSYLA

SEQ ID NO: 36180 - protein, 7 aa, Artificial Sequence
  Description of Artificial Sequence: Synthetic peptide
  XENP022726 vlCDR2
GASSRAT

SEQ ID NO: 36181 - protein, 9 aa, Artificial Sequence
  Description of Artificial Sequence: Synthetic peptide
  XENP022726 vlCDR3
QQYGSSPWT

SEQ ID NO: 36182 - protein, 219 aa, Artificial Sequence; identical to SEQ ID NO: 33008
  Description of Artificial Sequence: Synthetic polypeptide
  XENP022726 1C11_H1L3_Fab-[CTLA-4]_H3.23_L0.129_scFv Light Chain

SEQ ID NO: 36183 - protein, 112 aa, Artificial Sequence; identical to SEQ ID NO: 33009
  Description of Artificial Sequence: Synthetic polypeptide
  VL of XENP022726

SEQ ID NO: 36184 - protein, 16 aa, Artificial Sequence
  Description of Artificial Sequence: Synthetic peptide
  XENP022726 vlCDR1
KSSQSIVHSNGNTYLE

SEQ ID NO: 36185 - protein, 7 aa, Artificial Sequence
  Description of Artificial Sequence: Synthetic peptide
  XENP022726 vlCDR2
KVSNRFS

SEQ ID NO: 36186 - protein, 9 aa, Artificial Sequence
  Description of Artificial Sequence: Synthetic peptide
  XENP022726 vlCDR3
FQGSHVPNT

SEQ ID NO: 36187 - protein, 446 aa, Artificial Sequence
  Description of Artificial Sequence: Synthetic polypeptide
  XENP022727 1C11_H2L1_Fab-[CTLA-4]_H3.23_L0.129_scFv Fab-Fc Heavy Chain
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 36188 - protein, 117 aa, Artificial Sequence; identical to SEQ ID NO: 33014
  Description of Artificial Sequence: Synthetic polypeptide
  VH of XENP022727

SEQ ID NO: 36189 - protein, 5 aa, Artificial Sequence
  Description of Artificial Sequence: Synthetic peptide
  XENP022727 vhCDR1
HYGMN

SEQ ID NO: 36190 - protein, 17 aa, Artificial Sequence
  Description of Artificial Sequence: Synthetic peptide
  XENP022727 vhCDR2
WINTYTGEPTYADSVKG

SEQ ID NO: 36191 - protein, 8 aa, Artificial Sequence
  Description of Artificial Sequence: Synthetic peptide
  XENP022727 vhCDR3
DYYGSSPY

SEQ ID NO: 36192 - protein, 477 aa, Artificial Sequence; identical to SEQ ID NO: 21669
  Description of Artificial Sequence: Synthetic polypeptide
  XENP022727 1C11_H2L1_Fab-[CTLA-4]_H3.23_L0.129_scFv scFv-Fc Heavy Chain

SEQ ID NO: 36193 - protein, 118 aa, Artificial Sequence; identical to SEQ ID NO: 2632
  Description of Artificial Sequence: Synthetic polypeptide
  VH of XENP022727

SEQ ID NO: 36194 - protein, 108 aa, Artificial Sequence; identical to SEQ ID NO: 2768
  Description of Artificial Sequence: Synthetic polypeptide
  VL of XENP022727

SEQ ID NO: 36195 - protein, 231 aa, Artificial Sequence; identical to SEQ ID NO: 21532
  Description of Artificial Sequence: Synthetic polypeptide
  Fc chain of XENP022727

SEQ ID NO: 36196 - protein, 5 aa, Artificial Sequence
  Description of Artificial Sequence: Synthetic peptide
  XENP022727 vhCDR1
SYTMH

SEQ ID NO: 36197 - protein, 17 aa, Artificial Sequence
  Description of Artificial Sequence: Synthetic peptide
  XENP022727 vhCDR2
FISYDGNYKYYADSVKG

SEQ ID NO: 36198 - protein, 9 aa, Artificial Sequence
  Description of Artificial Sequence: Synthetic peptide
  XENP022727 vhCDR3
GGHLGPFDL

SEQ ID NO: 36199 - protein, 12 aa, Artificial Sequence
  Description of Artificial Sequence: Synthetic peptide
  XENP022727 vlCDR1
RASQSVGSSYLA

SEQ ID NO: 36200 - protein, 7 aa, Artificial Sequence
  Description of Artificial Sequence: Synthetic peptide
  XENP022727 vlCDR2
GASSRAT

SEQ ID NO: 36201 - protein, 9 aa, Artificial Sequence
  Description of Artificial Sequence: Synthetic peptide
  XENP022727 vlCDR3
QQYGSSPWT

SEQ ID NO: 36202 - protein, 219 aa, Artificial Sequence; identical to SEQ ID NO: 33018
  Description of Artificial Sequence: Synthetic polypeptide
  XENP022727 1C11_H2L1_Fab-[CTLA-4]_H3.23_L0.129_scFv Light Chain

SEQ ID NO: 36203 - protein, 112 aa, Artificial Sequence; identical to SEQ ID NO: 33019
  Description of Artificial Sequence: Synthetic polypeptide
  VL of XENP022727

SEQ ID NO: 36204 - protein, 16 aa, Artificial Sequence
  Description of Artificial Sequence: Synthetic peptide
  XENP022727 vlCDR1
RSSQSIVHSNGNTYLE

SEQ ID NO: 36205 - protein, 7 aa, Artificial Sequence
  Description of Artificial Sequence: Synthetic peptide
  XENP022727 vlCDR2
KVSNRFS

SEQ ID NO: 36206 - protein, 9 aa, Artificial Sequence
  Description of Artificial Sequence: Synthetic peptide
  XENP022727 vlCDR3
FQGSHVPNT

SEQ ID NO: 36207 - protein, 446 aa, Artificial Sequence; identical to SEQ ID NO: 36187
  Description of Artificial Sequence: Synthetic polypeptide
  XENP022728 1C11_H2L2_Fab-[CTLA-4]_H3.23_L0.129_scFv Fab-Fc Heavy Chain

SEQ ID NO: 36208 - protein, 117 aa, Artificial Sequence; identical to SEQ ID NO: 33014
  Description of Artificial Sequence: Synthetic polypeptide
  VH of XENP022728

SEQ ID NO: 36209 - protein, 5 aa, Artificial Sequence
  Description of Artificial Sequence: Synthetic peptide
  XENP022728 vhCDR1
HYGMN

SEQ ID NO: 36210 - protein, 17 aa, Artificial Sequence
  Description of Artificial Sequence: Synthetic peptide
  XENP022728 vhCDR2
WINTYTGEPTYADSVKG

SEQ ID NO: 36211 - protein, 8 aa, Artificial Sequence
  Description of Artificial Sequence: Synthetic peptide
  XENP022728 vhCDR3
DYYGSSPY

SEQ ID NO: 36212 - protein, 477 aa, Artificial Sequence; identical to SEQ ID NO: 21669
  Description of Artificial Sequence: Synthetic polypeptide
  XENP022728 1C11_H2L2_Fab-[CTLA-4]_H3.23_L0.129_scFv scFv-Fc Heavy Chain

SEQ ID NO: 36213 - protein, 118 aa, Artificial Sequence; identical to SEQ ID NO: 2632
  Description of Artificial Sequence: Synthetic polypeptide
  VH of XENP022728

SEQ ID NO: 36214 - protein, 108 aa, Artificial Sequence; identical to SEQ ID NO: 2768
  Description of Artificial Sequence: Synthetic polypeptide
  VL of XENP022728

SEQ ID NO: 36215 - protein, 231 aa, Artificial Sequence; identical to SEQ ID NO: 21532
  Description of Artificial Sequence: Synthetic polypeptide
  Fc chain of XENP022728

SEQ ID NO: 36216 - protein, 5 aa, Artificial Sequence
  Description of Artificial Sequence: Synthetic peptide
  XENP022728 vhCDR1
SYTMH

SEQ ID NO: 36217 - protein, 17 aa, Artificial Sequence
  Description of Artificial Sequence: Synthetic peptide
  XENP022728 vhCDR2
FISYDGNYKYYADSVKG

SEQ ID NO: 36218 - protein, 9 aa, Artificial Sequence
  Description of Artificial Sequence: Synthetic peptide
  XENP022728 vhCDR3
GGHLGPFDL

SEQ ID NO: 36219 - protein, 12 aa, Artificial Sequence
  Description of Artificial Sequence: Synthetic peptide
  XENP022728 vlCDR1
RASQSVGSSYLA

SEQ ID NO: 36220 - protein, 7 aa, Artificial Sequence
  Description of Artificial Sequence: Synthetic peptide
  XENP022728 vlCDR2
GASSRAT

SEQ ID NO: 36221 - protein, 9 aa, Artificial Sequence
  Description of Artificial Sequence: Synthetic peptide
  XENP022728 vlCDR3
QQYGSSPWT

SEQ ID NO: 36222 - protein, 219 aa, Artificial Sequence; identical to SEQ ID NO: 33028
  Description of Artificial Sequence: Synthetic polypeptide
  XENP022728 1C11_H2L2_Fab-[CTLA-4]_H3.23_L0.129_scFv Light Chain

SEQ ID NO: 36223 - protein, 112 aa, Artificial Sequence; identical to SEQ ID NO: 33029
  Description of Artificial Sequence: Synthetic polypeptide
  VL of XENP022728

SEQ ID NO: 36224 - protein, 16 aa, Artificial Sequence
  Description of Artificial Sequence: Synthetic peptide
  XENP022728 vlCDR1
RSSQSIVHSNGNTYLE

SEQ ID NO: 36225 - protein, 7 aa, Artificial Sequence
  Description of Artificial Sequence: Synthetic peptide
  XENP022728 vlCDR2
KVSNRFS

SEQ ID NO: 36226 - protein, 9 aa, Artificial Sequence
  Description of Artificial Sequence: Synthetic peptide
  XENP022728 vlCDR3
FQGSHVPNT

SEQ ID NO: 36227 - protein, 446 aa, Artificial Sequence
  Description of Artificial Sequence: Synthetic polypeptide
  XENP022729 1C11_H3L3_Fab-[CTLA-4]_H3.23_L0.129_scFv Fab-Fc Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 36228 - protein, 117 aa, Artificial Sequence; identical to SEQ ID NO: 33034
  Description of Artificial Sequence: Synthetic polypeptide
  VH of XENP022729

SEQ ID NO: 36229 - protein, 5 aa, Artificial Sequence
  Description of Artificial Sequence: Synthetic peptide
  XENP022729 vhCDR1
HYGMN

SEQ ID NO: 36230 - protein, 17 aa, Artificial Sequence
  Description of Artificial Sequence: Synthetic peptide
  XENP022729 vhCDR2
WINTYTGEPTYADGFTG

SEQ ID NO: 36231 - protein, 8 aa, Artificial Sequence
  Description of Artificial Sequence: Synthetic peptide
  XENP022729 vhCDR3
DYYGSSPY

SEQ ID NO: 36232 - protein, 477 aa, Artificial Sequence; identical to SEQ ID NO: 21669
  Description of Artificial Sequence: Synthetic polypeptide
  XENP022729 1C11_H3L3_Fab-[CTLA-4]_H3.23_L0.129_scFv scFv-Fc Heavy Chain

SEQ ID NO: 36233 - protein, 118 aa, Artificial Sequence; identical to SEQ ID NO: 2632
  Description of Artificial Sequence: Synthetic polypeptide
  VH of XENP022729

SEQ ID NO: 36234 - protein, 108 aa, Artificial Sequence; identical to SEQ ID NO: 2768
  Description of Artificial Sequence: Synthetic polypeptide
  VL of XENP022729

SEQ ID NO: 36235 - protein, 231 aa, Artificial Sequence; identical to SEQ ID NO: 21532
  Description of Artificial Sequence: Synthetic polypeptide
  Fc chain of XENP022729

SEQ ID NO: 36236 - protein, 5 aa, Artificial Sequence
  Description of Artificial Sequence: Synthetic peptide
  XENP022729 vhCDR1
SYTMH

SEQ ID NO: 36237 - protein, 17 aa, Artificial Sequence
  Description of Artificial Sequence: Synthetic peptide
  XENP022729 vhCDR2
FISYDGNYKYYADSVKG

SEQ ID NO: 36238 - protein, 9 aa, Artificial Sequence
  Description of Artificial Sequence: Synthetic peptide
  XENP022729 vhCDR3
GGHLGPFDL

SEQ ID NO: 36239 - protein, 12 aa, Artificial Sequence
  Description of Artificial Sequence: Synthetic peptide
  XENP022729 vlCDR1
RASQSVGSSYLA

SEQ ID NO: 36240 - protein, 7 aa, Artificial Sequence
  Description of Artificial Sequence: Synthetic peptide
  XENP022729 vlCDR2
GASSRAT

SEQ ID NO: 36241 - protein, 9 aa, Artificial Sequence
  Description of Artificial Sequence: Synthetic peptide
  XENP022729 vlCDR3
QQYGSSPWT

SEQ ID NO: 36242 - protein, 219 aa, Artificial Sequence; identical to SEQ ID NO: 33008
  Description of Artificial Sequence: Synthetic polypeptide
  XENP022729 1C11_H3L3_Fab-[CTLA-4]_H3.23_L0.129_scFv Light Chain

SEQ ID NO: 36243 - protein, 112 aa, Artificial Sequence; identical to SEQ ID NO: 33009
  Description of Artificial Sequence: Synthetic polypeptide
  VL of XENP022729

SEQ ID NO: 36244 - protein, 16 aa, Artificial Sequence
  Description of Artificial Sequence: Synthetic peptide
  XENP022729 vlCDR1
KSSQSIVHSNGNTYLE

SEQ ID NO: 36245 - protein, 7 aa, Artificial Sequence
  Description of Artificial Sequence: Synthetic peptide
  XENP022729 vlCDR2
KVSNRFS

SEQ ID NO: 36246 - protein, 9 aa, Artificial Sequence
  Description of Artificial Sequence: Synthetic peptide
  XENP022729 vlCDR3
FQGSHVPNT

SEQ ID NO: 36247 - protein, 449 aa, Artificial Sequence
  Description of Artificial Sequence: Synthetic polypeptide
  XENP022836 2E9_H1L1_Fab-[CTLA-4]_H3.23_L0.129_scFv HC-Fab
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 36248 - protein, 120 aa, Artificial Sequence; identical to SEQ ID NO: 11412
  Description of Artificial Sequence: Synthetic polypeptide
  VH of XENP022836

SEQ ID NO: 36249 - protein, 5 aa, Artificial Sequence
  Description of Artificial Sequence: Synthetic peptide
  XENP022836 vhCDR1
NYWLG

SEQ ID NO: 36250 - protein, 17 aa, Artificial Sequence
  Description of Artificial Sequence: Synthetic peptide
  XENP022836 vhCDR2
NFYPGSSNTYYNEKFQG

SEQ ID NO: 36251 - protein, 11 aa, Artificial Sequence
  Description of Artificial Sequence: Synthetic peptide
  XENP022836 vhCDR3
HYGTNYRYFDV

SEQ ID NO: 36252 - protein, 477 aa, Artificial Sequence; identical to SEQ ID NO: 21669
  Description of Artificial Sequence: Synthetic polypeptide
  XENP022836 2E9_H1L1_Fab-[CTLA-4]_H3.23_L0.129_scFv HC-scFV

SEQ ID NO: 36253 - protein, 118 aa, Artificial Sequence; identical to SEQ ID NO: 2632
  Description of Artificial Sequence: Synthetic polypeptide
  VH of XENP022836

SEQ ID NO: 36254 - protein, 108 aa, Artificial Sequence; identical to SEQ ID NO: 2768
  Description of Artificial Sequence: Synthetic polypeptide
  VL of XENP022836

SEQ ID NO: 36255 - protein, 231 aa, Artificial Sequence; identical to SEQ ID NO: 21532
  Description of Artificial Sequence: Synthetic polypeptide
  Fc chain of XENP022836

SEQ ID NO: 36256 - protein, 5 aa, Artificial Sequence
  Description of Artificial Sequence: Synthetic peptide
  XENP022836 vhCDR1
SYTMH

SEQ ID NO: 36257 - protein, 17 aa, Artificial Sequence
  Description of Artificial Sequence: Synthetic peptide
  XENP022836 vhCDR2
FISYDGNYKYYADSVKG

SEQ ID NO: 36258 - protein, 9 aa, Artificial Sequence
  Description of Artificial Sequence: Synthetic peptide
  XENP022836 vhCDR3
GGHLGPFDL

SEQ ID NO: 36259 - protein, 12 aa, Artificial Sequence
  Description of Artificial Sequence: Synthetic peptide
  XENP022836 vlCDR1
RASQSVGSSYLA

SEQ ID NO: 36260 - protein, 7 aa, Artificial Sequence
  Description of Artificial Sequence: Synthetic peptide
  XENP022836 vlCDR2
GASSRAT

SEQ ID NO: 36261 - protein, 9 aa, Artificial Sequence
  Description of Artificial Sequence: Synthetic peptide
  XENP022836 vlCDR3
QQYGSSPWT

SEQ ID NO: 36262 - protein, 214 aa, Artificial Sequence; identical to SEQ ID NO: 17080
  Description of Artificial Sequence: Synthetic polypeptide
  XENP022836 2E9_H1L1_Fab-[CTLA-4]_H3.23_L0.129_scFv Light Chain

SEQ ID NO: 36263 - protein, 107 aa, Artificial Sequence; identical to SEQ ID NO: 11413
  Description of Artificial Sequence: Synthetic polypeptide
  VL of XENP022836

SEQ ID NO: 36264 - protein, 11 aa, Artificial Sequence
  Description of Artificial Sequence: Synthetic peptide
  XENP022836 vlCDR1
RASQSVSNDVA

SEQ ID NO: 36265 - protein, 7 aa, Artificial Sequence
  Description of Artificial Sequence: Synthetic peptide
  XENP022836 vlCDR2
YASNRYT

SEQ ID NO: 36266 - protein, 9 aa, Artificial Sequence
  Description of Artificial Sequence: Synthetic peptide
  XENP022836 vlCDR3
QQDYSSPYT

SEQ ID NO: 36267 - protein, 446 aa, Artificial Sequence
  Description of Artificial Sequence: Synthetic polypeptide
  XENP022854 1C11_H3L3_Fab-[CTLA-4]_H3.23_L0.129_[CTLA-4]_scFv Fab-Fc Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 36268 - protein, 117 aa, Artificial Sequence; identical to SEQ ID NO: 33034
  Description of Artificial Sequence: Synthetic polypeptide
  VH of XENP022854

SEQ ID NO: 36269 - protein, 5 aa, Artificial Sequence
  Description of Artificial Sequence: Synthetic peptide
  XENP022854 vhCDR1
HYGMN

SEQ ID NO: 36270 - protein, 17 aa, Artificial Sequence
  Description of Artificial Sequence: Synthetic peptide
  XENP022854 vhCDR2
WINTYTGEPTYADGFTG

SEQ ID NO: 36271 - protein, 8 aa, Artificial Sequence
  Description of Artificial Sequence: Synthetic peptide
  XENP022854 vhCDR3
DYYGSSPY

SEQ ID NO: 36272 - protein, 477 aa, Artificial Sequence; identical to SEQ ID NO: 35612
  Description of Artificial Sequence: Synthetic polypeptide
  XENP022854 1C11_H3L3_Fab-[CTLA-4]_H3.23_L0.129_[CTLA-4]_scFv scFv-Fc Heavy Chain

SEQ ID NO: 36273 - protein, 118 aa, Artificial Sequence; identical to SEQ ID NO: 2632
  Description of Artificial Sequence: Synthetic polypeptide
  VH of XENP022854

SEQ ID NO: 36274 - protein, 108 aa, Artificial Sequence; identical to SEQ ID NO: 2768
  Description of Artificial Sequence: Synthetic polypeptide
  VL of XENP022854

SEQ ID NO: 36275 - protein, 231 aa, Artificial Sequence; identical to SEQ ID NO: 21572
  Description of Artificial Sequence: Synthetic polypeptide
  Fc chain of XENP022854

SEQ ID NO: 36276 - protein, 5 aa, Artificial Sequence
  Description of Artificial Sequence: Synthetic peptide
  XENP022854 vhCDR1
SYTMH

SEQ ID NO: 36277 - protein, 17 aa, Artificial Sequence
  Description of Artificial Sequence: Synthetic peptide
  XENP022854 vhCDR2
FISYDGNYKYYADSVKG

SEQ ID NO: 36278 - protein, 9 aa, Artificial Sequence
  Description of Artificial Sequence: Synthetic peptide
  XENP022854 vhCDR3
GGHLGPFDL

SEQ ID NO: 36279 - protein, 12 aa, Artificial Sequence
  Description of Artificial Sequence: Synthetic peptide
  XENP022854 vlCDR1
RASQSVGSSYLA

SEQ ID NO: 36280 - protein, 7 aa, Artificial Sequence
  Description of Artificial Sequence: Synthetic peptide
  XENP022854 vlCDR2
GASSRAT

SEQ ID NO: 36281 - protein, 9 aa, Artificial Sequence
  Description of Artificial Sequence: Synthetic peptide
  XENP022854 vlCDR3
QQYGSSPWT

SEQ ID NO: 36282 - protein, 219 aa, Artificial Sequence; identical to SEQ ID NO: 33008
  Description of Artificial Sequence: Synthetic polypeptide
  XENP022854 1C11_H3L3_Fab-[CTLA-4]_H3.23_L0.129_[CTLA-4]_scFv Light Chain

SEQ ID NO: 36283 - protein, 112 aa, Artificial Sequence; identical to SEQ ID NO: 33009
  Description of Artificial Sequence: Synthetic polypeptide
  VL of XENP022854

SEQ ID NO: 36284 - protein, 16 aa, Artificial Sequence
  Description of Artificial Sequence: Synthetic peptide
  XENP022854 vlCDR1
KSSQSIVHSNGNTYLE

SEQ ID NO: 36285 - protein, 7 aa, Artificial Sequence
  Description of Artificial Sequence: Synthetic peptide
  XENP022854 vlCDR2
KVSNRFS

SEQ ID NO: 36286 - protein, 9 aa, Artificial Sequence
  Description of Artificial Sequence: Synthetic peptide
  XENP022854 vlCDR3
FQGSHVPNT

SEQ ID NO: 36287 - protein, 449 aa, Artificial Sequence
  Description of Artificial Sequence: Synthetic polypeptide
  XENP022855 2E9_H1L1_Fab-[CTLA-4]_H3.23_L0.129_[CTLA-4]_scFv Fab-Fc Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 36288 - protein, 120 aa, Artificial Sequence; identical to SEQ ID NO: 11412
  Description of Artificial Sequence: Synthetic polypeptide
  VH of XENP022855

SEQ ID NO: 36289 - protein, 5 aa, Artificial Sequence
  Description of Artificial Sequence: Synthetic peptide
  XENP022855 vhCDR1
NYWLG

SEQ ID NO: 36290 - protein, 17 aa, Artificial Sequence
  Description of Artificial Sequence: Synthetic peptide
  XENP022855 vhCDR2
NFYPGSSNTYYNEKFQG

SEQ ID NO: 36291 - protein, 11 aa, Artificial Sequence
  Description of Artificial Sequence: Synthetic peptide
  XENP022855 vhCDR3
HYGTNYRYFDV

SEQ ID NO: 36292 - protein, 477 aa, Artificial Sequence; identical to SEQ ID NO: 35612
  Description of Artificial Sequence: Synthetic polypeptide
  XENP022855 2E9_H1L1_Fab-[CTLA-4]_H3.23_L0.129_[CTLA-4]_scFv scFv-Fc Heavy Chain

SEQ ID NO: 36293 - protein, 118 aa, Artificial Sequence; identical to SEQ ID NO: 2632
  Description of Artificial Sequence: Synthetic polypeptide
  VH of XENP022855

SEQ ID NO: 36294 - protein, 108 aa, Artificial Sequence; identical to SEQ ID NO: 2768
  Description of Artificial Sequence: Synthetic polypeptide
  VL of XENP022855

SEQ ID NO: 36295 - protein, 231 aa, Artificial Sequence; identical to SEQ ID NO: 21572
  Description of Artificial Sequence: Synthetic polypeptide
  Fc chain of XENP022855

SEQ ID NO: 36296 - protein, 5 aa, Artificial Sequence
  Description of Artificial Sequence: Synthetic peptide
  XENP022855 vhCDR1
SYTMH

SEQ ID NO: 36297 - protein, 17 aa, Artificial Sequence
  Description of Artificial Sequence: Synthetic peptide
  XENP022855 vhCDR2
FISYDGNYKYYADSVKG

SEQ ID NO: 36298 - protein, 9 aa, Artificial Sequence
  Description of Artificial Sequence: Synthetic peptide
  XENP022855 vhCDR3
GGHLGPFDL

SEQ ID NO: 36299 - protein, 12 aa, Artificial Sequence
  Description of Artificial Sequence: Synthetic peptide
  XENP022855 vlCDR1
RASQSVGSSYLA

SEQ ID NO: 36300 - protein, 7 aa, Artificial Sequence
  Description of Artificial Sequence: Synthetic peptide
  XENP022855 vlCDR2
GASSRAT

SEQ ID NO: 36301 - protein, 9 aa, Artificial Sequence
  Description of Artificial Sequence: Synthetic peptide
  XENP022855 vlCDR3
QQYGSSPWT

SEQ ID NO: 36302 - protein, 214 aa, Artificial Sequence; identical to SEQ ID NO: 17080
  Description of Artificial Sequence: Synthetic polypeptide
  XENP022855 2E9_H1L1_Fab-[CTLA-4]_H3.23_L0.129_[CTLA-4]_scFv Light Chain

SEQ ID NO: 36303 - protein, 107 aa, Artificial Sequence; identical to SEQ ID NO: 11413
  Description of Artificial Sequence: Synthetic polypeptide
  VL of XENP022855

SEQ ID NO: 36304 - protein, 11 aa, Artificial Sequence
  Description of Artificial Sequence: Synthetic peptide
  XENP022855 vlCDR1
RASQSVSNDVA

SEQ ID NO: 36305 - protein, 7 aa, Artificial Sequence
  Description of Artificial Sequence: Synthetic peptide
  XENP022855 vlCDR2
YASNRYT

SEQ ID NO: 36306 - protein, 9 aa, Artificial Sequence
  Description of Artificial Sequence: Synthetic peptide
  XENP022855 vlCDR3
QQDYSSPYT

SEQ ID NO: 36307 - protein, 446 aa, Artificial Sequence; identical to SEQ ID NO: 36227
  Description of Artificial Sequence: Synthetic polypeptide
  XENP022993 1C11_H3L1_Fab-[CTLA-4]_H3.23_L0.129_scFv Fab-Fc Heavy Chain

SEQ ID NO: 36308 - protein, 117 aa, Artificial Sequence; identical to SEQ ID NO: 33034
  Description of Artificial Sequence: Synthetic polypeptide
  VH of XENP022993

SEQ ID NO: 36309 - protein, 5 aa, Artificial Sequence
  Description of Artificial Sequence: Synthetic peptide
  XENP022993 vhCDR1
HYGMN

SEQ ID NO: 36310 - protein, 17 aa, Artificial Sequence
  Description of Artificial Sequence: Synthetic peptide
  XENP022993 vhCDR2
WINTYTGEPTYADGFTG

SEQ ID NO: 36311 - protein, 8 aa, Artificial Sequence
  Description of Artificial Sequence: Synthetic peptide
  XENP022993 vhCDR3
DYYGSSPY

SEQ ID NO: 36312 - protein, 477 aa, Artificial Sequence; identical to SEQ ID NO: 21669
  Description of Artificial Sequence: Synthetic polypeptide
  XENP022993 1C11_H3L1_Fab-[CTLA-4]_H3.23_L0.129_scFv scFv-Fc Heavy Chain

SEQ ID NO: 36313 - protein, 118 aa, Artificial Sequence; identical to SEQ ID NO: 2632
  Description of Artificial Sequence: Synthetic polypeptide
  VH of XENP022993

SEQ ID NO: 36314 - protein, 108 aa, Artificial Sequence; identical to SEQ ID NO: 2768
  Description of Artificial Sequence: Synthetic polypeptide
  VL of XENP022993

SEQ ID NO: 36315 - protein, 231 aa, Artificial Sequence; identical to SEQ ID NO: 21532
  Description of Artificial Sequence: Synthetic polypeptide
  Fc chain of XENP022993

SEQ ID NO: 36316 - protein, 5 aa, Artificial Sequence
  Description of Artificial Sequence: Synthetic peptide
  XENP022993 vhCDR1
SYTMH

SEQ ID NO: 36317 - protein, 17 aa, Artificial Sequence
  Description of Artificial Sequence: Synthetic peptide
  XENP022993 vhCDR2
FISYDGNYKYYADSVKG

SEQ ID NO: 36318 - protein, 9 aa, Artificial Sequence
  Description of Artificial Sequence: Synthetic peptide
  XENP022993 vhCDR3
GGHLGPFDL

SEQ ID NO: 36319 - protein, 12 aa, Artificial Sequence
  Description of Artificial Sequence: Synthetic peptide
  XENP022993 vlCDR1
RASQSVGSSYLA

SEQ ID NO: 36320 - protein, 7 aa, Artificial Sequence
  Description of Artificial Sequence: Synthetic peptide
  XENP022993 vlCDR2
GASSRAT

SEQ ID NO: 36321 - protein, 9 aa, Artificial Sequence
  Description of Artificial Sequence: Synthetic peptide
  XENP022993 vlCDR3
QQYGSSPWT

SEQ ID NO: 36322 - protein, 219 aa, Artificial Sequence; identical to SEQ ID NO: 33018
  Description of Artificial Sequence: Synthetic polypeptide
  XENP022993 1C11_H3L1_Fab-[CTLA-4]_H3.23_L0.129_scFv Light Chain

SEQ ID NO: 36323 - protein, 112 aa, Artificial Sequence; identical to SEQ ID NO: 33019
  Description of Artificial Sequence: Synthetic polypeptide
  VL of XENP022993

SEQ ID NO: 36324 - protein, 16 aa, Artificial Sequence
  Description of Artificial Sequence: Synthetic peptide
  XENP022993 vlCDR1
RSSQSIVHSNGNTYLE

SEQ ID NO: 36325 - protein, 7 aa, Artificial Sequence
  Description of Artificial Sequence: Synthetic peptide
  XENP022993 vlCDR2
KVSNRFS

SEQ ID NO: 36326 - protein, 9 aa, Artificial Sequence
  Description of Artificial Sequence: Synthetic peptide
  XENP022993 vlCDR3
FQGSHVPNT

SEQ ID NO: 36327 - protein, 446 aa, Artificial Sequence; identical to SEQ ID NO: 36227
  Description of Artificial Sequence: Synthetic polypeptide
  XENP022994 1C11_H3L2_Fab-[CTLA-4]_H3.23_L0.129_scFv Fab-Fc Heavy Chain

SEQ ID NO: 36328 - protein, 117 aa, Artificial Sequence; identical to SEQ ID NO: 33034
  Description of Artificial Sequence: Synthetic polypeptide
  VH of XENP022994

SEQ ID NO: 36329 - protein, 5 aa, Artificial Sequence
  Description of Artificial Sequence: Synthetic peptide
  XENP022994 vhCDR1
HYGMN

SEQ ID NO: 36330 - protein, 17 aa, Artificial Sequence
  Description of Artificial Sequence: Synthetic peptide
  XENP022994 vhCDR2
WINTYTGEPTYADGFTG

SEQ ID NO: 36331 - protein, 8 aa, Artificial Sequence
  Description of Artificial Sequence: Synthetic peptide
  XENP022994 vhCDR3
DYYGSSPY

SEQ ID NO: 36332 - protein, 477 aa, Artificial Sequence; identical to SEQ ID NO: 21669
  Description of Artificial Sequence: Synthetic polypeptide
  XENP022994 1C11_H3L2_Fab-[CTLA-4]_H3.23_L0.129_scFv scFv-Fc Heavy Chain

SEQ ID NO: 36333 - protein, 118 aa, Artificial Sequence; identical to SEQ ID NO: 2632
  Description of Artificial Sequence: Synthetic polypeptide
  VH of XENP022994

SEQ ID NO: 36334 - protein, 108 aa, Artificial Sequence; identical to SEQ ID NO: 2768
  Description of Artificial Sequence: Synthetic polypeptide
  VL of XENP022994

SEQ ID NO: 36335 - protein, 231 aa, Artificial Sequence; identical to SEQ ID NO: 21532
  Description of Artificial Sequence: Synthetic polypeptide
  Fc chain of XENP022994

SEQ ID NO: 36336 - protein, 5 aa, Artificial Sequence
  Description of Artificial Sequence: Synthetic peptide
  XENP022994 vhCDR1
SYTMH

SEQ ID NO: 36337 - protein, 17 aa, Artificial Sequence
  Description of Artificial Sequence: Synthetic peptide
  XENP022994 vhCDR2
FISYDGNYKYYADSVKG

SEQ ID NO: 36338 - protein, 9 aa, Artificial Sequence
  Description of Artificial Sequence: Synthetic peptide
  XENP022994 vhCDR3
GGHLGPFDL

SEQ ID NO: 36339 - protein, 12 aa, Artificial Sequence
  Description of Artificial Sequence: Synthetic peptide
  XENP022994 vlCDR1
RASQSVGSSYLA

SEQ ID NO: 36340 - protein, 7 aa, Artificial Sequence
  Description of Artificial Sequence: Synthetic peptide
  XENP022994 vlCDR2
GASSRAT

SEQ ID NO: 36341 - protein, 9 aa, Artificial Sequence
  Description of Artificial Sequence: Synthetic peptide
  XENP022994 vlCDR3
QQYGSSPWT

SEQ ID NO: 36342 - protein, 219 aa, Artificial Sequence; identical to SEQ ID NO: 33028
  Description of Artificial Sequence: Synthetic polypeptide
  XENP022994 1C11_H3L2_Fab-[CTLA-4]_H3.23_L0.129_scFv Light Chain

SEQ ID NO: 36343 - protein, 112 aa, Artificial Sequence; identical to SEQ ID NO: 33029
  Description of Artificial Sequence: Synthetic polypeptide
  VL of XENP022994

SEQ ID NO: 36344 - protein, 16 aa, Artificial Sequence
  Description of Artificial Sequence: Synthetic peptide
  XENP022994 vlCDR1
RSSQSIVHSNGNTYLE

SEQ ID NO: 36345 - protein, 7 aa, Artificial Sequence
  Description of Artificial Sequence: Synthetic peptide
  XENP022994 vlCDR2
KVSNRFS

SEQ ID NO: 36346 - protein, 9 aa, Artificial Sequence
  Description of Artificial Sequence: Synthetic peptide
  XENP022994 vlCDR3
FQGSHVPNT

SEQ ID NO: 36347 - protein, 446 aa, Artificial Sequence
  Description of Artificial Sequence: Synthetic polypeptide
  XENP020850 1D12_H1L1_IgG1_PVA_/S267K Heavy Chain
QVQLVQSGAEVKKPGASVKVSCKASGYTFTSYTMHWVRQAPGQGLEWMGYLIPSSGYTDYNQKFQGRVTMTADKSTSTAYMELSSLRSEDTAVYYCARGDSVYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36348 - protein, 117 aa, Artificial Sequence
  Description of Artificial Sequence: Synthetic polypeptide
  VH of XENP020850
QVQLVQSGAEVKKPGASVKVSCKASGYTFTSYTMHWVRQAPGQGLEWMGYLIPSSGYTDYNQKFQGRVTMTADKSTSTAYMELSSLRSEDTAVYYCARGDSVYFDYWGQGTLVTVSS

SEQ ID NO: 36349 - protein, 5 aa, Artificial Sequence
  Description of Artificial Sequence: Synthetic peptide
  XENP020850 vhCDR1
SYTMH

SEQ ID NO: 36350 - protein, 17 aa, Artificial Sequence
  Description of Artificial Sequence: Synthetic peptide
  XENP020850 vhCDR2
YLIPSSGYTDYNQKFQG

SEQ ID NO: 36351 - protein, 8 aa, Artificial Sequence
  Description of Artificial Sequence: Synthetic peptide
  XENP020850 vhCDR3
GDSVYFDY

SEQ ID NO: 36352 - protein, 218 aa, Artificial Sequence
  Description of Artificial Sequence: Synthetic polypeptide
  XENP020850 1D12_H1L1_IgG1_PVA_/S267K Light Chain
DIVLTQSPATLSLSPGERATLSCRASESVEYYGTSLMQWYQQKPGQPPRLLIYAASNVESGVPARFSGSGSGTDFTLTISSLEPEDFAVYFCQQSRKVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36353 - protein, 111 aa, Artificial Sequence
  Description of Artificial Sequence: Synthetic polypeptide
  VL of XENP020850
DIVLTQSPATLSLSPGERATLSCRASESVEYYGTSLMQWYQQKPGQPPRLLIYAASNVESGVPARFSGSGSGTDFTLTISSLEPEDFAVYFCQQSRKVPWTFGGGTKVEIK

SEQ ID NO: 36354 - protein, 15 aa, Artificial Sequence
  Description of Artificial Sequence: Synthetic peptide
  XENP020850 vlCDR1
RASESVEYYGTSLMQ

SEQ ID NO: 36355 - protein, 7 aa, Artificial Sequence
  Description of Artificial Sequence: Synthetic peptide
  XENP020850 vlCDR2
AASNVES

SEQ ID NO: 36356 - protein, 9 aa, Artificial Sequence
  Description of Artificial Sequence: Synthetic peptide
  XENP020850 vlCDR3
QQSRKVPWT

SEQ ID NO: 36357 - protein, 446 aa, Artificial Sequence; identical to SEQ ID NO: 36347
  Description of Artificial Sequence: Synthetic polypeptide
  XENP020851 1D12_H1L2_IgG1_PVA_/S267K Heavy Chain

SEQ ID NO: 36358 - protein, 117 aa, Artificial Sequence; identical to SEQ ID NO: 36348
  Description of Artificial Sequence: Synthetic polypeptide
  VH of XENP020851

SEQ ID NO: 36359 - protein, 5 aa, Artificial Sequence
  Description of Artificial Sequence: Synthetic peptide
  XENP020851 vhCDR1
SYTMH

SEQ ID NO: 36360 - protein, 17 aa, Artificial Sequence
  Description of Artificial Sequence: Synthetic peptide
  XENP020851 vhCDR2
YLIPSSGYTDYNQKFQG

SEQ ID NO: 36361 - protein, 8 aa, Artificial Sequence
  Description of Artificial Sequence: Synthetic peptide
  XENP020851 vhCDR3
GDSVYFDY

SEQ ID NO: 36362 - protein, 218 aa, Artificial Sequence
  Description of Artificial Sequence: Synthetic polypeptide
  XENP020851 1D12_H1L2_IgG1_PVA_/S267K Light Chain
DIVLTQSPDSLAVSLGERATINCKASESVEYYGTSLMQWYQQKPGQPPKLLIYAASNVESGVPARFSGSGSGTDFTLTISSLQAEDVAVYFCQQSRKVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36363 - protein, 111 aa, Artificial Sequence
  Description of Artificial Sequence: Synthetic polypeptide
  VL of XENP020851
DIVLTQSPDSLAVSLGERATINCKASESVEYYGTSLMQWYQQKPGQPPKLLIYAASNVESGVPARFSGSGSGTDFTLTISSLQAEDVAVYFCQQSRKVPWTFGGGTKVEIK

SEQ ID NO: 36364 - protein, 15 aa, Artificial Sequence
  Description of Artificial Sequence: Synthetic peptide
  XENP020851 vlCDR1
KASESVEYYGTSLMQ

SEQ ID NO: 36365 - protein, 7 aa, Artificial Sequence
  Description of Artificial Sequence: Synthetic peptide
  XENP020851 vlCDR2
AASNVES

SEQ ID NO: 36366 - protein, 9 aa, Artificial Sequence
  Description of Artificial Sequence: Synthetic peptide
  XENP020851 vlCDR3
QQSRKVPWT

SEQ ID NO: 36367 - protein, 446 aa, Artificial Sequence
  Description of Artificial Sequence: Synthetic polypeptide
  XENP020853 3H3_H1L1_IgG1_PVA_/S267K Heavy Chain
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36368 - protein, 117 aa, Artificial Sequence
  Description of Artificial Sequence: Synthetic polypeptide
  VH of XENP020853
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDEDYWGQGTLVTVSS

SEQ ID NO: 36369 - protein, 5 aa, Artificial Sequence
  Description of Artificial Sequence: Synthetic peptide
  XENP020853 vhCDR1
GYGVN

SEQ ID NO: 36370 - protein, 16 aa, Artificial Sequence
  Description of Artificial Sequence: Synthetic peptide
  XENP020853 vhCDR2
MIWGDGSTDYNSALKS

SEQ ID NO: 36371 - protein, 9 aa, Artificial Sequence
  Description of Artificial Sequence: Synthetic peptide
  XENP020853 vhCDR3
SYYTSDEDY

SEQ ID NO: 36372 - protein, 219 aa, Artificial Sequence
  Description of Artificial Sequence: Synthetic polypeptide
  XENP020853 3H3_H1L1_IgG1_PVA_/S267K Light Chain
DIVLTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36373 - protein, 112 aa, Artificial Sequence
  Description of Artificial Sequence: Synthetic polypeptide
  VL of XENP020853
DIVLTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIK

SEQ ID NO: 36374 - protein, 17 aa, Artificial Sequence
  Description of Artificial Sequence: Synthetic peptide
  XENP020853 vlCDR1
RSSQSLLNSRTRKNYLA

SEQ ID NO: 36375 - protein, 7 aa, Artificial Sequence
  Description of Artificial Sequence: Synthetic peptide
  XENP020853 vlCDR2
WASTRES

SEQ ID NO: 36376 - protein, 8 aa, Artificial Sequence
  Description of Artificial Sequence: Synthetic peptide
  XENP020853 vlCDR3
KQSYSLRT

SEQ ID NO: 36377 - protein, 446 aa, Artificial Sequence; identical to SEQ ID NO: 36367
  Description of Artificial Sequence: Synthetic polypeptide
  XENP020854 3H3_H1L2_IgG1_PVA_/S267K Heavy Chain

SEQ ID NO: 36378 - protein, 117 aa, Artificial Sequence; identical to SEQ ID NO: 36368
  Description of Artificial Sequence: Synthetic polypeptide
  VH of XENP020854

SEQ ID NO: 36379 - protein, 5 aa, Artificial Sequence
  Description of Artificial Sequence: Synthetic peptide
  XENP020854 vhCDR1
GYGVN

SEQ ID NO: 36380 - protein, 16 aa, Artificial Sequence
  Description of Artificial Sequence: Synthetic peptide
  XENP020854 vhCDR2
MIWGDGSTDYNSALKS

SEQ ID NO: 36381 - protein, 9 aa, Artificial Sequence
  Description of Artificial Sequence: Synthetic peptide
  XENP020854 vhCDR3
SYYTSDEDY

SEQ ID NO: 36382 - protein, 219 aa, Artificial Sequence
  Description of Artificial Sequence: Synthetic polypeptide
  XENP020854 3H3_H1L2_IgG1_PVA_/S267K Light Chain
DIVLTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36383 - protein, 112 aa, Artificial Sequence
  Description of Artificial Sequence: Synthetic polypeptide
  VL of XENP020854
DIVLTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIK

SEQ ID NO: 36384 - protein, 17 aa, Artificial Sequence
  Description of Artificial Sequence: Synthetic peptide
  XENP020854 vlCDR1
KSSQSLLNSRTRKNYLA

SEQ ID NO: 36385 - protein, 7 aa, Artificial Sequence
  Description of Artificial Sequence: Synthetic peptide
  XENP020854 vlCDR2
WASTRES

SEQ ID NO: 36386 - protein, 8 aa, Artificial Sequence
  Description of Artificial Sequence: Synthetic peptide
  XENP020854 vlCDR3
KQSYSLRT

SEQ ID NO: 36387 - protein, 446 aa, Artificial Sequence
  Description of Artificial Sequence: Synthetic polypeptide
  XENP020855 3H3_H2L1_IgG1_PVA_/S267K Heavy Chain
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36388 - protein, 117 aa, Artificial Sequence
  Description of Artificial Sequence: Synthetic polypeptide
  VH of XENP020855
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDFDYWGQGTLVTVSS

SEQ ID NO: 36389 - protein, 5 aa, Artificial Sequence
  Description of Artificial Sequence: Synthetic peptide
  XENP020855 vhCDR1
GYGVN

SEQ ID NO: 36390 - protein, 16 aa, Artificial Sequence
  Description of Artificial Sequence: Synthetic peptide
  XENP020855 vhCDR2
MIWGDGSTDYNSALKS

SEQ ID NO: 36391 - protein, 9 aa, Artificial Sequence
  Description of Artificial Sequence: Synthetic peptide
  XENP020855 vhCDR3
SYYTSDFDY

SEQ ID NO: 36392 - protein, 219 aa, Artificial Sequence; identical to SEQ ID NO: 36372
  Description of Artificial Sequence: Synthetic polypeptide
  XENP020855 3H3_H2L1_IgG1_PVA_/S267K Light Chain

SEQ ID NO: 36393 - protein, 112 aa, Artificial Sequence; identical to SEQ ID NO: 36373
  Description of Artificial Sequence: Synthetic polypeptide
  VL of XENP020855

SEQ ID NO: 36394 - protein, 17 aa, Artificial Sequence
  Description of Artificial Sequence: Synthetic peptide
  XENP020855 vlCDR1
RSSQSLLNSRTRKNYLA

SEQ ID NO: 36395 - protein, 7 aa, Artificial Sequence
  Description of Artificial Sequence: Synthetic peptide
  XENP020855 vlCDR2
WASTRES

SEQ ID NO: 36396 - protein, 8 aa, Artificial Sequence
  Description of Artificial Sequence: Synthetic peptide
  XENP020855 vlCDR3
KQSYSLRT

SEQ ID NO: 36397 - protein, 446 aa, Artificial Sequence; identical to SEQ ID NO: 36387
  Description of Artificial Sequence: Synthetic polypeptide
  XENP020856 3H3_H2L2_IgG1_PVA_/S267K Heavy Chain

SEQ ID NO: 36398 - protein, 117 aa, Artificial Sequence; identical to SEQ ID NO: 36388
  Description of Artificial Sequence: Synthetic polypeptide
  VH of XENP020856

SEQ ID NO: 36399 - protein, 5 aa, Artificial Sequence
  Description of Artificial Sequence: Synthetic peptide
  XENP020856 vhCDR1
GYGVN

SEQ ID NO: 36400 - protein, 16 aa, Artificial Sequence
  Description of Artificial Sequence: Synthetic peptide
  XENP020856 vhCDR2
MIWGDGSTDYNSALKS

SEQ ID NO: 36401 - protein, 9 aa, Artificial Sequence
  Description of Artificial Sequence: Synthetic peptide
  XENP020856 vhCDR3
SYYTSDFDY

SEQ ID NO: 36402 - protein, 219 aa, Artificial Sequence; identical to SEQ ID NO: 36382
  Description of Artificial Sequence: Synthetic polypeptide
  XENP020856 3H3_H2L2_IgG1_PVA_/S267K Light Chain

SEQ ID NO: 36403 - protein, 112 aa, Artificial Sequence; identical to SEQ ID NO: 36383
  Description of Artificial Sequence: Synthetic polypeptide
  VL of XENP020856

SEQ ID NO: 36404 - protein, 17 aa, Artificial Sequence
  Description of Artificial Sequence: Synthetic peptide
  XENP020856 vlCDR1
KSSQSLLNSRTRKNYLA

SEQ ID NO: 36405 - protein, 7 aa, Artificial Sequence
  Description of Artificial Sequence: Synthetic peptide
  XENP020856 vlCDR2
WASTRES

SEQ ID NO: 36406 - protein, 8 aa, Artificial Sequence
  Description of Artificial Sequence: Synthetic peptide
  XENP020856 vlCDR3
KQSYSLRT

SEQ ID NO: 36407 - protein, 446 aa, Artificial Sequence
  Description of Artificial Sequence: Synthetic polypeptide
  XENP020857 3H3_H3L1_IgG1_PVA_/S267K Heavy Chain
EVQLLESGGGLVQPGGSLRLSCAVSGFSLNGYGVNWVRQAPGKGLEWVSMIWGDGSTDYNSAVKGRFTISKDNSKSTVYLQMNSLRAEDTAVYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36408 - protein, 117 aa, Artificial Sequence
  Description of Artificial Sequence: Synthetic polypeptide
  VH of XENP020857
EVQLLESGGGLVQPGGSLRLSCAVSGFSLNGYGVNWVRQAPGKGLEWVSMIWGDGSTDYNSAVKGRFTISKDNSKSTVYLQMNSLRAEDTAVYYCARSYYTSDEDYWGQGTLVTVSS

SEQ ID NO: 36409 - protein, 5 aa, Artificial Sequence
  Description of Artificial Sequence: Synthetic peptide
  XENP020857 vhCDR1
GYGVN

SEQ ID NO: 36410 - protein, 16 aa, Artificial Sequence
  Description of Artificial Sequence: Synthetic peptide
  XENP020857 vhCDR2
MIWGDGSTDYNSAVKG

SEQ ID NO: 36411 - protein, 9 aa, Artificial Sequence
  Description of Artificial Sequence: Synthetic peptide
  XENP020857 vhCDR3
SYYTSDEDY

SEQ ID NO: 36412 - protein, 219 aa, Artificial Sequence; identical to SEQ ID NO: 36372
  Description of Artificial Sequence: Synthetic polypeptide
  XENP020857 3H3_H3L1_IgG1_PVA_/S267K Light Chain

SEQ ID NO: 36413 - protein, 112 aa, Artificial Sequence; identical to SEQ ID NO: 36373
  Description of Artificial Sequence: Synthetic polypeptide
  VL of XENP020857

SEQ ID NO: 36414 - protein, 17 aa, Artificial Sequence
  Description of Artificial Sequence: Synthetic peptide
  XENP020857 vlCDR1
RSSQSLLNSRTRKNYLA

SEQ ID NO: 36415 - protein, 7 aa, Artificial Sequence
  Description of Artificial Sequence: Synthetic peptide
  XENP020857 vlCDR2
WASTRES

SEQ ID NO: 36416 - protein, 8 aa, Artificial Sequence
  Description of Artificial Sequence: Synthetic peptide
  XENP020857 vlCDR3
KQSYSLRT

SEQ ID NO: 36417 - protein, 446 aa, Artificial Sequence; identical to SEQ ID NO: 36407
  Description of Artificial Sequence: Synthetic polypeptide
  XENP020858 3H3_H3L2_IgG1_PVA_/S267K Heavy Chain

SEQ ID NO: 36418 - protein, 117 aa, Artificial Sequence; identical to SEQ ID NO: 36408
  Description of Artificial Sequence: Synthetic polypeptide
  VH of XENP020858

SEQ ID NO: 36419 - protein, 5 aa, Artificial Sequence
  Description of Artificial Sequence: Synthetic peptide
  XENP020858 vhCDR1
GYGVN

SEQ ID NO: 36420 - protein, 16 aa, Artificial Sequence
  Description of Artificial Sequence: Synthetic peptide
  XENP020858 vhCDR2
MIWGDGSTDYNSAVKG

SEQ ID NO: 36421 - protein, 9 aa, Artificial Sequence
  Description of Artificial Sequence: Synthetic peptide
  XENP020858 vhCDR3
SYYTSDEDY

SEQ ID NO: 36422 - protein, 219 aa, Artificial Sequence; identical to SEQ ID NO: 36382
  Description of Artificial Sequence: Synthetic polypeptide
  XENP020858 3H3_H3L2_IgG1_PVA_/S267K Light Chain

SEQ ID NO: 36423 - protein, 112 aa, Artificial Sequence; identical to SEQ ID NO: 36383
  Description of Artificial Sequence: Synthetic polypeptide
  VL of XENP020858

SEQ ID NO: 36424 - protein, 17 aa, Artificial Sequence
  Description of Artificial Sequence: Synthetic peptide
  XENP020858 vlCDR1
KSSQSLLNSRTRKNYLA

SEQ ID NO: 36425 - protein, 7 aa, Artificial Sequence
  Description of Artificial Sequence: Synthetic peptide
  XENP020858 vlCDR2
WASTRES

SEQ ID NO: 36426 - protein, 8 aa, Artificial Sequence
  Description of Artificial Sequence: Synthetic peptide
  XENP020858 vlCDR3
KQSYSLRT

SEQ ID NO: 36427 - protein, 446 aa, Artificial Sequence
  Description of Artificial Sequence: Synthetic polypeptide
  XENP020859 3H3_H4L1_IgG1_PVA_/S267K Heavy Chain
QVQLQESGPGLVKPSETLSLTCTVSGFSLNGYGVNWVRQPPGKGLEWIGMIWGDGSTDYNPSLKSRVTISKDNSKSQVSLKLSSVTAADTAVYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36428 - protein, 117 aa, Artificial Sequence
  Description of Artificial Sequence: Synthetic polypeptide
  VH of XENP020859
QVQLQESGPGLVKPSETLSLTCTVSGFSLNGYGVNWVRQPPGKGLEWIGMIWGDGSTDYNPSLKSRVTISKDNSKSQVSLKLSSVTAADTAVYYCARSYYTSDEDYWGQGTLVTVSS

SEQ ID NO: 36429 - protein, 5 aa, Artificial Sequence
  Description of Artificial Sequence: Synthetic peptide
  XENP020859 vhCDR1
GYGVN

SEQ ID NO: 36430 - protein, 16 aa, Artificial Sequence
  Description of Artificial Sequence: Synthetic peptide
  XENP020859 vhCDR2
MIWGDGSTDYNPSLKS

SEQ ID NO: 36431 - protein, 9 aa, Artificial Sequence
  Description of Artificial Sequence: Synthetic peptide
  XENP020859 vhCDR3
SYYTSDEDY

SEQ ID NO: 36432 - protein, 219 aa, Artificial Sequence; identical to SEQ ID NO: 36372
  Description of Artificial Sequence: Synthetic polypeptide
  XENP020859 3H3_H4L1_IgG1_PVA_/S267K Light Chain

SEQ ID NO: 36433 - protein, 112 aa, Artificial Sequence; identical to SEQ ID NO: 36373
  Description of Artificial Sequence: Synthetic polypeptide
  VL of XENP020859

SEQ ID NO: 36434 - protein, 17 aa, Artificial Sequence
  Description of Artificial Sequence: Synthetic peptide
  XENP020859 vlCDR1
RSSQSLLNSRTRKNYLA

SEQ ID NO: 36435 - protein, 7 aa, Artificial Sequence
  Description of Artificial Sequence: Synthetic peptide
  XENP020859 vlCDR2
WASTRES

SEQ ID NO: 36436 - protein, 8 aa, Artificial Sequence
  Description of Artificial Sequence: Synthetic peptide
  XENP020859 vlCDR3
KQSYSLRT

SEQ ID NO: 36437 - protein, 446 aa, Artificial Sequence; identical to SEQ ID NO: 36427
  Description of Artificial Sequence: Synthetic polypeptide
  XENP020860 3H3_H4L2_IgG1_PVA_/S267K Heavy Chain

SEQ ID NO: 36438 - protein, 117 aa, Artificial Sequence; identical to SEQ ID NO: 36428
  Description of Artificial Sequence: Synthetic polypeptide
  VH of XENP020860

SEQ ID NO: 36439 - protein, 5 aa, Artificial Sequence
  Description of Artificial Sequence: Synthetic peptide
  XENP020860 vhCDR1
GYGVN

SEQ ID NO: 36440 - protein, 16 aa, Artificial Sequence
  Description of Artificial Sequence: Synthetic peptide
  XENP020860 vhCDR2
MIWGDGSTDYNPSLKS

SEQ ID NO: 36441 - protein, 9 aa, Artificial Sequence
  Description of Artificial Sequence: Synthetic peptide
  XENP020860 vhCDR3
SYYTSDEDY

SEQ ID NO: 36442 - protein, 219 aa, Artificial Sequence; identical to SEQ ID NO: 36382
  Description of Artificial Sequence: Synthetic polypeptide
  XENP020860 3H3_H4L2_IgG1_PVA_/S267K Light Chain

SEQ ID NO: 36443 - protein, 112 aa, Artificial Sequence; identical to SEQ ID NO: 36383
  Description of Artificial Sequence: Synthetic polypeptide
  VL of XENP020860

SEQ ID NO: 36444 - protein, 17 aa, Artificial Sequence
  Description of Artificial Sequence: Synthetic peptide
  XENP020860 vlCDR1
KSSQSLLNSRTRKNYLA

SEQ ID NO: 36445 - protein, 7 aa, Artificial Sequence
  Description of Artificial Sequence: Synthetic peptide
  XENP020860 vlCDR2
WASTRES

SEQ ID NO: 36446 - protein, 8 aa, Artificial Sequence
  Description of Artificial Sequence: Synthetic peptide
  XENP020860 vlCDR3
KQSYSLRT

SEQ ID NO: 36447 - protein, 447 aa, Artificial Sequence
  Description of Artificial Sequence: Synthetic polypeptide
  XENP020861 7B11_H1L1_IgG1_PVA_/S267K Heavy Chain
QVQLVQSGAEVKKPGASVKVSCKVSGFSLTSYAVNWVRQAPGQGLEWMGVIWSGGSTDYNAKFQGRVTMTKDNSKSTVYMELSSLRSEDTAVYYCVSLYYRYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36448 - protein, 118 aa, Artificial Sequence
  Description of Artificial Sequence: Synthetic polypeptide
  VH of XENP020861
QVQLVQSGAEVKKPGASVKVSCKVSGFSLTSYAVNWVRQAPGQGLEWMGVIWSGGSTDYNAKFQGRVTMTKDNSKSTVYMELSSLRSEDTAVYYCVSLYYRYDGFDYWGQGTLVTVSS

SEQ ID NO: 36449 - protein, 5 aa, Artificial Sequence
  Description of Artificial Sequence: Synthetic peptide
  XENP020861 vhCDR1
SYAVN

SEQ ID NO: 36450 - protein, 16 aa, Artificial Sequence
  Description of Artificial Sequence: Synthetic peptide
  XENP020861 vhCDR2
VIWSGGSTDYNAKFQG

SEQ ID NO: 36451 - protein, 10 aa, Artificial Sequence
  Description of Artificial Sequence: Synthetic peptide
  XENP020861 vhCDR3
LYYRYDGFDY

SEQ ID NO: 36452 - protein, 214 aa, Artificial Sequence
  Description of Artificial Sequence: Synthetic polypeptide
  XENP020861 7B11_H1L1_IgG1_PVA_/S267K Light Chain
DIVLTQSPSSLSASVGDRVTITCRASQNVGTHVARYQQKPGKSPKALVYSASYRYSGVPDRFTGSGSGTDFTLTISSLQPEDFATYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36453 - protein, 107 aa, Artificial Sequence
  Description of Artificial Sequence: Synthetic polypeptide
  VL of XENP020861
DIVLTQSPSSLSASVGDRVTITCRASQNVGTHVARYQQKPGKSPKALVYSASYRYSGVPDRFTGSGSGTDFTLTISSLQPEDFATYFCQQYNSYPLTFGGGTKVEIK

SEQ ID NO: 36454 - protein, 11 aa, Artificial Sequence
  Description of Artificial Sequence: Synthetic peptide
  XENP020861 vlCDR1
RASQNVGTHVA

SEQ ID NO: 36455 - protein, 7 aa, Artificial Sequence
  Description of Artificial Sequence: Synthetic peptide
  XENP020861 vlCDR2
SASYRYS

SEQ ID NO: 36456 - protein, 9 aa, Artificial Sequence
  Description of Artificial Sequence: Synthetic peptide
  XENP020861 vlCDR3
QQYNSYPLT

SEQ ID NO: 36457 - protein, 447 aa, Artificial Sequence; identical to SEQ ID NO: 36447
  Description of Artificial Sequence: Synthetic polypeptide
  XENP020862 7B11_H1L2_IgG1_PVA_/S267K Heavy Chain

SEQ ID NO: 36458 - protein, 118 aa, Artificial Sequence; identical to SEQ ID NO: 36448
  Description of Artificial Sequence: Synthetic polypeptide
  VH of XENP020862

SEQ ID NO: 36459 - protein, 5 aa, Artificial Sequence
  Description of Artificial Sequence: Synthetic peptide
  XENP020862 vhCDR1
SYAVN

SEQ ID NO: 36460 - protein, 16 aa, Artificial Sequence
  Description of Artificial Sequence: Synthetic peptide
  XENP020862 vhCDR2
VIWSGGSTDYNAKFQG

SEQ ID NO: 36461 - protein, 10 aa, Artificial Sequence
  Description of Artificial Sequence: Synthetic peptide
  XENP020862 vhCDR3
LYYRYDGFDY

SEQ ID NO: 36462 - protein, 214 aa, Artificial Sequence
  Description of Artificial Sequence: Synthetic polypeptide
  XENP020862 7B11_H1L2_IgG1_PVA_/S267K Light Chain
DIVLTQSPDSLAVSLGERATINCKASQNVGTHVARYQQKPGQSPKALVYSASYRYSGVPDRFTGSGSGTDFTLTISSLQAEDVAVYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36463 - protein, 107 aa, Artificial Sequence
  Description of Artificial Sequence: Synthetic polypeptide
  VL of XENP020862
DIVLTQSPDSLAVSLGERATINCKASQNVGTHVARYQQKPGQSPKALVYSASYRYSGVPDRFTGSGSGTDFTLTISSLQAEDVAVYFCQQYNSYPLTFGGGTKVEIK

SEQ ID NO: 36464 - protein, 11 aa, Artificial Sequence
  Description of Artificial Sequence: Synthetic peptide
  XENP020862 vlCDR1
KASQNVGTHVA

SEQ ID NO: 36465 - protein, 7 aa, Artificial Sequence
  Description of Artificial Sequence: Synthetic peptide
  XENP020862 vlCDR2
SASYRYS

SEQ ID NO: 36466 - protein, 9 aa, Artificial Sequence
  Description of Artificial Sequence: Synthetic peptide
  XENP020862 vlCDR3
QQYNSYPLT

SEQ ID NO: 36467 - protein, 447 aa, Artificial Sequence
  Description of Artificial Sequence: Synthetic polypeptide
  XENP020863 7B11_H2L1_IgG1_PVA_/S267K Heavy Chain
EVQLVESGGGLVQPGGSLRLSCAVSGFSLTSYAVNWVRQAPGKGLEWVSVIWSGGSTDYNPSVKGRFTISKDNSKSTVYLQLNSLRAEDTAVYYCVSLYYRYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36468 - protein, 118 aa, Artificial Sequence
  Description of Artificial Sequence: Synthetic polypeptide
  VH of XENP020863
EVQLVESGGGLVQPGGSLRLSCAVSGFSLTSYAVNWVRQAPGKGLEWVSVIWSGGSTDYNPSVKGRFTISKDNSKSTVYLQLNSLRAEDTAVYYCVSLYYRYDGFDYWGQGTLVTVSS

SEQ ID NO: 36469 - protein, 5 aa, Artificial Sequence
  Description of Artificial Sequence: Synthetic peptide
  XENP020863 vhCDR1
SYAVN

SEQ ID NO: 36470 - protein, 16 aa, Artificial Sequence
  Description of Artificial Sequence: Synthetic peptide
  XENP020863 vhCDR2
VIWSGGSTDYNPSVKG

SEQ ID NO: 36471 - protein, 10 aa, Artificial Sequence
  Description of Artificial Sequence: Synthetic peptide
  XENP020863 vhCDR3
LYYRYDGFDY

SEQ ID NO: 36472 - protein, 214 aa, Artificial Sequence; identical to SEQ ID NO: 36452
  Description of Artificial Sequence: Synthetic polypeptide
  XENP020863 7B11_H2L1_IgG1_PVA_/S267K Light Chain

SEQ ID NO: 36473 - protein, 107 aa, Artificial Sequence; identical to SEQ ID NO: 36453
  Description of Artificial Sequence: Synthetic polypeptide
  VL of XENP020863

SEQ ID NO: 36474 - protein, 11 aa, Artificial Sequence
  Description of Artificial Sequence: Synthetic peptide
  XENP020863 vlCDR1
RASQNVGTHVA

SEQ ID NO: 36475 - protein, 7 aa, Artificial Sequence
  Description of Artificial Sequence: Synthetic peptide
  XENP020863 vlCDR2
SASYRYS

SEQ ID NO: 36476 - protein, 9 aa, Artificial Sequence
  Description of Artificial Sequence: Synthetic peptide
  XENP020863 vlCDR3
QQYNSYPLT

SEQ ID NO: 36477 - protein, 447 aa, Artificial Sequence; identical to SEQ ID NO: 36467
  Description of Artificial Sequence: Synthetic polypeptide
  XENP020864 7B11_H2L2_IgG1_PVA_/S267K Heavy Chain

SEQ ID NO: 36478 - protein, 118 aa, Artificial Sequence; identical to SEQ ID NO: 36468
  Description of Artificial Sequence: Synthetic polypeptide
  VH of XENP020864

SEQ ID NO: 36479 - protein, 5 aa, Artificial Sequence
  Description of Artificial Sequence: Synthetic peptide
  XENP020864 vhCDR1
SYAVN

SEQ ID NO: 36480 - protein, 16 aa, Artificial Sequence
  Description of Artificial Sequence: Synthetic peptide
  XENP020864 vhCDR2
VIWSGGSTDYNPSVKG

SEQ ID NO: 36481 - protein, 10 aa, Artificial Sequence
  Description of Artificial Sequence: Synthetic peptide
  XENP020864 vhCDR3
LYYRYDGFDY

SEQ ID NO: 36482 - protein, 214 aa, Artificial Sequence; identical to SEQ ID NO: 36462
  Description of Artificial Sequence: Synthetic polypeptide
  XENP020864 7B11_H2L2_IgG1_PVA_/S267K Light Chain

SEQ ID NO: 36483 - protein, 107 aa, Artificial Sequence; identical to SEQ ID NO: 36463
  Description of Artificial Sequence: Synthetic polypeptide
  VL of XENP020864

SEQ ID NO: 36484 - protein, 11 aa, Artificial Sequence
  Description of Artificial Sequence: Synthetic peptide
  XENP020864 vlCDR1
KASQNVGTHVA

SEQ ID NO: 36485 - protein, 7 aa, Artificial Sequence
  Description of Artificial Sequence: Synthetic peptide
  XENP020864 vlCDR2
SASYRYS

SEQ ID NO: 36486 - protein, 9 aa, Artificial Sequence
  Description of Artificial Sequence: Synthetic peptide
  XENP020864 vlCDR3
QQYNSYPLT

SEQ ID NO: 36487 - protein, 446 aa, Artificial Sequence
  Description of Artificial Sequence: Synthetic polypeptide
  XENP020865 7C2_H1L1_IgG1_PVA_/S267K Heavy Chain
EVQVLESGGGLVQPGGSLRLSCAASGFTFSRYAVSWVRQAPGKRLEWVSSISSGGSTYYPDSVKGRFTISRDNSKNTLYLQLNSLRAEDTAVYYCARGDYEGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36488 - protein, 117 aa, Artificial Sequence
  Description of Artificial Sequence: Synthetic polypeptide
  VH of XENP020865
EVQVLESGGGLVQPGGSLRLSCAASGFTFSRYAVSWVRQAPGKRLEWVSSISSGGSTYYPDSVKGRFTISRDNSKNTLYLQLNSLRAEDTAVYYCARGDYEGYFDYWGQGTLVTVSS

SEQ ID NO: 36489 - protein, 5 aa, Artificial Sequence
  Description of Artificial Sequence: Synthetic peptide
  XENP020865 vhCDR1
RYAVS

SEQ ID NO: 36490 - protein, 16 aa, Artificial Sequence
  Description of Artificial Sequence: Synthetic peptide
  XENP020865 vhCDR2
SISSGGSTYYPDSVKG

SEQ ID NO: 36491 - protein, 9 aa, Artificial Sequence
  Description of Artificial Sequence: Synthetic peptide
  XENP020865 vhCDR3
GDYEGYFDY

SEQ ID NO: 36492 - protein, 220 aa, Artificial Sequence
  Description of Artificial Sequence: Synthetic polypeptide
  XENP020865 7C2_H1L1_IgG1_PVA_/S267K Light Chain
DIVLTQSPDSLAVSLGERATINCKSSQSLLNSINQKNYLAGYQQKPGQSPKLLVYFASTRESGVPDRFIGSGSGTDFTLTISSLQAEDVAVYFCQQHYSTPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36493 - protein, 113 aa, Artificial Sequence
  Description of Artificial Sequence: Synthetic polypeptide
  VL of XENP020865
DIVLTQSPDSLAVSLGERATINCKSSQSLLNSINQKNYLAGYQQKPGQSPKLLVYFASTRESGVPDRFIGSGSGTDFTLTISSLQAEDVAVYFCQQHYSTPLTFGAGTKLEIK

SEQ ID NO: 36494 - protein, 17 aa, Artificial Sequence
  Description of Artificial Sequence: Synthetic peptide
  XENP020865 vlCDR1
KSSQSLLNSINQKNYLA

SEQ ID NO: 36495 - protein, 7 aa, Artificial Sequence
  Description of Artificial Sequence: Synthetic peptide
  XENP020865 vlCDR2
FASTRES

SEQ ID NO: 36496 - protein, 9 aa, Artificial Sequence
  Description of Artificial Sequence: Synthetic peptide
  XENP020865 vlCDR3
QQHYSTPLT

SEQ ID NO: 36497 - protein, 446 aa, Artificial Sequence; identical to SEQ ID NO: 36367
  Description of Artificial Sequence: Synthetic polypeptide
  XENP021188 3H3_H1_L1.1_IgG1_PVA_/S267K Heavy Chain

SEQ ID NO: 36498 - protein, 117 aa, Artificial Sequence; identical to SEQ ID NO: 36368
  Description of Artificial Sequence: Synthetic polypeptide
  VH of XENP021188

SEQ ID NO: 36499 - protein, 5 aa, Artificial Sequence
  Description of Artificial Sequence: Synthetic peptide
  XENP021188 vhCDR1
GYGVN

SEQ ID NO: 36500 - protein, 16 aa, Artificial Sequence
  Description of Artificial Sequence: Synthetic peptide
  XENP021188 vhCDR2
MIWGDGSTDYNSALKS

SEQ ID NO: 36501 - protein, 9 aa, Artificial Sequence
  Description of Artificial Sequence: Synthetic peptide
  XENP021188 vhCDR3
SYYTSDEDY

SEQ ID NO: 36502 - protein, 219 aa, Artificial Sequence
  Description of Artificial Sequence: Synthetic polypeptide
  XENP021188 3H3_H1_L1.1_IgG1_PVA_/S267K Light Chain
DIVMTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36503 - protein, 112 aa, Artificial Sequence
  Description of Artificial Sequence: Synthetic polypeptide
  VL of XENP021188
DIVMTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIK

SEQ ID NO: 36504 - protein, 17 aa, Artificial Sequence
  Description of Artificial Sequence: Synthetic peptide
  XENP021188 vlCDR1
RSSQSLLNSRTRKNYLA

SEQ ID NO: 36505 - protein, 7 aa, Artificial Sequence
  Description of Artificial Sequence: Synthetic peptide
  XENP021188 vlCDR2
WASTRES

SEQ ID NO: 36506 - protein, 8 aa, Artificial Sequence
  Description of Artificial Sequence: Synthetic peptide
  XENP021188 vlCDR3
KQSYSLRT

SEQ ID NO: 36507 - protein, 446 aa, Artificial Sequence; identical to SEQ ID NO: 36367
  Description of Artificial Sequence: Synthetic polypeptide
  XENP021189 3H3_H1_L2.1_IgG1_PVA_/S267K Heavy Chain

SEQ ID NO: 36508 - protein, 117 aa, Artificial Sequence; identical to SEQ ID NO: 36368
  Description of Artificial Sequence: Synthetic polypeptide
  VH of XENP021189

SEQ ID NO: 36509 - protein, 5 aa, Artificial Sequence
  Description of Artificial Sequence: Synthetic peptide
  XENP021189 vhCDR1
GYGVN

SEQ ID NO: 36510 - protein, 16 aa, Artificial Sequence
  Description of Artificial Sequence: Synthetic peptide
  XENP021189 vhCDR2
MIWGDGSTDYNSALKS

SEQ ID NO: 36511 - protein, 9 aa, Artificial Sequence
  Description of Artificial Sequence: Synthetic peptide
  XENP021189 vhCDR3
SYYTSDEDY

SEQ ID NO: 36512 - protein, 219 aa, Artificial Sequence
  Description of Artificial Sequence: Synthetic polypeptide
  XENP021189 3H3_H1_L2.1_IgG1_PVA_/S267K Light Chain
DIVMTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36513 - protein, 112 aa, Artificial Sequence
  Description of Artificial Sequence: Synthetic polypeptide
  VL of XENP021189
DIVMTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIK

SEQ ID NO: 36514 - protein, 17 aa, Artificial Sequence
  Description of Artificial Sequence: Synthetic peptide
  XENP021189 vlCDR1
KSSQSLLNSRTRKNYLA

SEQ ID NO: 36515 - protein, 7 aa, Artificial Sequence
  Description of Artificial Sequence: Synthetic peptide
  XENP021189 vlCDR2
WASTRES

SEQ ID NO: 36516 - protein, 8 aa, Artificial Sequence
  Description of Artificial Sequence: Synthetic peptide
  XENP021189 vlCDR3
KQSYSLRT

SEQ ID NO: 36517 - protein, 446 aa, Artificial Sequence; identical to SEQ ID NO: 36387
  Description of Artificial Sequence: Synthetic polypeptide
  XENP021190 3H3_H2_L1.1_IgG1_PVA_/S267K Heavy Chain

SEQ ID NO: 36518 - protein, 117 aa, Artificial Sequence; identical to SEQ ID NO: 36388
  Description of Artificial Sequence: Synthetic polypeptide
  VH of XENP021190

SEQ ID NO: 36519 - protein, 5 aa, Artificial Sequence
  Description of Artificial Sequence: Synthetic peptide
  XENP021190 vhCDR1
GYGVN

SEQ ID NO: 36520 - protein, 16 aa, Artificial Sequence
  Description of Artificial Sequence: Synthetic peptide
  XENP021190 vhCDR2
MIWGDGSTDYNSALKS

SEQ ID NO: 36521 - protein, 9 aa, Artificial Sequence
  Description of Artificial Sequence: Synthetic peptide
  XENP021190 vhCDR3
SYYTSDFDY

SEQ ID NO: 36522 - protein, 219 aa, Artificial Sequence; identical to SEQ ID NO: 36502
  Description of Artificial Sequence: Synthetic polypeptide
  XENP021190 3H3_H2_L1.1_IgG1_PVA_/S267K Light Chain

SEQ ID NO: 36523 - protein, 112 aa, Artificial Sequence; identical to SEQ ID NO: 36503
  Description of Artificial Sequence: Synthetic polypeptide
  VL of XENP021190

SEQ ID NO: 36524 - protein, 17 aa, Artificial Sequence
  Description of Artificial Sequence: Synthetic peptide
  XENP021190 vlCDR1
RSSQSLLNSRTRKNYLA

SEQ ID NO: 36525 - protein, 7 aa, Artificial Sequence
  Description of Artificial Sequence: Synthetic peptide
  XENP021190 vlCDR2
WASTRES

SEQ ID NO: 36526 - protein, 8 aa, Artificial Sequence
  Description of Artificial Sequence: Synthetic peptide
  XENP021190 vlCDR3
KQSYSLRT

SEQ ID NO: 36527 - protein, 446 aa, Artificial Sequence; identical to SEQ ID NO: 36387
  Description of Artificial Sequence: Synthetic polypeptide
  XENP021191 3H3_H2_L2.1_IgG1_PVA_/S267K Heavy Chain

SEQ ID NO: 36528 - protein, 117 aa, Artificial Sequence; identical to SEQ ID NO: 36388
  Description of Artificial Sequence: Synthetic polypeptide
  VH of XENP021191

SEQ ID NO: 36529 - protein, 5 aa, Artificial Sequence
  Description of Artificial Sequence: Synthetic peptide
  XENP021191 vhCDR1
GYGVN

SEQ ID NO: 36530 - protein, 16 aa, Artificial Sequence
  Description of Artificial Sequence: Synthetic peptide
  XENP021191 vhCDR2
MIWGDGSTDYNSALKS

SEQ ID NO: 36531 - protein, 9 aa, Artificial Sequence
  Description of Artificial Sequence: Synthetic peptide
  XENP021191 vhCDR3
SYYTSDFDY

SEQ ID NO: 36532 - protein, 219 aa, Artificial Sequence; identical to SEQ ID NO: 36512
  Description of Artificial Sequence: Synthetic polypeptide
  XENP021191 3H3_H2_L2.1_IgG1_PVA_/S267K Light Chain

SEQ ID NO: 36533 - protein, 112 aa, Artificial Sequence; identical to SEQ ID NO: 36513
  Description of Artificial Sequence: Synthetic polypeptide
  VL of XENP021191

SEQ ID NO: 36534 - protein, 17 aa, Artificial Sequence
  Description of Artificial Sequence: Synthetic peptide
  XENP021191 vlCDR1
KSSQSLLNSRTRKNYLA

SEQ ID NO: 36535 - protein, 7 aa, Artificial Sequence
  Description of Artificial Sequence: Synthetic peptide
  XENP021191 vlCDR2
WASTRES

SEQ ID NO: 36536 - protein, 8 aa, Artificial Sequence
  Description of Artificial Sequence: Synthetic peptide
  XENP021191 vlCDR3
KQSYSLRT

SEQ ID NO: 36537 - protein, 446 aa, Artificial Sequence; identical to SEQ ID NO: 36407
  Description of Artificial Sequence: Synthetic polypeptide
  XENP021192 3H3_H3_L1.1_IgG1_PVA_/S267K Heavy Chain

SEQ ID NO: 36538 - protein, 117 aa, Artificial Sequence; identical to SEQ ID NO: 36408
  Description of Artificial Sequence: Synthetic polypeptide
  VH of XENP021192

SEQ ID NO: 36539 - protein, 5 aa, Artificial Sequence
  Description of Artificial Sequence: Synthetic peptide
  XENP021192 vhCDR1
GYGVN

SEQ ID NO: 36540 - protein, 16 aa, Artificial Sequence
  Description of Artificial Sequence: Synthetic peptide
  XENP021192 vhCDR2
MIWGDGSTDYNSAVKG

SEQ ID NO: 36541 - protein, 9 aa, Artificial Sequence
  Description of Artificial Sequence: Synthetic peptide
  XENP021192 vhCDR3
SYYTSDEDY

SEQ ID NO: 36542 - protein, 219 aa, Artificial Sequence; identical to SEQ ID NO: 36502
  Description of Artificial Sequence: Synthetic polypeptide
  XENP021192 3H3_H3_L1.1_IgG1_PVA_/S267K Light Chain

SEQ ID NO: 36543 - protein, 112 aa, Artificial Sequence; identical to SEQ ID NO: 36503
  Description of Artificial Sequence: Synthetic polypeptide
  VL of XENP021192

SEQ ID NO: 36544 - protein, 17 aa, Artificial Sequence
  Description of Artificial Sequence: Synthetic peptide
  XENP021192 vlCDR1
RSSQSLLNSRTRKNYLA

SEQ ID NO: 36545 - protein, 7 aa, Artificial Sequence
  Description of Artificial Sequence: Synthetic peptide
  XENP021192 vlCDR2
WASTRES

SEQ ID NO: 36546 - protein, 8 aa, Artificial Sequence
  Description of Artificial Sequence: Synthetic peptide
  XENP021192 vlCDR3
KQSYSLRT

SEQ ID NO: 36547 - protein, 446 aa, Artificial Sequence; identical to SEQ ID NO: 36407
  Description of Artificial Sequence: Synthetic polypeptide
  XENP021193 3H3_H3_L2.1_IgG1_PVA_/S267K Heavy Chain

SEQ ID NO: 36548 - protein, 117 aa, Artificial Sequence; identical to SEQ ID NO: 36408
  Description of Artificial Sequence: Synthetic polypeptide
  VH of XENP021193

SEQ ID NO: 36549 - protein, 5 aa, Artificial Sequence
  Description of Artificial Sequence: Synthetic peptide
  XENP021193 vhCDR1
GYGVN

SEQ ID NO: 36550 - protein, 16 aa, Artificial Sequence
  Description of Artificial Sequence: Synthetic peptide
  XENP021193 vhCDR2
MIWGDGSTDYNSAVKG

SEQ ID NO: 36551 - protein, 9 aa, Artificial Sequence
  Description of Artificial Sequence: Synthetic peptide
  XENP021193 vhCDR3
SYYTSDEDY

SEQ ID NO: 36552 - protein, 219 aa, Artificial Sequence; identical to SEQ ID NO: 36512
  Description of Artificial Sequence: Synthetic polypeptide
  XENP021193 3H3_H3_L2.1_IgG1_PVA_/S267K Light Chain

SEQ ID NO: 36553 - protein, 112 aa, Artificial Sequence; identical to SEQ ID NO: 36513
  Description of Artificial Sequence: Synthetic polypeptide
  VL of XENP021193

SEQ ID NO: 36554 - protein, 17 aa, Artificial Sequence
  Description of Artificial Sequence: Synthetic peptide
  XENP021193 vlCDR1
KSSQSLLNSRTRKNYLA

SEQ ID NO: 36555 - protein, 7 aa, Artificial Sequence
  Description of Artificial Sequence: Synthetic peptide
  XENP021193 vlCDR2
WASTRES

SEQ ID NO: 36556 - protein, 8 aa, Artificial Sequence
  Description of Artificial Sequence: Synthetic peptide
  XENP021193 vlCDR3
KQSYSLRT

SEQ ID NO: 36557 - protein, 446 aa, Artificial Sequence; identical to SEQ ID NO: 36427
  Description of Artificial Sequence: Synthetic polypeptide
  XENP021194 3H3_H4_L1.1_IgG1_PVA_/S267K Heavy Chain

SEQ ID NO: 36558 - protein, 117 aa, Artificial Sequence; identical to SEQ ID NO: 36428
  Description of Artificial Sequence: Synthetic polypeptide
  VH of XENP021194

SEQ ID NO: 36559 - protein, 5 aa, Artificial Sequence
  Description of Artificial Sequence: Synthetic peptide
  XENP021194 vhCDR1
GYGVN

SEQ ID NO: 36560 - protein, 16 aa, Artificial Sequence
  Description of Artificial Sequence: Synthetic peptide
  XENP021194 vhCDR2
MIWGDGSTDYNPSLKS

SEQ ID NO: 36561 - protein, 9 aa, Artificial Sequence
  Description of Artificial Sequence: Synthetic peptide
  XENP021194 vhCDR3
SYYTSDEDY

SEQ ID NO: 36562 - protein, 219 aa, Artificial Sequence; identical to SEQ ID NO: 36502
  Description of Artificial Sequence: Synthetic polypeptide
  XENP021194 3H3_H4_L1.1_IgG1_PVA_/S267K Light Chain

SEQ ID NO: 36563 - protein, 112 aa, Artificial Sequence; identical to SEQ ID NO: 36503
  Description of Artificial Sequence: Synthetic polypeptide
  VL of XENP021194

SEQ ID NO: 36564 - protein, 17 aa, Artificial Sequence
  Description of Artificial Sequence: Synthetic peptide
  XENP021194 vlCDR1
RSSQSLLNSRTRKNYLA

SEQ ID NO: 36565 - protein, 7 aa, Artificial Sequence
  Description of Artificial Sequence: Synthetic peptide
  XENP021194 vlCDR2
WASTRES

SEQ ID NO: 36566 - protein, 8 aa, Artificial Sequence
  Description of Artificial Sequence: Synthetic peptide
  XENP021194 vlCDR3
KQSYSLRT

SEQ ID NO: 36567 - protein, 446 aa, Artificial Sequence; identical to SEQ ID NO: 36427
  Description of Artificial Sequence: Synthetic polypeptide
  XENP021195 3H3_H4_L2.1_IgG1_PVA_/S267K Heavy Chain

SEQ ID NO: 36568 - protein, 117 aa, Artificial Sequence; identical to SEQ ID NO: 36428
  Description of Artificial Sequence: Synthetic polypeptide
  VH of XENP021195

SEQ ID NO: 36569 - protein, 5 aa, Artificial Sequence
  Description of Artificial Sequence: Synthetic peptide
  XENP021195 vhCDR1
GYGVN

SEQ ID NO: 36570 - protein, 16 aa, Artificial Sequence
  Description of Artificial Sequence: Synthetic peptide
  XENP021195 vhCDR2
MIWGDGSTDYNPSLKS

SEQ ID NO: 36571 - protein, 9 aa, Artificial Sequence
  Description of Artificial Sequence: Synthetic peptide
  XENP021195 vhCDR3
SYYTSDEDY

SEQ ID NO: 36572 - protein, 219 aa, Artificial Sequence; identical to SEQ ID NO: 36512
  Description of Artificial Sequence: Synthetic polypeptide
  XENP021195 3H3_H4_L2.1_IgG1_PVA_/S267K Light Chain

SEQ ID NO: 36573 - protein, 112 aa, Artificial Sequence; identical to SEQ ID NO: 36513
  Description of Artificial Sequence: Synthetic polypeptide
  VL of XENP021195

SEQ ID NO: 36574 - protein, 17 aa, Artificial Sequence
  Description of Artificial Sequence: Synthetic peptide
  XENP021195 vlCDR1
KSSQSLLNSRTRKNYLA

SEQ ID NO: 36575 - protein, 7 aa, Artificial Sequence
  Description of Artificial Sequence: Synthetic peptide
  XENP021195 vlCDR2
WASTRES

SEQ ID NO: 36576 - protein, 8 aa, Artificial Sequence
  Description of Artificial Sequence: Synthetic peptide
  XENP021195 vlCDR3
KQSYSLRT

SEQ ID NO: 36577 - protein, 447 aa, Artificial Sequence; identical to SEQ ID NO: 36447
  Description of Artificial Sequence: Synthetic polypeptide
  XENP021196 7B11_H1_L1.1_IgG1_PVA_/S267K Heavy Chain

SEQ ID NO: 36578 - protein, 118 aa, Artificial Sequence; identical to SEQ ID NO: 36448
  Description of Artificial Sequence: Synthetic polypeptide
  VH of XENP021196

SEQ ID NO: 36579 - protein, 5 aa, Artificial Sequence
  Description of Artificial Sequence: Synthetic peptide
  XENP021196 vhCDR1
SYAVN

SEQ ID NO: 36580 - protein, 16 aa, Artificial Sequence
  Description of Artificial Sequence: Synthetic peptide
  XENP021196 vhCDR2
VIWSGGSTDYNAKFQG

SEQ ID NO: 36581 - protein, 10 aa, Artificial Sequence
  Description of Artificial Sequence: Synthetic peptide
  XENP021196 vhCDR3
LYYRYDGFDY

SEQ ID NO: 36582 - protein, 214 aa, Artificial Sequence
  Description of Artificial Sequence: Synthetic polypeptide
  XENP021196 7B11_H1_L1.1_IgG1_PVA_/S267K Light Chain
DIVMTQSPSSLSASVGDRVTITCRASQNVGTHVAWYQQKPGKSPKALVYSASYRYSGVPDRFTGSGSGTDFTLTISSLQPEDFATYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36583 - protein, 107 aa, Artificial Sequence
  Description of Artificial Sequence: Synthetic polypeptide
  VL of XENP021196
DIVMTQSPSSLSASVGDRVTITCRASQNVGTHVAWYQQKPGKSPKALVYSASYRYSGVPDRFTGSGSGTDFTLTISSLQPEDFATYFCQQYNSYPLTFGGGTKVEIK

SEQ ID NO: 36584 - protein, 11 aa, Artificial Sequence
  Description of Artificial Sequence: Synthetic peptide
  XENP021196 vlCDR1
RASQNVGTHVA

SEQ ID NO: 36585 - protein, 7 aa, Artificial Sequence
  Description of Artificial Sequence: Synthetic peptide
  XENP021196 vlCDR2
SASYRYS

SEQ ID NO: 36586 - protein, 9 aa, Artificial Sequence
  Description of Artificial Sequence: Synthetic peptide
  XENP021196 vlCDR3
QQYNSYPLT

SEQ ID NO: 36587 - protein, 447 aa, Artificial Sequence; identical to SEQ ID NO: 36447
  Description of Artificial Sequence: Synthetic polypeptide
  XENP021201 7B11_H1_L2.1_IgG1_PVA_/S267K Heavy Chain

SEQ ID NO: 36588 - protein, 118 aa, Artificial Sequence; identical to SEQ ID NO: 36448
  Description of Artificial Sequence: Synthetic polypeptide
  VH of XENP021201

SEQ ID NO: 36589 - protein, 5 aa, Artificial Sequence
  Description of Artificial Sequence: Synthetic peptide
  XENP021201 vhCDR1
SYAVN

SEQ ID NO: 36590 - protein, 16 aa, Artificial Sequence
  Description of Artificial Sequence: Synthetic peptide
  XENP021201 vhCDR2
VIWSGGSTDYNAKFQG

SEQ ID NO: 36591 - protein, 10 aa, Artificial Sequence
  Description of Artificial Sequence: Synthetic peptide
  XENP021201 vhCDR3
LYYRYDGFDY

SEQ ID NO: 36592 - protein, 214 aa, Artificial Sequence
  Description of Artificial Sequence: Synthetic polypeptide
  XENP021201 7B11_H1_L2.1_IgG1_PVA_/S267K Light Chain
DIVMTQSPDSLAVSLGERATINCKASQNVGTHVAWYQQKPGQSPKALVYSASYRYSGVPDRFTGSGSGTDFTLTISSLQAEDVAVYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36593 - protein, 107 aa, Artificial Sequence
  Description of Artificial Sequence: Synthetic polypeptide
  VL of XENP021201
DIVMTQSPDSLAVSLGERATINCKASQNVGTHVAWYQQKPGQSPKALVYSASYRYSGVPDRFTGSGSGTDFTLTISSLQAEDVAVYFCQQYNSYPLTFGGGTKVEIK

SEQ ID NO: 36594 - protein, 11 aa, Artificial Sequence
  Description of Artificial Sequence: Synthetic peptide
  XENP021201 vlCDR1
KASQNVGTHVA

SEQ ID NO: 36595 - protein, 7 aa, Artificial Sequence
  Description of Artificial Sequence: Synthetic peptide
  XENP021201 vlCDR2
SASYRYS

SEQ ID NO: 36596 - protein, 9 aa, Artificial Sequence
  Description of Artificial Sequence: Synthetic peptide
  XENP021201 vlCDR3
QQYNSYPLT

SEQ ID NO: 36597 - protein, 447 aa, Artificial Sequence
  Description of Artificial Sequence: Synthetic polypeptide
  XENP021202 7B11_H2.1_L1.1_IgG1_PVA_/S267K Heavy Chain
EVQLVESGGGLVQPGGSLRLSCAVSGFSLTSYAVNWVRQAPGKGLEWVSVIWSGGSTDYNPSVKGRFTISKDNSKSTVYLQMNSLRAEDTAVYYCVSLYYRYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36598 - protein, 118 aa, Artificial Sequence
  Description of Artificial Sequence: Synthetic polypeptide
  VH of XENP021202
EVQLVESGGGLVQPGGSLRLSCAVSGFSLTSYAVNWVRQAPGKGLEWVSVIWSGGSTDYNPSVKGRFTISKDNSKSTVYLQMNSLRAEDTAVYYCVSLYYRYDGFDYWGQGTLVTVSS

SEQ ID NO: 36599 - protein, 5 aa, Artificial Sequence
  Description of Artificial Sequence: Synthetic peptide
  XENP021202 vhCDR1
SYAVN

SEQ ID NO: 36600 - protein, 16 aa, Artificial Sequence
  Description of Artificial Sequence: Synthetic peptide
  XENP021202 vhCDR2
VIWSGGSTDYNPSVKG

SEQ ID NO: 36601 - protein, 10 aa, Artificial Sequence
  Description of Artificial Sequence: Synthetic peptide
  XENP021202 vhCDR3
LYYRYDGFDY

SEQ ID NO: 36602 - protein, 214 aa, Artificial Sequence; identical to SEQ ID NO: 36582
  Description of Artificial Sequence: Synthetic polypeptide
  XENP021202 7B11_H2.1_L1.1_IgG1_PVA_/S267K Light Chain

SEQ ID NO: 36603 - protein, 107 aa, Artificial Sequence; identical to SEQ ID NO: 36583
  Description of Artificial Sequence: Synthetic polypeptide
  VL of XENP021202

SEQ ID NO: 36604 - protein, 11 aa, Artificial Sequence
  Description of Artificial Sequence: Synthetic peptide
  XENP021202 vlCDR1
RASQNVGTHVA

SEQ ID NO: 36605 - protein, 7 aa, Artificial Sequence
  Description of Artificial Sequence: Synthetic peptide
  XENP021202 vlCDR2
SASYRYS

SEQ ID NO: 36606 - protein, 9 aa, Artificial Sequence
  Description of Artificial Sequence: Synthetic peptide
  XENP021202 vlCDR3
QQYNSYPLT

SEQ ID NO: 36607 - protein, 447 aa, Artificial Sequence; identical to SEQ ID NO: 36597
  Description of Artificial Sequence: Synthetic polypeptide
  XENP021203 7B11_H2.1_L2.1_IgG1_PVA_/S267K Heavy Chain

SEQ ID NO: 36608 - protein, 118 aa, Artificial Sequence; identical to SEQ ID NO: 36598
  Description of Artificial Sequence: Synthetic polypeptide
  VH of XENP021203

SEQ ID NO: 36609 - protein, 5 aa, Artificial Sequence
  Description of Artificial Sequence: Synthetic peptide
  XENP021203 vhCDR1
SYAVN

SEQ ID NO: 36610 - protein, 16 aa, Artificial Sequence
  Description of Artificial Sequence: Synthetic peptide
  XENP021203 vhCDR2
VIWSGGSTDYNPSVKG

SEQ ID NO: 36611 - protein, 10 aa, Artificial Sequence
  Description of Artificial Sequence: Synthetic peptide
  XENP021203 vhCDR3
LYYRYDGFDY

SEQ ID NO: 36612 - protein, 214 aa, Artificial Sequence; identical to SEQ ID NO: 36592
  Description of Artificial Sequence: Synthetic polypeptide
  XENP021203 7B11_H2.1_L2.1_IgG1_PVA_/S267K Light Chain

SEQ ID NO: 36613 - protein, 107 aa, Artificial Sequence; identical to SEQ ID NO: 36593
  Description of Artificial Sequence: Synthetic polypeptide
  VL of XENP021203

SEQ ID NO: 36614 - protein, 11 aa, Artificial Sequence
  Description of Artificial Sequence: Synthetic peptide
  XENP021203 vlCDR1
KASQNVGTHVA

SEQ ID NO: 36615 - protein, 7 aa, Artificial Sequence
  Description of Artificial Sequence: Synthetic peptide
  XENP021203 vlCDR2
SASYRYS

SEQ ID NO: 36616 - protein, 9 aa, Artificial Sequence
  Description of Artificial Sequence: Synthetic peptide
  XENP021203 vlCDR3
QQYNSYPLT

SEQ ID NO: 36617 - protein, 446 aa, Artificial Sequence
  Description of Artificial Sequence: Synthetic polypeptide
  XENP021204 7C2_H1.1_L1.1_IgG1_PVA_/S267K Heavy Chain
EVQVLESGGGLVQPGGSLRLSCAASGFTFSRYAMSWVRQAPGKRLEWVSSISSGGSTYYPDSVKGRFTISRDNSKNTLYLQMNSLRAEDTAVYYCARGDYEGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36618 - protein, 117 aa, Artificial Sequence
  Description of Artificial Sequence: Synthetic polypeptide
  VH of XENP021204
EVQVLESGGGLVQPGGSLRLSCAASGFTFSRYAMSWVRQAPGKRLEWVSSISSGGSTYYPDSVKGRFTISRDNSKNTLYLQMNSLRAEDTAVYYCARGDYEGYFDYWGQGTLVTVSS

SEQ ID NO: 36619 - protein, 5 aa, Artificial Sequence
  Description of Artificial Sequence: Synthetic peptide
  XENP021204 vhCDR1
RYAMS

SEQ ID NO: 36620 - protein, 16 aa, Artificial Sequence
  Description of Artificial Sequence: Synthetic peptide
  XENP021204 vhCDR2
SISSGGSTYYPDSVKG

SEQ ID NO: 36621 - protein, 9 aa, Artificial Sequence
  Description of Artificial Sequence: Synthetic peptide
  XENP021204 vhCDR3
GDYEGYFDY

SEQ ID NO: 36622 - protein, 220 aa, Artificial Sequence
  Description of Artificial Sequence: Synthetic polypeptide
  XENP021204 7C2_H1.1_L1.1_IgG1_PVA_/S267K Light Chain
DIVMTQSPDSLAVSLGERATINCKSSQSLLNSINQKNYLAWYQQKPGQSPKLLVYFASTRESGVPDRFIGSGSGTDFTLTISSLQAEDVAVYFCQQHYSTPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36623 - protein, 113 aa, Artificial Sequence
  Description of Artificial Sequence: Synthetic polypeptide
  VL of XENP021204
DIVMTQSPDSLAVSLGERATINCKSSQSLLNSINQKNYLAWYQQKPGQSPKLLVYFASTRESGVPDRFIGSGSGTDFTLTISSLQAEDVAVYFCQQHYSTPLTFGAGTKLEIK

SEQ ID NO: 36624 - protein, 17 aa, Artificial Sequence
  Description of Artificial Sequence: Synthetic peptide
  XENP021204 vlCDR1
KSSQSLLNSINQKNYLA

SEQ ID NO: 36625 - protein, 7 aa, Artificial Sequence
  Description of Artificial Sequence: Synthetic peptide
  XENP021204 vlCDR2
FASTRES

SEQ ID NO: 36626 - protein, 9 aa, Artificial Sequence
  Description of Artificial Sequence: Synthetic peptide
  XENP021204 vlCDR3
QQHYSTPLT

SEQ ID NO: 36627 - protein, 442 aa, Artificial Sequence
  Description of Artificial Sequence: Synthetic polypeptide
  XENP021492 1D12_H0L0_IgG1_PVA_/S267K Heavy Chain
EVQLVESGGGLVKPGGSLKFSCAASGFAFSSFDMSWVRQTPEKRLEWVAYISSDGASTFYPDTMKGRFTISRDNAKNTLYLQMSSLKSEDTAMYYCTRLGAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36628 - protein, 113 aa, Artificial Sequence
  Description of Artificial Sequence: Synthetic polypeptide
  VH of XENP021492
EVQLVESGGGLVKPGGSLKFSCAASGFAFSSFDMSWVRQTPEKRLEWVAYISSDGASTFYPDTMKGRFTISRDNAKNTLYLQMSSLKSEDTAMYYCTRLGAYWGQGTLVTVSA

SEQ ID NO: 36629 - protein, 5 aa, Artificial Sequence
  Description of Artificial Sequence: Synthetic peptide
  XENP021492 vhCDR1
SFDMS

SEQ ID NO: 36630 - protein, 17 aa, Artificial Sequence
  Description of Artificial Sequence: Synthetic peptide
  XENP021492 vhCDR2
YISSDGASTFYPDTMKG

SEQ ID NO: 36631 - protein, 4 aa, Artificial Sequence
  Description of Artificial Sequence: Synthetic peptide
  XENP021492 vhCDR3
LGAY

SEQ ID NO: 36632 - protein, 218 aa, Artificial Sequence
  Description of Artificial Sequence: Synthetic polypeptide
  XENP021492 1D12_H0L0_IgG1_PVA_/S267K Light Chain
DIVLTQSPASLAVSLGQRATISCRASESVEYYGTSLMQWYQQKPGQPPKLLIYAASNVESGVPARFSGSGSGTDFSLNIHPVEEDDIAMYFCQQSRKVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36633 - protein, 111 aa, Artificial Sequence
  Description of Artificial Sequence: Synthetic polypeptide
  VL of XENP021492
DIVLTQSPASLAVSLGQRATISCRASESVEYYGTSLMQWYQQKPGQPPKLLIYAASNVESGVPARFSGSGSGTDFSLNIHPVEEDDIAMYFCQQSRKVPWTFGGGTKLEIK

SEQ ID NO: 36634 - protein, 15 aa, Artificial Sequence
  Description of Artificial Sequence: Synthetic peptide
  XENP021492 vlCDR1
RASESVEYYGTSLMQ

SEQ ID NO: 36635 - protein, 7 aa, Artificial Sequence
  Description of Artificial Sequence: Synthetic peptide
  XENP021492 vlCDR2
AASNVES

SEQ ID NO: 36636 - protein, 9 aa, Artificial Sequence
  Description of Artificial Sequence: Synthetic peptide
  XENP021492 vlCDR3
QQSRKVPWT

SEQ ID NO: 36637 - protein, 446 aa, Artificial Sequence
  Description of Artificial Sequence: Synthetic polypeptide
  XENP021493 6C8_H0L0_IgG1_PVA_/S267K Heavy Chain
QVQLKESGPGLVAPSQSLSITCTVSGFSLNGYGVNWVRQPPGKGLEWLGMIWGDGSTDYNSALKSRLSISKDNSKSQVFLKMNSLQTDDTARYYCARSYYTSDEDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36638 - protein, 117 aa, Artificial Sequence
  Description of Artificial Sequence: Synthetic polypeptide
  VH of XENP021493
QVQLKESGPGLVAPSQSLSITCTVSGFSLNGYGVNWVRQPPGKGLEWLGMIWGDGSTDYNSALKSRLSISKDNSKSQVFLKMNSLQTDDTARYYCARSYYTSDEDYWGQGTLVTVSA

SEQ ID NO: 36639 - protein, 5 aa, Artificial Sequence
  Description of Artificial Sequence: Synthetic peptide
  XENP021493 vhCDR1
GYGVN

SEQ ID NO: 36640 - protein, 16 aa, Artificial Sequence
  Description of Artificial Sequence: Synthetic peptide
  XENP021493 vhCDR2
MIWGDGSTDYNSALKS

SEQ ID NO: 36641 - protein, 9 aa, Artificial Sequence
  Description of Artificial Sequence: Synthetic peptide
  XENP021493 vhCDR3
SYYTSDEDY

SEQ ID NO: 36642 - protein, 214 aa, Artificial Sequence
  Description of Artificial Sequence: Synthetic polypeptide
  XENP021493 6C8_H0L0_IgG1_PVA_/S267K Light Chain
DIVMTQSQKFMSTSVGDRVSVTCKASQNVGSNVAWCQQKPGQSPKALIYSASFRYSGVPDRFTGSGSGTDFTLTISNVQSEDLAEYFCQQYNSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36643 - protein, 107 aa, Artificial Sequence
  Description of Artificial Sequence: Synthetic polypeptide
  VL of XENP021493
DIVMTQSQKFMSTSVGDRVSVTCKASQNVGSNVAWCQQKPGQSPKALIYSASFRYSGVPDRFTGSGSGTDFTLTISNVQSEDLAEYFCQQYNSYPYTFGGGTKLEIK

SEQ ID NO: 36644 - protein, 11 aa, Artificial Sequence
  Description of Artificial Sequence: Synthetic peptide
  XENP021493 vlCDR1
KASQNVGSNVA

SEQ ID NO: 36645 - protein, 7 aa, Artificial Sequence
  Description of Artificial Sequence: Synthetic peptide
  XENP021493 vlCDR2
SASFRYS

SEQ ID NO: 36646 - protein, 9 aa, Artificial Sequence
  Description of Artificial Sequence: Synthetic peptide
  XENP021493 vlCDR3
QQYNSYPYT

SEQ ID NO: 36647 - protein, 446 aa, Artificial Sequence
  Description of Artificial Sequence: Synthetic polypeptide
  XENP021494 6D9_H0_1D12_L0_IgG1_PVA_/S267K Heavy Chain
QVQLKQSGPGLVQPSQSLSITCTVSGFSLTSYGVHWVRQSPGKGLEWLGVIWSGGSTEYNAAFISRLSISKDNSKSQVFFKMNSLQADDTAIYYCARGGLLSPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36648 - protein, 117 aa, Artificial Sequence
  Description of Artificial Sequence: Synthetic polypeptide
  VH of XENP021494
QVQLKQSGPGLVQPSQSLSITCTVSGFSLTSYGVHWVRQSPGKGLEWLGVIWSGGSTEYNAAFISRLSISKDNSKSQVFFKMNSLQADDTAIYYCARGGLLSPFDYWGQGTTLTVSS

SEQ ID NO: 36649 - protein, 5 aa, Artificial Sequence
  Description of Artificial Sequence: Synthetic peptide
  XENP021494 vhCDR1
SYGVH

SEQ ID NO: 36650 - protein, 16 aa, Artificial Sequence
  Description of Artificial Sequence: Synthetic peptide
  XENP021494 vhCDR2
VIWSGGSTEYNAAFIS

SEQ ID NO: 36651 - protein, 9 aa, Artificial Sequence
  Description of Artificial Sequence: Synthetic peptide
  XENP021494 vhCDR3
GGLLSPFDY

SEQ ID NO: 36652 - protein, 218 aa, Artificial Sequence; identical to SEQ ID NO: 36632
  Description of Artificial Sequence: Synthetic polypeptide
  XENP021494 6D9_H0_1D12_L0_IgG1_PVA_/S267K Light Chain

SEQ ID NO: 36653 - protein, 111 aa, Artificial Sequence; identical to SEQ ID NO: 36633
  Description of Artificial Sequence: Synthetic polypeptide
  VL of XENP021494

SEQ ID NO: 36654 - protein, 15 aa, Artificial Sequence
  Description of Artificial Sequence: Synthetic peptide
  XENP021494 vlCDR1
RASESVEYYGTSLMQ

SEQ ID NO: 36655 - protein, 7 aa, Artificial Sequence
  Description of Artificial Sequence: Synthetic peptide
  XENP021494 vlCDR2
AASNVES

SEQ ID NO: 36656 - protein, 9 aa, Artificial Sequence
  Description of Artificial Sequence: Synthetic peptide
  XENP021494 vlCDR3
QQSRKVPWT

SEQ ID NO: 36657 - protein, 452 aa, Artificial Sequence
  Description of Artificial Sequence: Synthetic polypeptide
  XENP021495 7A9_H0L0_IgG1_PVA_/S267K Heavy Chain
EVKLLESGGGLVQPGGSLKLSCAASGFDFSRYWMSWVRQAPGKGLEWIGEINPDSSTINYTPSLKDKFLISRDNAKNTLYLQMSKVRSEDTALYYCARPNGYYVGTIFPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36658 - protein, 123 aa, Artificial Sequence
  Description of Artificial Sequence: Synthetic polypeptide
  VH of XENP021495
EVKLLESGGGLVQPGGSLKLSCAASGFDFSRYWMSWVRQAPGKGLEWIGEINPDSSTINYTPSLKDKFLISRDNAKNTLYLQMSKVRSEDTALYYCARPNGYYVGTIFPFAYWGQGTLVTVSA

SEQ ID NO: 36659 - protein, 5 aa, Artificial Sequence
  Description of Artificial Sequence: Synthetic peptide
  XENP021495 vhCDR1
RYWMS

SEQ ID NO: 36660 - protein, 17 aa, Artificial Sequence
  Description of Artificial Sequence: Synthetic peptide
  XENP021495 vhCDR2
EINPDSSTINYTPSLKD

SEQ ID NO: 36661 - protein, 14 aa, Artificial Sequence
  Description of Artificial Sequence: Synthetic peptide
  XENP021495 vhCDR3
PNGYYVGTIFPFAY

SEQ ID NO: 36662 - protein, 215 aa, Artificial Sequence
  Description of Artificial Sequence: Synthetic polypeptide
  XENP021495 7A9_H0L0_IgG1_PVA_/S267K Light Chain
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 36663 - protein, 215 aa, Artificial Sequence; identical to SEQ ID NO: 36662
  Description of Artificial Sequence: Synthetic polypeptide
  VL of XENP021495

SEQ ID NO: 36664 - protein, 14 aa, Artificial Sequence
  Description of Artificial Sequence: Synthetic peptide
  XENP021495 vlCDR1
RSSTGAVTTSNYAN

SEQ ID NO: 36665 - protein, 7 aa, Artificial Sequence
  Description of Artificial Sequence: Synthetic peptide
  XENP021495 vlCDR2
GTNNRAP

SEQ ID NO: 36666 - protein, 9 aa, Artificial Sequence
  Description of Artificial Sequence: Synthetic peptide
  XENP021495 vlCDR3
ALWYSNHWV

SEQ ID NO: 36667 - protein, 447 aa, Artificial Sequence; identical to SEQ ID NO: 20835
  Description of Artificial Sequence: Synthetic polypeptide
  XENP021496 7B11_H0L0_IgG1_PVA_/S267K Heavy Chain

SEQ ID NO: 36668 - protein, 118 aa, Artificial Sequence; identical to SEQ ID NO: 20836
  Description of Artificial Sequence: Synthetic polypeptide
  VH of XENP021496

SEQ ID NO: 36669 - protein, 5 aa, Artificial Sequence
  Description of Artificial Sequence: Synthetic peptide
  XENP021496 vhCDR1
SYAVN

SEQ ID NO: 36670 - protein, 16 aa, Artificial Sequence
  Description of Artificial Sequence: Synthetic peptide
  XENP021496 vhCDR2
VIWSGGSTDYNAAFIS

SEQ ID NO: 36671 - protein, 10 aa, Artificial Sequence
  Description of Artificial Sequence: Synthetic peptide
  XENP021496 vhCDR3
LYYRYDGFDY

SEQ ID NO: 36672 - protein, 214 aa, Artificial Sequence
  Description of Artificial Sequence: Synthetic polypeptide
  XENP021496 7B11_H0L0_IgG1_PVA_/S267K Light Chain
DIVMTQSQKFMSTSVGDRVSVTCKASQNVGTHVAWYQQKPGQSPKALVYSASYRYSGVPDRFTGSGSGTDFTLTISNVQSEDLAEYFCQQYNSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36673 - protein, 107 aa, Artificial Sequence
  Description of Artificial Sequence: Synthetic polypeptide
  VL of XENP021496
DIVMTQSQKFMSTSVGDRVSVTCKASQNVGTHVAWYQQKPGQSPKALVYSASYRYSGVPDRFTGSGSGTDFTLTISNVQSEDLAEYFCQQYNSYPLTFGGGTKLEIK

SEQ ID NO: 36674 - protein, 11 aa, Artificial Sequence
  Description of Artificial Sequence: Synthetic peptide
  XENP021496 vlCDR1
KASQNVGTHVA

SEQ ID NO: 36675 - protein, 7 aa, Artificial Sequence
  Description of Artificial Sequence: Synthetic peptide
  XENP021496 vlCDR2
SASYRYS

SEQ ID NO: 36676 - protein, 9 aa, Artificial Sequence
  Description of Artificial Sequence: Synthetic peptide
  XENP021496 vlCDR3
QQYNSYPLT

SEQ ID NO: 36677 - protein, 447 aa, Artificial Sequence; identical to SEQ ID NO: 20845
  Description of Artificial Sequence: Synthetic polypeptide
  XENP021501 7B11var_H0L0_IgG1_PVA_/S267K Heavy Chain

SEQ ID NO: 36678 - protein, 118 aa, Artificial Sequence; identical to SEQ ID NO: 20846
  Description of Artificial Sequence: Synthetic polypeptide
  VH of XENP021501

SEQ ID NO: 36679 - protein, 5 aa, Artificial Sequence
  Description of Artificial Sequence: Synthetic peptide
  XENP021501 vhCDR1
SYAVN

SEQ ID NO: 36680 - protein, 16 aa, Artificial Sequence
  Description of Artificial Sequence: Synthetic peptide
  XENP021501 vhCDR2
VIWSGGSTDYNAAFIS

SEQ ID NO: 36681 - protein, 10 aa, Artificial Sequence
  Description of Artificial Sequence: Synthetic peptide
  XENP021501 vhCDR3
LYYRYDGFDY

SEQ ID NO: 36682 - protein, 214 aa, Artificial Sequence; identical to SEQ ID NO: 36672
  Description of Artificial Sequence: Synthetic polypeptide
  XENP021501 7B11var_H0L0_IgG1_PVA_/S267K Light Chain

SEQ ID NO: 36683 - protein, 107 aa, Artificial Sequence; identical to SEQ ID NO: 36673
  Description of Artificial Sequence: Synthetic polypeptide
  VL of XENP021501

SEQ ID NO: 36684 - protein, 11 aa, Artificial Sequence
  Description of Artificial Sequence: Synthetic peptide
  XENP021501 vlCDR1
KASQNVGTHVA

SEQ ID NO: 36685 - protein, 7 aa, Artificial Sequence
  Description of Artificial Sequence: Synthetic peptide
  XENP021501 vlCDR2
SASYRYS

SEQ ID NO: 36686 - protein, 9 aa, Artificial Sequence
  Description of Artificial Sequence: Synthetic peptide
  XENP021501 vlCDR3
QQYNSYPLT

SEQ ID NO: 36687 - protein, 446 aa, Artificial Sequence
  Description of Artificial Sequence: Synthetic polypeptide
  XENP021502 7C2_H0L0_IgG1_PVA_/S267K Heavy Chain
EVKVVESGGGLVKPGGSLKLSCAASGFTFSRYAMSWVRQTPEKRLEWVASISSGGSTYYPDSVQGRFTISRDNARNILYLQMSSLRSEDTAMYYCARGDYEGYFDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36688 - protein, 117 aa, Artificial Sequence
  Description of Artificial Sequence: Synthetic polypeptide
  VH of XENP021502
EVKVVESGGGLVKPGGSLKLSCAASGFTFSRYAMSWVRQTPEKRLEWVASISSGGSTYYPDSVQGRFTISRDNARNILYLQMSSLRSEDTAMYYCARGDYEGYFDYWGQGTSLTVSS

SEQ ID NO: 36689 - protein, 5 aa, Artificial Sequence
  Description of Artificial Sequence: Synthetic peptide
  XENP021502 vhCDR1
RYAMS

SEQ ID NO: 36690 - protein, 16 aa, Artificial Sequence
  Description of Artificial Sequence: Synthetic peptide
  XENP021502 vhCDR2
SISSGGSTYYPDSVQG

SEQ ID NO: 36691 - protein, 9 aa, Artificial Sequence
  Description of Artificial Sequence: Synthetic peptide
  XENP021502 vhCDR3
GDYEGYFDY

SEQ ID NO: 36692 - protein, 220 aa, Artificial Sequence
  Description of Artificial Sequence: Synthetic polypeptide
  XENP021502 7C2_H0L0_IgG1_PVA_/S267K Light Chain
DIVMTQSPSSLAMSVGQKVTMSCKSSQSLLNSINQKNYLAWYQQKPGQSPKLLVYFASTRESGVPDRFIGSGSGTDFTLTISSVQAEDLADYFCQQHYSTPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36693 - protein, 113 aa, Artificial Sequence
  Description of Artificial Sequence: Synthetic polypeptide
  VL of XENP021502
DIVMTQSPSSLAMSVGQKVTMSCKSSQSLLNSINQKNYLAWYQQKPGQSPKLLVYFASTRESGVPDRFIGSGSGTDFTLTISSVQAEDLADYFCQQHYSTPLTFGAGTKLELK

SEQ ID NO: 36694 - protein, 17 aa, Artificial Sequence
  Description of Artificial Sequence: Synthetic peptide
  XENP021502 vlCDR1
KSSQSLLNSINQKNYLA

SEQ ID NO: 36695 - protein, 7 aa, Artificial Sequence
  Description of Artificial Sequence: Synthetic peptide
  XENP021502 vlCDR2
FASTRES

SEQ ID NO: 36696 - protein, 9 aa, Artificial Sequence
  Description of Artificial Sequence: Synthetic peptide
  XENP021502 vlCDR3
QQHYSTPLT

SEQ ID NO: 36697 - protein, 442 aa, Artificial Sequence; identical to SEQ ID NO: 36627
  Description of Artificial Sequence: Synthetic polypeptide
  XENP021503 1D10_H0L0_IgG1_PVA_/S267K Heavy Chain

SEQ ID NO: 36698 - protein, 113 aa, Artificial Sequence; identical to SEQ ID NO: 36628
  Description of Artificial Sequence: Synthetic polypeptide
  VH of XENP021503

SEQ ID NO: 36699 - protein, 5 aa, Artificial Sequence
  Description of Artificial Sequence: Synthetic peptide
  XENP021503 vhCDR1
SFDMS

SEQ ID NO: 36700 - protein, 17 aa, Artificial Sequence
  Description of Artificial Sequence: Synthetic peptide
  XENP021503 vhCDR2
YISSDGASTFYPDTMKG

SEQ ID NO: 36701 - protein, 4 aa, Artificial Sequence
  Description of Artificial Sequence: Synthetic peptide
  XENP021503 vhCDR3
LGAY

SEQ ID NO: 36702 - protein, 219 aa, Artificial Sequence
  Description of Artificial Sequence: Synthetic polypeptide
  XENP021503 1D10_H0L0_IgG1_PVA_/S267K Light Chain
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36703 - protein, 112 aa, Artificial Sequence
  Description of Artificial Sequence: Synthetic polypeptide
  VL of XENP021503
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIK

SEQ ID NO: 36704 - protein, 16 aa, Artificial Sequence
  Description of Artificial Sequence: Synthetic peptide
  XENP021503 vlCDR1
KSSQSLLDSDGKTYLN

SEQ ID NO: 36705 - protein, 7 aa, Artificial Sequence
  Description of Artificial Sequence: Synthetic peptide
  XENP021503 vlCDR2
LVSKLDS

SEQ ID NO: 36706 - protein, 9 aa, Artificial Sequence
  Description of Artificial Sequence: Synthetic peptide
  XENP021503 vlCDR3
WQGTHFPYT

SEQ ID NO: 36707 - protein, 120 aa, Artificial Sequence
  Description of Artificial Sequence: Synthetic polypeptide
  3C2[BTLA] variable heavy Chain
QVQLQESGPGLVKPSETLSLTCTISGGSISNYYWNWIRQPPGKGLEWIGYIYYSTSTKYNPSLKSRVTMSVETSKNQFSLKLSSVTAADTAVYYCARVKVYSTGWFFDYWGQGTLVTVSS

SEQ ID NO: 36708 - protein, 5 aa, Artificial Sequence
  Description of Artificial Sequence: Synthetic peptide
  3C2[BTLA] vhCDR1
NYYWN

SEQ ID NO: 36709 - protein, 16 aa, Artificial Sequence
  Description of Artificial Sequence: Synthetic peptide
  3C2[BTLA] vhCDR2
YIYYSTSTKYNPSLKS

SEQ ID NO: 36710 - protein, 12 aa, Artificial Sequence
  Description of Artificial Sequence: Synthetic peptide
  3C2[BTLA] vhCDR3
VKVYSTGWFFDY

SEQ ID NO: 36711 - protein, 107 aa, Artificial Sequence [sequence omitted]

SEQ ID NO: 36712 - protein, 11 aa, Artificial Sequence
  Description of Artificial Sequence: Synthetic peptide
  3C2[BTLA] vlCDR1
RASQGISSALA

SEQ ID NO: 36713 - protein, 7 aa, Artificial Sequence
  Description of Artificial Sequence: Synthetic peptide
  3C2[BTLA] vlCDR2
DASSLES

SEQ ID NO: 36714 - protein, 9 aa, Artificial Sequence
  Description of Artificial Sequence: Synthetic peptide
  3C2[BTLA] vlCDR3
QQFNSYPLT

SEQ ID NO: 36715 - protein, 127 aa, Artificial Sequence
  Description of Artificial Sequence: Synthetic polypeptide
  11E2[BTLA] variable heavy Chain
EVQLVESGGGVIRPGGSLRLSCAASGFTFDDYGMSWVRQAPGKGLEWVSGINWNGGSTGYAASVKGRFTISRDNAKNSLYLQMNSLRAEDSALYYCARDYYYGPGSPNYFYYAMDVWGQGTTVTVSS

SEQ ID NO: 36716 - protein, 5 aa, Artificial Sequence
  Description of Artificial Sequence: Synthetic peptide
  11E2[BTLA] vhCDR1
DYGMS

SEQ ID NO: 36717 - protein, 17 aa, Artificial Sequence
  Description of Artificial Sequence: Synthetic peptide
  11E2[BTLA] vhCDR2
GINWNGGSTGYAASVKG

SEQ ID NO: 36718 - protein, 18 aa, Artificial Sequence
  Description of Artificial Sequence: Synthetic peptide
  11E2[BTLA] vhCDR3
DYYYGPGSPNYFYYAMDV

SEQ ID NO: 36719 - protein, 107 aa, Artificial Sequence
  Description of Artificial Sequence: Synthetic polypeptide
  11E2[BTLA] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK

SEQ ID NO: 36720 - protein, 11 aa, Artificial Sequence
  Description of Artificial Sequence: Synthetic peptide
  11E2[BTLA] vlCDR1
RASQGISSWLA

SEQ ID NO: 36721 - protein, 7 aa, Artificial Sequence
  Description of Artificial Sequence: Synthetic peptide
  11E2[BTLA] vlCDR2
AASSLQS

SEQ ID NO: 36722 - protein, 9 aa, Artificial Sequence
  Description of Artificial Sequence: Synthetic peptide
  11E2[BTLA] vlCDR3
QQYNSYPRT

SEQ ID NO: 36723 - protein, 119 aa, Artificial Sequence; identical to SEQ ID NO: 20886
  Description of Artificial Sequence: Synthetic polypeptide
  4C7[BTLA] variable heavy Chain

SEQ ID NO: 36724 - protein, 5 aa, Artificial Sequence
  Description of Artificial Sequence: Synthetic peptide
  4C7[BTLA] vhCDR1
HYYWS

SEQ ID NO: 36725 - protein, 16 aa, Artificial Sequence
  Description of Artificial Sequence: Synthetic peptide
  4C7[BTLA] vhCDR2
YIYYSGSTKYNPSLKS

SEQ ID NO: 36726 - protein, 11 aa, Artificial Sequence
  Description of Artificial Sequence: Synthetic peptide
  4C7[BTLA] vhCDR3
EWPYYYYEMDV

SEQ ID NO: 36727 - protein, 108 aa, Artificial Sequence; identical to SEQ ID NO: 20891
  Description of Artificial Sequence: Synthetic polypeptide
  4C7[BTLA] variable light Chain

SEQ ID NO: 36728 - protein, 12 aa, Artificial Sequence
  Description of Artificial Sequence: Synthetic peptide
  4C7[BTLA] vlCDR1
RASQSVSSSYLA

SEQ ID NO: 36729 - protein, 7 aa, Artificial Sequence
  Description of Artificial Sequence: Synthetic peptide
  4C7[BTLA] vlCDR2
GASSRAT

SEQ ID NO: 36730 - protein, 9 aa, Artificial Sequence
  Description of Artificial Sequence: Synthetic peptide
  4C7[BTLA] vlCDR3
QQYGSSFRT

SEQ ID NO: 36731 - protein, 121 aa, Artificial Sequence; identical to SEQ ID NO: 20896
  Description of Artificial Sequence: Synthetic polypeptide
  8D5[BTLA] variable heavy Chain

SEQ ID NO: 36732 - protein, 5 aa, Artificial Sequence
  Description of Artificial Sequence: Synthetic peptide
  8D5[BTLA] vhCDR1
SYDMH

SEQ ID NO: 36733 - protein, 16 aa, Artificial Sequence
  Description of Artificial Sequence: Synthetic peptide
  8D5[BTLA] vhCDR2
VIGPAGDTYYPGSVKG

SEQ ID NO: 36734 - protein, 13 aa, Artificial Sequence
  Description of Artificial Sequence: Synthetic peptide
  8D5[BTLA] vhCDR3
EGMAAHNYYGMDV

SEQ ID NO: 36735 - protein, 108 aa, Artificial Sequence; identical to SEQ ID NO: 20901
  Description of Artificial Sequence: Synthetic polypeptide
  8D5[BTLA] variable light Chain

SEQ ID NO: 36736 - protein, 11 aa, Artificial Sequence
  Description of Artificial Sequence: Synthetic peptide
  8D5[BTLA] vlCDR1
RASQSVSSYLA

SEQ ID NO: 36737 - protein, 7 aa, Artificial Sequence
  Description of Artificial Sequence: Synthetic peptide
  8D5[BTLA] vlCDR2
DASNRAT

SEQ ID NO: 36738 - protein, 10 aa, Artificial Sequence
  Description of Artificial Sequence: Synthetic peptide
  8D5[BTLA] vlCDR3
QQRSNWPPIT

SEQ ID NO: 36739 - protein, 118 aa, Artificial Sequence; identical to SEQ ID NO: 22
  Description of Artificial Sequence: Synthetic polypeptide
  ipilimumab[CTLA-4] variable heavy Chain

SEQ ID NO: 36740 - protein, 5 aa, Artificial Sequence
  Description of Artificial Sequence: Synthetic peptide
  ipilimumab[CTLA-4] vhCDR1
SYTMH

SEQ ID NO: 36741 - protein, 17 aa, Artificial Sequence
  Description of Artificial Sequence: Synthetic peptide
  ipilimumab[CTLA-4] vhCDR2
FISYDGNNKYYADSVKG

SEQ ID NO: 36742 - protein, 9 aa, Artificial Sequence
  Description of Artificial Sequence: Synthetic peptide
  ipilimumab[CTLA-4] vhCDR3
TGWLGPFDY

SEQ ID NO: 36743 - protein, 108 aa, Artificial Sequence; identical to SEQ ID NO: 23
  Description of Artificial Sequence: Synthetic polypeptide
  ipilimumab[CTLA-4] variable light Chain

SEQ ID NO: 36744 - protein, 12 aa, Artificial Sequence
  Description of Artificial Sequence: Synthetic peptide
  ipilimumab[CTLA-4] vlCDR1
RASQSVGSSYLA

SEQ ID NO: 36745 - protein, 7 aa, Artificial Sequence
  Description of Artificial Sequence: Synthetic peptide
  ipilimumab[CTLA-4] vlCDR2
GAFSRAT

SEQ ID NO: 36746 - protein, 9 aa, Artificial Sequence
  Description of Artificial Sequence: Synthetic peptide
  ipilimumab[CTLA-4] vlCDR3
QQYGSSPWT

SEQ ID NO: 36747 - protein, 125 aa, Artificial Sequence; identical to SEQ ID NO: 22690
  Description of Artificial Sequence: Synthetic polypeptide
  tremelimumab[CTLA-4] variable heavy Chain

SEQ ID NO: 36748 - protein, 5 aa, Artificial Sequence
  Description of Artificial Sequence: Synthetic peptide
  tremelimumab[CTLA-4] vhCDR1
SYGMH

SEQ ID NO: 36749 - protein, 17 aa, Artificial Sequence
  Description of Artificial Sequence: Synthetic peptide
  tremelimumab[CTLA-4] vhCDR2
VIWYDGSNKYYADSVKG

SEQ ID NO: 36750 - protein, 16 aa, Artificial Sequence
  Description of Artificial Sequence: Synthetic peptide
  tremelimumab[CTLA-4] vhCDR3
DPRGATLYYYYYGMDV

SEQ ID NO: 36751 - protein, 107 aa, Artificial Sequence; identical to SEQ ID NO: 22691
  Description of Artificial Sequence: Synthetic polypeptide
  tremelimumab[CTLA-4] variable light Chain

SEQ ID NO: 36752 - protein, 11 aa, Artificial Sequence
  Description of Artificial Sequence: Synthetic peptide
  tremelimumab[CTLA-4] vlCDR1
RASQSINSYLD

SEQ ID NO: 36753 - protein, 7 aa, Artificial Sequence
  Description of Artificial Sequence: Synthetic peptide
  tremelimumab[CTLA-4] vlCDR2
AASSLQS

SEQ ID NO: 36754 - protein, 9 aa, Artificial Sequence
  Description of Artificial Sequence: Synthetic peptide
  tremelimumab[CTLA-4] vlCDR3
QQYYSTPFT

SEQ ID NO: 36755 - protein, 118 aa, Artificial Sequence
  Description of Artificial Sequence: Synthetic polypeptide
  AGEN1884[CTLA-4] variable heavy Chain
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVGLMGPFDIWGQGTMVTVSS

SEQ ID NO: 36756 - protein, 5 aa, Artificial Sequence
  Description of Artificial Sequence: Synthetic peptide
  AGEN1884[CTLA-4] vhCDR1
SYSMN

SEQ ID NO: 36757 - protein, 17 aa, Artificial Sequence
  Description of Artificial Sequence: Synthetic peptide
  AGEN1884[CTLA-4] vhCDR2
SISSSSSYIYYADSVKG

SEQ ID NO: 36758 - protein, 9 aa, Artificial Sequence
  Description of Artificial Sequence: Synthetic peptide
  AGEN1884[CTLA-4] vhCDR3
VGLMGPFDI

SEQ ID NO: 36759 - protein, 107 aa, Artificial Sequence
  Description of Artificial Sequence: Synthetic polypeptide
  AGEN1884[CTLA-4] variable light Chain
EIVLTQSPGTLSLSPGERATLSCRASQSVSRYLGWYQQKPGQAPRLLIYGASTRATGIPDRFSGSGSGTDFTLTITRLEPEDFAVYYCQQYGSSPWTFGQGTKVEIK

SEQ ID NO: 36760 - protein, 11 aa, Artificial Sequence
  Description of Artificial Sequence: Synthetic peptide
  AGEN1884[CTLA-4] vlCDR1
RASQSVSRYLG

SEQ ID NO: 36761 - protein, 7 aa, Artificial Sequence
  Description of Artificial Sequence: Synthetic peptide
  AGEN1884[CTLA-4] vlCDR2
GASTRAT

SEQ ID NO: 36762 - protein, 9 aa, Artificial Sequence
  Description of Artificial Sequence: Synthetic peptide
  AGEN1884[CTLA-4] vlCDR3
QQYGSSPWT

SEQ ID NO: 36763 - protein, 116 aa, Artificial Sequence
  Description of Artificial Sequence: Synthetic polypeptide
  4.3F6B5[CTLA-4] variable heavy Chain
EVQLQPSGPVLVKPGASVKISCKASGYTFTDYKIHWVKQSHGKSLEWIGYIYPYSGSSDYNQKFKSKATLTVDNSSTTAYMELRSLTSEDSAVYYCARGGDAMDYWGQGTAVTVSS

SEQ ID NO: 36764 - protein, 5 aa, Artificial Sequence
  Description of Artificial Sequence: Synthetic peptide
  4.3F6B5[CTLA-4] vhCDR1
DYKIH

SEQ ID NO: 36765 - protein, 17 aa, Artificial Sequence
  Description of Artificial Sequence: Synthetic peptide
  4.3F6B5[CTLA-4] vhCDR2
YIYPYSGSSDYNQKFKS

SEQ ID NO: 36766 - protein, 7 aa, Artificial Sequence
  Description of Artificial Sequence: Synthetic peptide
  4.3F6B5[CTLA-4] vhCDR3
GGDAMDY

SEQ ID NO: 36767 - protein, 106 aa, Artificial Sequence
  Description of Artificial Sequence: Synthetic polypeptide
  4.3F6B5[CTLA-4] variable light Chain
DILMTQSPASLSASVGETVTITCGASENIYGALNWYQRKQGKSPQLLIYGATNLADGMSSRFSGSGLGRQYYLKISSLHPDDVATYFCQNILGTWTFGGGTKLEIK

SEQ ID NO: 36768 - protein, 11 aa, Artificial Sequence
  Description of Artificial Sequence: Synthetic peptide
  4.3F6B5[CTLA-4] vlCDR1
GASENIYGALN

SEQ ID NO: 36769 - protein, 7 aa, Artificial Sequence
  Description of Artificial Sequence: Synthetic peptide
  4.3F6B5[CTLA-4] vlCDR2
GATNLAD

SEQ ID NO: 36770 - protein, 8 aa, Artificial Sequence
  Description of Artificial Sequence: Synthetic peptide
  4.3F6B5[CTLA-4] vlCDR3
QNILGTWT

SEQ ID NO: 36771 - protein, 117 aa, Artificial Sequence
  Description of Artificial Sequence: Synthetic polypeptide
  4.8H10H5[CTLA-4] variable heavy Chain
DVKLVESGGGLVKLGGSLKLSCAASGFTFNIYYMSWVRQTPEKRLELVAAINPDGGNTYYPDTVKGRFTISRDNAKNTLYLQMSSLKSEDSALYYCARYGGPGFDSWGQGTTLTVSS

SEQ ID NO: 36772 - protein, 5 aa, Artificial Sequence
  Description of Artificial Sequence: Synthetic peptide
  4.8H10H5[CTLA-4] vhCDR1
IYYMS

SEQ ID NO: 36773 - protein, 17 aa, Artificial Sequence
  Description of Artificial Sequence: Synthetic peptide
  4.8H10H5[CTLA-4] vhCDR2
AINPDGGNTYYPDTVKG

SEQ ID NO: 36774 - protein, 8 aa, Artificial Sequence
  Description of Artificial Sequence: Synthetic peptide
  4.8H10H5[CTLA-4] vhCDR3
YGGPGFDS

SEQ ID NO: 36775 - protein, 108 aa, Artificial Sequence
  Description of Artificial Sequence: Synthetic polypeptide
  4.8H10H5[CTLA-4] variable light Chain
ENVLTQSPAIMSASPGERVTMTCSASSSVSYMHWYQQKSNTSPKLWIYDTSKLASGVPGRFSGSGSRNSYSLTISSMEAEDVATYYCFPGSGFPFMYTFGGGTKLEIK

SEQ ID NO: 36776 - protein, 10 aa, Artificial Sequence
  Description of Artificial Sequence: Synthetic peptide
  4.8H10H5[CTLA-4] vlCDR1
SASSSVSYMH

SEQ ID NO: 36777 - protein, 7 aa, Artificial Sequence
  Description of Artificial Sequence: Synthetic peptide
  4.8H10H5[CTLA-4] vlCDR2
DTSKLAS

SEQ ID NO: 36778 - protein, 11 aa, Artificial Sequence
  Description of Artificial Sequence: Synthetic peptide
  4.8H10H5[CTLA-4] vlCDR3
FPGSGFPFMYT

SEQ ID NO: 36779 - protein, 116 aa, Artificial Sequence
  Description of Artificial Sequence: Synthetic polypeptide
  TGN2122.C[CTLA-4] variable heavy Chain
QVQLVQSGAEVKKPGASVKVSCKASGYTFTDYKIHWVRQAPGQGLEWIGYIYPYSGSSDYNQKFKSRATLTVDNSISTAYMELSRLRSDDTAVYYCARGGDAMDYWGQGTLVTVSS

SEQ ID NO: 36780 - protein, 5 aa, Artificial Sequence
  Description of Artificial Sequence: Synthetic peptide
  TGN2122.C[CTLA-4] vhCDR1
DYKIH

SEQ ID NO: 36781 - protein, 17 aa, Artificial Sequence
  Description of Artificial Sequence: Synthetic peptide
  TGN2122.C[CTLA-4] vhCDR2
YIYPYSGSSDYNQKFKS

SEQ ID NO: 36782 - protein, 7 aa, Artificial Sequence
  Description of Artificial Sequence: Synthetic peptide
  TGN2122.C[CTLA-4] vhCDR3
GGDAMDY

SEQ ID NO: 36783 - protein, 106 aa, Artificial Sequence
  Description of Artificial Sequence: Synthetic polypeptide
  TGN2122.C[CTLA-4] variable light Chain
DIQMTQSPSSLSASVGDRVTITCGASENIYGALNWYQRKPGKAPKLLIYGATNLADGVPSRFSGSGSGRDYTLTISSLQPEDFATYFCQNILGTWTFGGGTKVEIK

SEQ ID NO: 36784 - protein, 11 aa, Artificial Sequence
  Description of Artificial Sequence: Synthetic peptide
  TGN2122.C[CTLA-4] vlCDR1
GASENIYGALN

SEQ ID NO: 36785 - protein, 7 aa, Artificial Sequence
  Description of Artificial Sequence: Synthetic peptide
  TGN2122.C[CTLA-4] vlCDR2
GATNLAD

SEQ ID NO: 36786 - protein, 8 aa, Artificial Sequence
  Description of Artificial Sequence: Synthetic peptide
  TGN2122.C[CTLA-4] vlCDR3
QNILGTWT

SEQ ID NO: 36787 - protein, 117 aa, Artificial Sequence
  Description of Artificial Sequence: Synthetic polypeptide
  TGN2122.H[CTLA-4] variable heavy Chain
EVQLVESGGGLVQPGGSLRLSCAASGFTFNIYYMSWVRQAPGKGLELVAAINPDGGNTYYPDTVKGRFTISRDNAKNSLYLQMNSLRAEDTAVYYCARYGGPGFDSWGQGTLVTVSS

SEQ ID NO: 36788 - protein, 5 aa, Artificial Sequence
  Description of Artificial Sequence: Synthetic peptide
  TGN2122.H[CTLA-4] vhCDR1
IYYMS

SEQ ID NO: 36789 - protein, 17 aa, Artificial Sequence
  Description of Artificial Sequence: Synthetic peptide
  TGN2122.H[CTLA-4] vhCDR2
AINPDGGNTYYPDTVKG

SEQ ID NO: 36790 - protein, 8 aa, Artificial Sequence
  Description of Artificial Sequence: Synthetic peptide
  TGN2122.H[CTLA-4] vhCDR3
YGGPGFDS

SEQ ID NO: 36791 - protein, 108 aa, Artificial Sequence
  Description of Artificial Sequence: Synthetic polypeptide
  TGN2122.H[CTLA-4] variable light Chain
ENVLTQSPATLSLSPGERATLSCSASSSVSYMHWYQQKPGQAPRLWIYDTSKLASGIPARFSGSGSRNDYTLTISSLEPEDFAVYYCFPGSGFPFMYTFGGGTKVEIK

SEQ ID NO: 36792 - protein, 10 aa, Artificial Sequence
  Description of Artificial Sequence: Synthetic peptide
  TGN2122.H[CTLA-4] vlCDR1
SASSSVSYMH

SEQ ID NO: 36793 - protein, 7 aa, Artificial Sequence
  Description of Artificial Sequence: Synthetic peptide
  TGN2122.H[CTLA-4] vlCDR2
DTSKLAS

SEQ ID NO: 36794 - protein, 11 aa, Artificial Sequence
  Description of Artificial Sequence: Synthetic peptide
  TGN2122.H[CTLA-4] vlCDR3
FPGSGFPFMYT

SEQ ID NO: 36795 - protein, 123 aa, Artificial Sequence
  Description of Artificial Sequence: Synthetic polypeptide
  F7[CTLA-4] variable heavy Chain
QVQLVQSGAEVKKPGASVKVSCKASGYAFDGHYMHWVRQAPGQRLEWMGWVDPHSGATNYAQNFQGGVTMTRDTSINTVYMELSSLKSDDTAVYYCARDFYDTSAKSGAFDIWGQGTMVTVSS

SEQ ID NO: 36796 - protein, 5 aa, Artificial Sequence
  Description of Artificial Sequence: Synthetic peptide
  F7[CTLA-4] vhCDR1
GHYMH

SEQ ID NO: 36797 - protein, 17 aa, Artificial Sequence
  Description of Artificial Sequence: Synthetic peptide
  F7[CTLA-4] vhCDR2
WVDPHSGATNYAQNFQG

SEQ ID NO: 36798 - protein, 14 aa, Artificial Sequence
  Description of Artificial Sequence: Synthetic peptide
  F7[CTLA-4] vhCDR3
DFYDTSAKSGAFDI

SEQ ID NO: 36799 - protein, 107 aa, Artificial Sequence
  Description of Artificial Sequence: Synthetic polypeptide
  F7[CTLA-4] variable light Chain
AIQLTQSPSSVSASVGDRVTITCRASQGISSWLAWYQQKPGKAPKLLIYAASSLQSGVPSRFSGSGSGTDFTLTISSLQPEDFATYYCQQVNSFPWAFGQGTKVEIK

SEQ ID NO: 36800 - protein, 11 aa, Artificial Sequence
  Description of Artificial Sequence: Synthetic peptide
  F7[CTLA-4] vlCDR1
RASQGISSWLA

SEQ ID NO: 36801 - protein, 7 aa, Artificial Sequence
  Description of Artificial Sequence: Synthetic peptide
  F7[CTLA-4] vlCDR2
AASSLQS

SEQ ID NO: 36802 - protein, 9 aa, Artificial Sequence
  Description of Artificial Sequence: Synthetic peptide
  F7[CTLA-4] vlCDR3
QQVNSFPWA

SEQ ID NO: 36803 - protein, 121 aa, Artificial Sequence
  Description of Artificial Sequence: Synthetic polypeptide
  E8[CTLA-4] variable heavy Chain
QVQLVQSGAEVKKPGASVKVSCEASGYTFTNYYIHWLRQAPGQGLEWMGIINPSGGSTTYAQKFQGRITMTRDTSTNTLYMELSSLRSEDTAIYYCARRDCRGPSCYFAYWGQGTTVTVSS

SEQ ID NO: 36804 - protein, 5 aa, Artificial Sequence
  Description of Artificial Sequence: Synthetic peptide
  E8[CTLA-4] vhCDR1
NYYIH

SEQ ID NO: 36805 - protein, 17 aa, Artificial Sequence
  Description of Artificial Sequence: Synthetic peptide
  E8[CTLA-4] vhCDR2
IINPSGGSTTYAQKFQG

SEQ ID NO: 36806 - protein, 12 aa, Artificial Sequence
  Description of Artificial Sequence: Synthetic peptide
  E8[CTLA-4] vhCDR3
RDCRGPSCYFAY

SEQ ID NO: 36807 - protein, 107 aa, Artificial Sequence
  Description of Artificial Sequence: Synthetic polypeptide
  E8[CTLA-4] variable light Chain
DIVMTQSPSSLSASVGDRVTITCRASQSISSYLNWYQQKPGKAPKLLIYAASSLQSGVPPRFSGSGSGTEFTLTISSLQPEDFATYYCQQANSFPPTFGQGTKVDIK

SEQ ID NO: 36808 - protein, 11 aa, Artificial Sequence
  Description of Artificial Sequence: Synthetic peptide
  E8[CTLA-4] vlCDR1
RASQSISSYLN

SEQ ID NO: 36809 - protein, 7 aa, Artificial Sequence
  Description of Artificial Sequence: Synthetic peptide
  E8[CTLA-4] vlCDR2
AASSLQS

SEQ ID NO: 36810 - protein, 9 aa, Artificial Sequence
  Description of Artificial Sequence: Synthetic peptide
  E8[CTLA-4] vlCDR3
QQANSFPPT

SEQ ID NO: 36811 - protein, 114 aa, Artificial Sequence
  Description of Artificial Sequence: Synthetic polypeptide
  CT1E1[CTLA-4] variable heavy Chain
EVQLVESGGGLVQPGRSLRLSCRGSNFNFDDLAISWVRQAPGKGLEWLGFVRSKAYGETTDYVASVKGRFTISRDDSKFIAWLQMDSLKTDDTAVYYCTTFNYWGQGTLVTVSS

SEQ ID NO: 36812 - protein, 5 aa, Artificial Sequence
  Description of Artificial Sequence: Synthetic peptide
  CT1E1[CTLA-4] vhCDR1
DLAIS

SEQ ID NO: 36813 - protein, 19 aa, Artificial Sequence
  Description of Artificial Sequence: Synthetic peptide
  CT1E1[CTLA-4] vhCDR2
FVRSKAYGETTDYVASVKG

SEQ ID NO: 36814 - protein, 3 aa, Artificial Sequence
  Description of Artificial Sequence: Synthetic peptide
  CT1E1[CTLA-4] vhCDR3
FNY

SEQ ID NO: 36815 - protein, 108 aa, Artificial Sequence
  Description of Artificial Sequence: Synthetic polypeptide
  CT1E1[CTLA-4] variable light Chain
QPVLTQPPSVSVAPGKTARISCGGNNIASEAVHWYQKKPGQAPVLVIYYDSDRPSGIPERFSGSNSGNTATLRISRVDAGDEADYYCQVWDRTTDQPVFGGGTKLTVL

SEQ ID NO: 36816 - protein, 11 aa, Artificial Sequence
  Description of Artificial Sequence: Synthetic peptide
  CT1E1[CTLA-4] vlCDR1
GGNNIASEAVH

SEQ ID NO: 36817 - protein, 7 aa, Artificial Sequence
  Description of Artificial Sequence: Synthetic peptide
  CT1E1[CTLA-4] vlCDR2
YDSDRPS

SEQ ID NO: 36818 - protein, 11 aa, Artificial Sequence
  Description of Artificial Sequence: Synthetic peptide
  CT1E1[CTLA-4] vlCDR3
QVWDRTTDQPV

SEQ ID NO: 36819 - protein, 120 aa, Artificial Sequence
  Description of Artificial Sequence: Synthetic polypeptide
  BMS-986016[LAG-3] variable heavy Chain
QVQLQQWGAGLLKPSETLSLTCAVYGGSFSDYYWNWIRQPPGKGLEWIGEINHRGSTNSNPSLKSRVTLSLDTSKNQFSLKLRSVTAADTAVYYCAFGYSDYEYNWFDPWGQGTLVTVSS

SEQ ID NO: 36820 - protein, 5 aa, Artificial Sequence
  Description of Artificial Sequence: Synthetic peptide
  BMS-986016[LAG-3] vhCDR1
DYYWN

SEQ ID NO: 36821 - protein, 16 aa, Artificial Sequence
  Description of Artificial Sequence: Synthetic peptide
  BMS-986016[LAG-3] vhCDR2
EINHRGSTNSNPSLKS

SEQ ID NO: 36822 - protein, 12 aa, Artificial Sequence
  Description of Artificial Sequence: Synthetic peptide
  BMS-986016[LAG-3] vhCDR3
GYSDYEYNWFDP

SEQ ID NO: 36823 - protein, 107 aa, Artificial Sequence; identical to SEQ ID NO: 17141
  Description of Artificial Sequence: Synthetic polypeptide
  BMS-986016[LAG-3] variable light Chain

SEQ ID NO: 36824 - protein, 11 aa, Artificial Sequence
  Description of Artificial Sequence: Synthetic peptide
  BMS-986016[LAG-3] vlCDR1
RASQSISSYLA

SEQ ID NO: 36825 - protein, 7 aa, Artificial Sequence
  Description of Artificial Sequence: Synthetic peptide
  BMS-986016[LAG-3] vlCDR2
DASNRAT

SEQ ID NO: 36826 - protein, 9 aa, Artificial Sequence
  Description of Artificial Sequence: Synthetic peptide
  BMS-986016[LAG-3] vlCDR3
QQRSNWPLT

SEQ ID NO: 36827 - protein, 116 aa, Artificial Sequence
  Description of Artificial Sequence: Synthetic polypeptide
  IMP731[LAG-3] variable heavy Chain
QVQLKESGPGLVAPSQSLSITCTVSGFSLTAYGVNWVRQPPGKGLEWLGMIWDDGSTDYNSALKSRLSISKDNSKSQVFLKMNSLQTDDTARYYCAREGDVAFDYWGQGTTLTVSS

SEQ ID NO: 36828 - protein, 5 aa, Artificial Sequence
  Description of Artificial Sequence: Synthetic peptide
  IMP731[LAG-3] vhCDR1
AYGVN

SEQ ID NO: 36829 - protein, 16 aa, Artificial Sequence
  Description of Artificial Sequence: Synthetic peptide
  IMP731[LAG-3] vhCDR2
MIWDDGSTDYNSALKS

SEQ ID NO: 36830 - protein, 8 aa, Artificial Sequence
  Description of Artificial Sequence: Synthetic peptide
  IMP731[LAG-3] vhCDR3
EGDVAFDY

SEQ ID NO: 36831 - protein, 113 aa, Artificial Sequence
  Description of Artificial Sequence: Synthetic polypeptide
  IMP731[LAG-3] variable light Chain
DIVMTQSPSSLAVSVGQKVTMSCKSSQSLLNGSNQKNYLAWYQQKPGQSPKLLVYFASTRDSGVPDRFIGSGSGTDFTLTISSVQAEDLADYFCLQHFGTPPTFGGGTKLEIK

SEQ ID NO: 36832 - protein, 17 aa, Artificial Sequence
  Description of Artificial Sequence: Synthetic peptide
  IMP731[LAG-3] vlCDR1
KSSQSLLNGSNQKNYLA

SEQ ID NO: 36833 - protein, 7 aa, Artificial Sequence
  Description of Artificial Sequence: Synthetic peptide
  IMP731[LAG-3] vlCDR2
FASTRDS

SEQ ID NO: 36834 - protein, 9 aa, Artificial Sequence
  Description of Artificial Sequence: Synthetic peptide
  IMP731[LAG-3] vlCDR3
LQHFGTPPT

SEQ ID NO: 36835 - protein, 123 aa, Artificial Sequence
  Description of Artificial Sequence: Synthetic polypeptide
  13E2[LAG-3] variable heavy Chain
QVTLKESGPGILQPSQTLSLTCSFSGFSLSTSGMGLGWIRQPSGKGLEWLTHIWWDDIKRYNPDLRSRLTISKDTSSSQIFLKIASVDTADTATYYCARIVEGSYSSSYFDVWGAGTTVTVSS

SEQ ID NO: 36836 - protein, 7 aa, Artificial Sequence
  Description of Artificial Sequence: Synthetic peptide
  13E2[LAG-3] vhCDR1
TSGMGLG

SEQ ID NO: 36837 - protein, 16 aa, Artificial Sequence
  Description of Artificial Sequence: Synthetic peptide
  13E2[LAG-3] vhCDR2
HIWWDDIKRYNPDLRS

SEQ ID NO: 36838 - protein, 13 aa, Artificial Sequence
  Description of Artificial Sequence: Synthetic peptide
  13E2[LAG-3] vhCDR3
IVEGSYSSSYFDV

SEQ ID NO: 36839 - protein, 107 aa, Artificial Sequence
  Description of Artificial Sequence: Synthetic polypeptide
  13E2[LAG-3] variable light Chain
DIVMTQPHKFMSTSVEDRVTITCKASQDVIFDVAWYQQKPGQSPKLLIYSASSRVSGVPDRFTGSGSGTDFTFTISSVQAEDLAVYYCQQHYSTPYTFGGGTTLEIK

SEQ ID NO: 36840 - protein, 11 aa, Artificial Sequence
  Description of Artificial Sequence: Synthetic peptide
  13E2[LAG-3] vlCDR1
KASQDVIFDVA

SEQ ID NO: 36841 - protein, 7 aa, Artificial Sequence
  Description of Artificial Sequence: Synthetic peptide
  13E2[LAG-3] vlCDR2
SASSRVS

SEQ ID NO: 36842 - protein, 9 aa, Artificial Sequence
  Description of Artificial Sequence: Synthetic peptide
  13E2[LAG-3] vlCDR3
QQHYSTPYT

SEQ ID NO: 36843 - protein, 123 aa, Artificial Sequence
  Description of Artificial Sequence: Synthetic polypeptide
  34F4[LAG-3] variable heavy Chain
QVTLKESGPGILQPSQTLSLTCSFSGFSLNTSGMGVGWIRQPSGKGLEWLTHIWWDDVKRYNPALKSRLTISKDTSSSQVFLKIASVDTADTATYYCARIEGDTYYDYYFDYWGQGVTLTVSS

SEQ ID NO: 36844 - protein, 7 aa, Artificial Sequence
  Description of Artificial Sequence: Synthetic peptide
  34F4[LAG-3] vhCDR1
TSGMGVG

SEQ ID NO: 36845 - protein, 16 aa, Artificial Sequence
  Description of Artificial Sequence: Synthetic peptide
  34F4[LAG-3] vhCDR2
HIWWDDVKRYNPALKS

SEQ ID NO: 36846 - protein, 13 aa, Artificial Sequence
  Description of Artificial Sequence: Synthetic peptide
  34F4[LAG-3] vhCDR3
IEGDTYYDYYFDY

SEQ ID NO: 36847 - protein, 107 aa, Artificial Sequence
  Description of Artificial Sequence: Synthetic polypeptide
  34F4[LAG-3] variable light Chain
DIVMTQSHKLMSTSVGDGLSITCKASQDVSIAVVWYQQKPGQSPKLLIYSASFRYTGVPDRFTGSGSGTDFTFTISSVQAEDLAVYYCQQHYSIPWTFGGGTKLEIK

SEQ ID NO: 36848 - protein, 11 aa, Artificial Sequence
  Description of Artificial Sequence: Synthetic peptide
  34F4[LAG-3] vlCDR1
KASQDVSIAVV

SEQ ID NO: 36849 - protein, 7 aa, Artificial Sequence
  Description of Artificial Sequence: Synthetic peptide
  34F4[LAG-3] vlCDR2
SASFRYT

SEQ ID NO: 36850 - protein, 9 aa, Artificial Sequence
  Description of Artificial Sequence: Synthetic peptide
  34F4[LAG-3] vlCDR3
QQHYSIPWT

SEQ ID NO: 36851 - protein, 123 aa, Artificial Sequence
  Description of Artificial Sequence: Synthetic polypeptide
  IMP761[LAG-3] variable heavy Chain
QITLKESGPTLVKPTQTLTLTCTFSGFSLSTSGMGLGWIRQPPGKTLEWLTHIWWDDIKRYNPDLRSRLSITKDTSKNQVVLTMTNMDPLDTGTYYCARIVEGSYSSSYFDVWGQGTLVTVSS

SEQ ID NO: 36852 - protein, 7 aa, Artificial Sequence
  Description of Artificial Sequence: Synthetic peptide
  IMP761[LAG-3] vhCDR1
TSGMGLG

SEQ ID NO: 36853 - protein, 16 aa, Artificial Sequence
  Description of Artificial Sequence: Synthetic peptide
  IMP761[LAG-3] vhCDR2
HIWWDDIKRYNPDLRS

SEQ ID NO: 36854 - protein, 13 aa, Artificial Sequence
  Description of Artificial Sequence: Synthetic peptide
  IMP761[LAG-3] vhCDR3
IVEGSYSSSYFDV

SEQ ID NO: 36855 - protein, 107 aa, Artificial Sequence
  Description of Artificial Sequence: Synthetic polypeptide
  IMP761[LAG-3] variable light Chain
DIVMTQTPSSLSASVGDRVTITCKASQDVIFDVAWYQQRPGQAPKLLIYSASSRVSGVPSRFSGSGSGTDFTLTISSLQPEDFATYYCQQHYSTPYTFGQGTRLDIK

SEQ ID NO: 36856 - protein, 11 aa, Artificial Sequence
  Description of Artificial Sequence: Synthetic peptide
  IMP761[LAG-3] vlCDR1
KASQDVIFDVA

SEQ ID NO: 36857 - protein, 7 aa, Artificial Sequence
  Description of Artificial Sequence: Synthetic peptide
  IMP761[LAG-3] vlCDR2
SASSRVS

SEQ ID NO: 36858 - protein, 9 aa, Artificial Sequence
  Description of Artificial Sequence: Synthetic peptide
  IMP761[LAG-3] vlCDR3
QQHYSTPYT

SEQ ID NO: 36859 - protein, 116 aa, Artificial Sequence
  Description of Artificial Sequence: Synthetic polypeptide
  H5L7[LAG-3] variable heavy Chain
QVQLQESGPGLVKPSETLSLTCTVSGFSLTAYGVNWIRQPPGKGLEWIGMIWDDGSTDYDSALKSRVTISVDTSKNQFSLKLSSVTAADTAVYYCAREGDVAFDYWGQGTLVTVSS

SEQ ID NO: 36860 - protein, 5 aa, Artificial Sequence
  Description of Artificial Sequence: Synthetic peptide
  H5L7[LAG-3] vhCDR1
AYGVN

SEQ ID NO: 36861 - protein, 16 aa, Artificial Sequence
  Description of Artificial Sequence: Synthetic peptide
  H5L7[LAG-3] vhCDR2
MIWDDGSTDYDSALKS

SEQ ID NO: 36862 - protein, 8 aa, Artificial Sequence
  Description of Artificial Sequence: Synthetic peptide
  H5L7[LAG-3] vhCDR3
EGDVAFDY

SEQ ID NO: 36863 - protein, 113 aa, Artificial Sequence
  Description of Artificial Sequence: Synthetic polypeptide
  H5L7[LAG-3] variable light Chain
DIQMTQSPSSLSASVGDRVTITCKSSQSLLNPSNQKNYLAWYQQKPGKAPKLLVYFASTRDSGVPSRFSGSGSGTDFTLTISSLQPEDFATYYCLQHFGTPPTFGQGTKLEIK

SEQ ID NO: 36864 - protein, 17 aa, Artificial Sequence
  Description of Artificial Sequence: Synthetic peptide
  H5L7[LAG-3] vlCDR1
KSSQSLLNPSNQKNYLA

SEQ ID NO: 36865 - protein, 7 aa, Artificial Sequence
  Description of Artificial Sequence: Synthetic peptide
  H5L7[LAG-3] vlCDR2
FASTRDS

SEQ ID NO: 36866 - protein, 9 aa, Artificial Sequence
  Description of Artificial Sequence: Synthetic peptide
  H5L7[LAG-3] vlCDR3
LQHFGTPPT

SEQ ID NO: 36867 - protein, 119 aa, Artificial Sequence
  Description of Artificial Sequence: Synthetic polypeptide
  hu22D2[LAG-3] variable heavy Chain
QMQLVQSGPEVKKPGTSVKVSCKASGYTFTDYNVDWVRQARGQRLEWIGDINPNNGGTIYAQKFQERVTITVDKSTSTAYMELSSLRSEDTAVYYCARNYRWFGAMDHWGQGTTVTVSS

SEQ ID NO: 36868 - protein, 5 aa, Artificial Sequence
  Description of Artificial Sequence: Synthetic peptide
  hu22D2[LAG-3] vhCDR1
DYNVD

SEQ ID NO: 36869 - protein, 17 aa, Artificial Sequence
  Description of Artificial Sequence: Synthetic peptide
  hu22D2[LAG-3] vhCDR2
DINPNNGGTIYAQKFQE

SEQ ID NO: 36870 - protein, 10 aa, Artificial Sequence
  Description of Artificial Sequence: Synthetic peptide
  hu22D2[LAG-3] vhCDR3
NYRWFGAMDH

SEQ ID NO: 36871 - protein, 111 aa, Artificial Sequence
  Description of Artificial Sequence: Synthetic polypeptide
  hu22D2[LAG-3] variable light Chain
DIVMTQTPLSLSVTPGQPASISCKASQSLDYEGDSDMNWYLQKPGQPPQLLIYGASNLESGVPDRFSGSGSGTDFTLKISRVEAEDVGVYYCQQSTEDPRTFGGGTKVEIK

SEQ ID NO: 36872 - protein, 15 aa, Artificial Sequence
  Description of Artificial Sequence: Synthetic peptide
  hu22D2[LAG-3] vlCDR1
KASQSLDYEGDSDMN

SEQ ID NO: 36873 - protein, 7 aa, Artificial Sequence
  Description of Artificial Sequence: Synthetic peptide
  hu22D2[LAG-3] vlCDR2
GASNLES

SEQ ID NO: 36874 - protein, 9 aa, Artificial Sequence
  Description of Artificial Sequence: Synthetic peptide
  hu22D2[LAG-3] vlCDR3
QQSTEDPRT

SEQ ID NO: 36875 - protein, 123 aa, Artificial Sequence
  Description of Artificial Sequence: Synthetic polypeptide
  H4sH15482P[LAG-3] variable heavy Chain
QVQLVESGGGVVQPGRSLRLSCVASGFTFSSYGMHWVRQAPGKGLEWVAIIWYDGSNKYYADSVKGRFTISRDNSKNTQYLQMNSLRAEDTAVYYCASVATSGDFDYYGMDVWGQGTTVTVSS

SEQ ID NO: 36876 - protein, 5 aa, Artificial Sequence
  Description of Artificial Sequence: Synthetic peptide
  H4sH15482P[LAG-3] vhCDR1
SYGMH

SEQ ID NO: 36877 - protein, 17 aa, Artificial Sequence
  Description of Artificial Sequence: Synthetic peptide
  H4sH15482P[LAG-3] vhCDR2
IIWYDGSNKYYADSVKG

SEQ ID NO: 36878 - protein, 14 aa, Artificial Sequence
  Description of Artificial Sequence: Synthetic peptide
  H4sH15482P[LAG-3] vhCDR3
VATSGDFDYYGMDV

SEQ ID NO: 36879 - protein, 107 aa, Artificial Sequence
  Description of Artificial Sequence: Synthetic polypeptide
  H4sH15482P[LAG-3] variable light Chain
EIVLTQSPATLSLSPGERTTLSCRASQRISTYLAWYQQKPGQAPRLLIYDASKRATGIPARFSGSGSGTGFTLTISSLEPEDFAVYYCQQRSNWPLTFGGGTKVEIK

SEQ ID NO: 36880 - protein, 11 aa, Artificial Sequence
  Description of Artificial Sequence: Synthetic peptide
  H4sH15482P[LAG-3] vlCDR1
RASQRISTYLA

SEQ ID NO: 36881 - protein, 7 aa, Artificial Sequence
  Description of Artificial Sequence: Synthetic peptide
  H4sH15482P[LAG-3] vlCDR2
DASKRAT

SEQ ID NO: 36882 - protein, 9 aa, Artificial Sequence
  Description of Artificial Sequence: Synthetic peptide
  H4sH15482P[LAG-3] vlCDR3
QQRSNWPLT

SEQ ID NO: 36883 - protein, 119 aa, Artificial Sequence
  Description of Artificial Sequence: Synthetic polypeptide
  L35D4[LAG-3] variable heavy Chain
QVQLVQSGAEVKKPGASVKVSCKASGYTFTSYYMHWVRQAPGQGLEWMGIINPSAGSTSYAQKFQGRVTMTRDTSTSTVYMELSSLRSEDTAVYYCARELMATGGFDYWGQGTLVTVSS

SEQ ID NO: 36884 - protein, 5 aa, Artificial Sequence
  Description of Artificial Sequence: Synthetic peptide
  L35D4[LAG-3] vhCDR1
SYYMH

SEQ ID NO: 36885 - protein, 17 aa, Artificial Sequence
  Description of Artificial Sequence: Synthetic peptide
  L35D4[LAG-3] vhCDR2
IINPSAGSTSYAQKFQG

SEQ ID NO: 36886 - protein, 10 aa, Artificial Sequence
  Description of Artificial Sequence: Synthetic peptide
  L35D4[LAG-3] vhCDR3
ELMATGGFDY

SEQ ID NO: 36887 - protein, 112 aa, Artificial Sequence
  Description of Artificial Sequence: Synthetic polypeptide
  L35D4[LAG-3] variable light Chain
QSVLTQPPSASGSPGQSVTISCTGTSSDVGGYNYVSWYQQYPGKAPRLMIFEVTERASGVPDRFSGSKSGNTASLTVSGLQTEDEAVYFCSSYSGSNNPGAMFGGGTKLTVL

SEQ ID NO: 36888 - protein, 14 aa, Artificial Sequence
  Description of Artificial Sequence: Synthetic peptide
  L35D4[LAG-3] vlCDR1
TGTSSDVGGYNYVS

SEQ ID NO: 36889 - protein, 7 aa, Artificial Sequence
  Description of Artificial Sequence: Synthetic peptide
  L35D4[LAG-3] vlCDR2
EVTERAS

SEQ ID NO: 36890 - protein, 12 aa, Artificial Sequence
  Description of Artificial Sequence: Synthetic peptide
  L35D4[LAG-3] vlCDR3
SSYSGSNNPGAM

SEQ ID NO: 36891 - protein, 119 aa, Artificial Sequence; identical to SEQ ID NO: 36883
  Description of Artificial Sequence: Synthetic polypeptide
  L35G6[LAG-3] variable heavy Chain

SEQ ID NO: 36892 - protein, 5 aa, Artificial Sequence
  Description of Artificial Sequence: Synthetic peptide
  L35G6[LAG-3] vhCDR1
SYYMH

SEQ ID NO: 36893 - protein, 17 aa, Artificial Sequence
  Description of Artificial Sequence: Synthetic peptide
  L35G6[LAG-3] vhCDR2
IINPSAGSTSYAQKFQG

SEQ ID NO: 36894 - protein, 10 aa, Artificial Sequence
  Description of Artificial Sequence: Synthetic peptide
  L35G6[LAG-3] vhCDR3
ELMATGGFDY

SEQ ID NO: 36895 - protein, 110 aa, Artificial Sequence
  Description of Artificial Sequence: Synthetic polypeptide
  L35G6[LAG-3] variable light Chain
QAGLTQPASVSGSPGQSITISCTGSSSDVGGYSYVSWYQKHPGKAPKLMIYDVTNRPSGVSNRFSGSKSGNTASLTISGLQAEDEADYYCSTYTRSNTLVFGPGTKVTVL

SEQ ID NO: 36896 - protein, 14 aa, Artificial Sequence
  Description of Artificial Sequence: Synthetic peptide
  L35G6[LAG-3] vlCDR1
TGSSSDVGGYSYVS

SEQ ID NO: 36897 - protein, 7 aa, Artificial Sequence
  Description of Artificial Sequence: Synthetic peptide
  L35G6[LAG-3] vlCDR2
DVTNRPS

SEQ ID NO: 36898 - protein, 10 aa, Artificial Sequence
  Description of Artificial Sequence: Synthetic peptide
  L35G6[LAG-3] vlCDR3
STYTRSNTLV

SEQ ID NO: 36899 - protein, 119 aa, Artificial Sequence; identical to SEQ ID NO: 36883
  Description of Artificial Sequence: Synthetic polypeptide
  L33H11[LAG-3] variable heavy Chain

SEQ ID NO: 36900 - protein, 5 aa, Artificial Sequence
  Description of Artificial Sequence: Synthetic peptide
  L33H11[LAG-3] vhCDR1
SYYMH

SEQ ID NO: 36901 - protein, 17 aa, Artificial Sequence
  Description of Artificial Sequence: Synthetic peptide
  L33H11[LAG-3] vhCDR2
IINPSAGSTSYAQKFQG

SEQ ID NO: 36902 - protein, 10 aa, Artificial Sequence
  Description of Artificial Sequence: Synthetic peptide
  L33H11[LAG-3] vhCDR3
ELMATGGFDY

SEQ ID NO: 36903 - protein, 110 aa, Artificial Sequence
  Description of Artificial Sequence: Synthetic polypeptide
  L33H11[LAG-3] variable light Chain
LPVLTQPASVSGSPGQSITISCTGTSSDVGGYNYVSWYQQHPGKAPKLMIYDVTNRPSGVSNRFSGSKSGNTASLTISGLQAEDEADYYCSSYTSSNTLLFGGGTQLTVL

SEQ ID NO: 36904 - protein, 14 aa, Artificial Sequence
  Description of Artificial Sequence: Synthetic peptide
  L33H11[LAG-3] vlCDR1
TGTSSDVGGYNYVS

SEQ ID NO: 36905 - protein, 7 aa, Artificial Sequence
  Description of Artificial Sequence: Synthetic peptide
  L33H11[LAG-3] vlCDR2
DVTNRPS

SEQ ID NO: 36906 - protein, 10 aa, Artificial Sequence
  Description of Artificial Sequence: Synthetic peptide
  L33H11[LAG-3] vlCDR3
SSYTSSNTLL

SEQ ID NO: 36907 - protein, 119 aa, Artificial Sequence; identical to SEQ ID NO: 36883
  Description of Artificial Sequence: Synthetic polypeptide
  L32A9[LAG-3] variable heavy Chain

SEQ ID NO: 36908 - protein, 5 aa, Artificial Sequence
  Description of Artificial Sequence: Synthetic peptide
  L32A9[LAG-3] vhCDR1
SYYMH

SEQ ID NO: 36909 - protein, 17 aa, Artificial Sequence
  Description of Artificial Sequence: Synthetic peptide
  L32A9[LAG-3] vhCDR2
IINPSAGSTSYAQKFQG

SEQ ID NO: 36910 - protein, 10 aa, Artificial Sequence
  Description of Artificial Sequence: Synthetic peptide
  L32A9[LAG-3] vhCDR3
ELMATGGFDY

SEQ ID NO: 36911 - protein, 110 aa, Artificial Sequence
  Description of Artificial Sequence: Synthetic polypeptide
  L32A9[LAG-3] variable light Chain
QSVVTQPPSVSAAPGQKVTISCSGSSSNIGNNYVSWYQQLPGTAPKLLIYDNNKRHSGIPDRFSGSTSDTSATLGITRLQTGDEADYYCGTWDSSLSAYVFGTGTKVTVL

SEQ ID NO: 36912 - protein, 13 aa, Artificial Sequence
  Description of Artificial Sequence: Synthetic peptide
  L32A9[LAG-3] vlCDR1
SGSSSNIGNNYVS

SEQ ID NO: 36913 - protein, 7 aa, Artificial Sequence
  Description of Artificial Sequence: Synthetic peptide
  L32A9[LAG-3] vlCDR2
DNNKRHS

SEQ ID NO: 36914 - protein, 11 aa, Artificial Sequence
  Description of Artificial Sequence: Synthetic peptide
  L32A9[LAG-3] vlCDR3
GTWDSSLSAYV

SEQ ID NO: 36915 - protein, 119 aa, Artificial Sequence; identical to SEQ ID NO: 36883
  Description of Artificial Sequence: Synthetic polypeptide
  L32D10[LAG-3] variable heavy Chain

SEQ ID NO: 36916 - protein, 5 aa, Artificial Sequence
  Description of Artificial Sequence: Synthetic peptide
  L32D10[LAG-3] vhCDR1
SYYMH

SEQ ID NO: 36917 - protein, 17 aa, Artificial Sequence
  Description of Artificial Sequence: Synthetic peptide
  L32D10[LAG-3] vhCDR2
IINPSAGSTSYAQKFQG

SEQ ID NO: 36918 - protein, 10 aa, Artificial Sequence
  Description of Artificial Sequence: Synthetic peptide
  L32D10[LAG-3] vhCDR3
ELMATGGFDY

SEQ ID NO: 36919 - protein, 110 aa, Artificial Sequence
  Description of Artificial Sequence: Synthetic polypeptide
  L32D10[LAG-3] variable light Chain
QSVLTQPPSASGSPGQSVTISCTGTSSDVGGYDYVSWYQQHQGKAPKLMIYDVSNRPSGVSNRFSGSKSGNTASLTISGLQAEDEADYYCSSYTSSTTLVFGGGTKLTVL

SEQ ID NO: 36920 - protein, 14 aa, Artificial Sequence
  Description of Artificial Sequence: Synthetic peptide
  L32D10[LAG-3] vlCDR1
TGTSSDVGGYDYVS

SEQ ID NO: 36921 - protein, 7 aa, Artificial Sequence
  Description of Artificial Sequence: Synthetic peptide
  L32D10[LAG-3] vlCDR2
DVSNRPS

SEQ ID NO: 36922 - protein, 10 aa, Artificial Sequence
  Description of Artificial Sequence: Synthetic peptide
  L32D10[LAG-3] vlCDR3
SSYTSSTTLV

SEQ ID NO: 36923 - protein, 119 aa, Artificial Sequence; identical to SEQ ID NO: 36883
  Description of Artificial Sequence: Synthetic polypeptide
  L32A4[LAG-3] variable heavy Chain

SEQ ID NO: 36924 - protein, 5 aa, Artificial Sequence
  Description of Artificial Sequence: Synthetic peptide
  L32A4[LAG-3] vhCDR1
SYYMH

SEQ ID NO: 36925 - protein, 17 aa, Artificial Sequence
  Description of Artificial Sequence: Synthetic peptide
  L32A4[LAG-3] vhCDR2
IINPSAGSTSYAQKFQG

SEQ ID NO: 36926 - protein, 10 aa, Artificial Sequence
  Description of Artificial Sequence: Synthetic peptide
  L32A4[LAG-3] vhCDR3
ELMATGGFDY

SEQ ID NO: 36927 - protein, 110 aa, Artificial Sequence
  Description of Artificial Sequence: Synthetic polypeptide
  L32A4[LAG-3] variable light Chain
QSVLTQPASVSGSPGQSITISCTGTSSDIGAYNFVSWYQQHPGKAPKLMIYGVSNRPSGVSSRFSGSKSGSTASLTISGLQAEDEADYYCSSYTTSGSAVFGTGTKLTVL

SEQ ID NO: 36928 - protein, 14 aa, Artificial Sequence
  Description of Artificial Sequence: Synthetic peptide
  L32A4[LAG-3] vlCDR1
TGTSSDIGAYNFVS

SEQ ID NO: 36929 - protein, 7 aa, Artificial Sequence
  Description of Artificial Sequence: Synthetic peptide
  L32A4[LAG-3] vlCDR2
GVSNRPS

SEQ ID NO: 36930 - protein, 10 aa, Artificial Sequence
  Description of Artificial Sequence: Synthetic peptide
  L32A4[LAG-3] vlCDR3
SSYTTSGSAV

SEQ ID NO: 36931 - protein, 119 aa, Artificial Sequence
  Description of Artificial Sequence: Synthetic polypeptide
  L3A1[LAG-3] variable heavy Chain
EVQLLESGAEVKKPGASVKVSCKASGYTFTSYYMHWVRQAPGQGLEWMGIINPSAGSTSYAQKFQGRVTMTRDTSTSTVYMELSSLRSEDTAVYYCARELMATGGFDYWGQGTLVTVSS

SEQ ID NO: 36932 - protein, 5 aa, Artificial Sequence
  Description of Artificial Sequence: Synthetic peptide
  L3A1[LAG-3] vhCDR1
SYYMH

SEQ ID NO: 36933 - protein, 17 aa, Artificial Sequence
  Description of Artificial Sequence: Synthetic peptide
  L3A1[LAG-3] vhCDR2
IINPSAGSTSYAQKFQG

SEQ ID NO: 36934 - protein, 10 aa, Artificial Sequence
  Description of Artificial Sequence: Synthetic peptide
  L3A1[LAG-3] vhCDR3
ELMATGGFDY

SEQ ID NO: 36935 - protein, 110 aa, Artificial Sequence
  Description of Artificial Sequence: Synthetic polypeptide
  L3A1[LAG-3] variable light Chain
QSVLTQPASVSGSPGQSITISCTGTSSDIGAYNFVSWYQQHPGKAPKLMIYGVSNRPSGVSSRFSGSKSGSTASLTITGLQAEDEADYYCSSYTTSGSAVFGTGTKLTVL

SEQ ID NO: 36936 - protein, 14 aa, Artificial Sequence
  Description of Artificial Sequence: Synthetic peptide
  L3A1[LAG-3] vlCDR1
TGTSSDIGAYNFVS

SEQ ID NO: 36937 - protein, 7 aa, Artificial Sequence
  Description of Artificial Sequence: Synthetic peptide
  L3A1[LAG-3] vlCDR2
GVSNRPS

SEQ ID NO: 36938 - protein, 10 aa, Artificial Sequence
  Description of Artificial Sequence: Synthetic peptide
  L3A1[LAG-3] vlCDR3
SSYTTSGSAV

SEQ ID NO: 36939 - protein, 121 aa, Artificial Sequence
  Description of Artificial Sequence: Synthetic polypeptide
  L3A10[LAG-3] variable heavy Chain
EVQLLESGGGVVQPGRSLRVSCAASGFTFSNHAMHWVRQAPGKGLEWVAVISYDGSKKFYSDSVRGRFTISRDNSKNTLYLQMNSLRPEDTAVYYCAKGAHGYTSGWHDYWGQGTLVTVSS

SEQ ID NO: 36940 - protein, 5 aa, Artificial Sequence
  Description of Artificial Sequence: Synthetic peptide
  L3A10[LAG-3] vhCDR1
NHAMH

SEQ ID NO: 36941 - protein, 17 aa, Artificial Sequence
  Description of Artificial Sequence: Synthetic peptide
  L3A10[LAG-3] vhCDR2
VISYDGSKKFYSDSVRG

SEQ ID NO: 36942 - protein, 12 aa, Artificial Sequence
  Description of Artificial Sequence: Synthetic peptide
  L3A10[LAG-3] vhCDR3
GAHGYTSGWHDY

SEQ ID NO: 36943 - protein, 108 aa, Artificial Sequence
  Description of Artificial Sequence: Synthetic polypeptide
  L3A10[LAG-3] variable light Chain
DVVMTQSPSSLSASVGDRVSITCRASQNIGRYLNWYQQKPGKAPKLLVSAASSLQGGVPSRFSGSGSGTDFTLTISRLQPEDFATYFCQQTYSSPQCTFGQGTKVDIK

SEQ ID NO: 36944 - protein, 11 aa, Artificial Sequence
  Description of Artificial Sequence: Synthetic peptide
  L3A10[LAG-3] vlCDR1
RASQNIGRYLN

SEQ ID NO: 36945 - protein, 7 aa, Artificial Sequence
  Description of Artificial Sequence: Synthetic peptide
  L3A10[LAG-3] vlCDR2
AASSLQG

SEQ ID NO: 36946 - protein, 10 aa, Artificial Sequence
  Description of Artificial Sequence: Synthetic peptide
  L3A10[LAG-3] vlCDR3
QQTYSSPQCT

SEQ ID NO: 36947 - protein, 121 aa, Artificial Sequence
  Description of Artificial Sequence: Synthetic polypeptide
  L3C5[LAG-3] variable heavy Chain
QVQLVQSGSELKKPGASVKVSCKASGYTFTNYYMHWVRQAPGQGLEWMGIINPSGGATNYAQKFQGRVTMTRDTSTSTVYMELSSLRSEDTAVYYCARDSGYDLGYGMDVWGQGTLVTVSS

SEQ ID NO: 36948 - protein, 5 aa, Artificial Sequence
  Description of Artificial Sequence: Synthetic peptide
  L3C5[LAG-3] vhCDR1
NYYMH

SEQ ID NO: 36949 - protein, 17 aa, Artificial Sequence
  Description of Artificial Sequence: Synthetic peptide
  L3C5[LAG-3] vhCDR2
IINPSGGATNYAQKFQG

SEQ ID NO: 36950 - protein, 12 aa, Artificial Sequence
  Description of Artificial Sequence: Synthetic peptide
  L3C5[LAG-3] vhCDR3
DSGYDLGYGMDV

SEQ ID NO: 36951 - protein, 110 aa, Artificial Sequence
  Description of Artificial Sequence: Synthetic polypeptide
  L3C5[LAG-3] variable light Chain
QSVLTQPASVSGSPGQSITISCTGTSSDVGGYNYVSWYQQHPGKAPKLMIYDVSNRPSGASNRFSGSKSGNTASLTISGLQAEDEADYYCSSYTNRNTLLFGGGTKLTVL

SEQ ID NO: 36952 - protein, 14 aa, Artificial Sequence
  Description of Artificial Sequence: Synthetic peptide
  L3C5[LAG-3] vlCDR1
TGTSSDVGGYNYVS

SEQ ID NO: 36953 - protein, 7 aa, Artificial Sequence
  Description of Artificial Sequence: Synthetic peptide
  L3C5[LAG-3] vlCDR2
DVSNRPS

SEQ ID NO: 36954 - protein, 10 aa, Artificial Sequence
  Description of Artificial Sequence: Synthetic peptide
  L3C5[LAG-3] vlCDR3
SSYTNRNTLL

SEQ ID NO: 36955 - protein, 119 aa, Artificial Sequence; identical to SEQ ID NO: 36931
  Description of Artificial Sequence: Synthetic polypeptide
  L3E3[LAG-3] variable heavy Chain

SEQ ID NO: 36956 - protein, 5 aa, Artificial Sequence
  Description of Artificial Sequence: Synthetic peptide
  L3E3[LAG-3] vhCDR1
SYYMH

SEQ ID NO: 36957 - protein, 17 aa, Artificial Sequence
  Description of Artificial Sequence: Synthetic peptide
  L3E3[LAG-3] vhCDR2
IINPSAGSTSYAQKFQG

SEQ ID NO: 36958 - protein, 10 aa, Artificial Sequence
  Description of Artificial Sequence: Synthetic peptide
  L3E3[LAG-3] vhCDR3
ELMATGGFDY

SEQ ID NO: 36959 - protein, 110 aa, Artificial Sequence
  Description of Artificial Sequence: Synthetic polypeptide
  L3E3[LAG-3] variable light Chain
QSVLTQPASASGSPGQSITISCTGTSSDVGGYNYVSWYQQHPGKAPKLMIYDVSNRPSGVSNRFSGSKSGNTASLTISGLQAEDEANYYCSSYTSSSTNVFGTGTKVTVL

SEQ ID NO: 36960 - protein, 14 aa, Artificial Sequence
  Description of Artificial Sequence: Synthetic peptide
  L3E3[LAG-3] vlCDR1
TGTSSDVGGYNYVS

SEQ ID NO: 36961 - protein, 7 aa, Artificial Sequence
  Description of Artificial Sequence: Synthetic peptide
  L3E3[LAG-3] vlCDR2
DVSNRPS

SEQ ID NO: 36962 - protein, 10 aa, Artificial Sequence
  Description of Artificial Sequence: Synthetic peptide
  L3E3[LAG-3] vlCDR3
SSYTSSSTNV

SEQ ID NO: 36963 - protein, 121 aa, Artificial Sequence
  Description of Artificial Sequence: Synthetic polypeptide
  durvalumab[PD-L1] variable heavy Chain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 36964 - protein, 5 aa, Artificial Sequence
  Description of Artificial Sequence: Synthetic peptide
  durvalumab[PD-L1] vhCDR1
RYWMS

SEQ ID NO: 36965 - protein, 17 aa, Artificial Sequence
  Description of Artificial Sequence: Synthetic peptide
  durvalumab[PD-L1] vhCDR2
NIKQDGSEKYYVDSVKG

SEQ ID NO: 36966 - protein, 12 aa, Artificial Sequence
  Description of Artificial Sequence: Synthetic peptide
  durvalumab[PD-L1] vhCDR3
EGGWFGELAFDY

SEQ ID NO: 36967 - protein, 108 aa, Artificial Sequence
  Description of Artificial Sequence: Synthetic polypeptide
  durvalumab[PD-L1] variable light Chain
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 36968 - protein, 12 aa, Artificial Sequence
  Description of Artificial Sequence: Synthetic peptide
  durvalumab[PD-L1] vlCDR1
RASQRVSSSYLA

SEQ ID NO: 36969 - protein, 7 aa, Artificial Sequence
  Description of Artificial Sequence: Synthetic peptide
  durvalumab[PD-L1] vlCDR2
DASSRAT

SEQ ID NO: 36970 - protein, 9 aa, Artificial Sequence
  Description of Artificial Sequence: Synthetic peptide
  durvalumab[PD-L1] vlCDR3
QQYGSLPWT

SEQ ID NO: 36971 - protein, 118 aa, Artificial Sequence
  Description of Artificial Sequence: Synthetic polypeptide
  atezolizumab[PD-L1] variable heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 36972 - protein, 5 aa, Artificial Sequence
  Description of Artificial Sequence: Synthetic peptide
  atezolizumab[PD-L1] vhCDR1
DSWIH

SEQ ID NO: 36973 - protein, 17 aa, Artificial Sequence
  Description of Artificial Sequence: Synthetic peptide
  atezolizumab[PD-L1] vhCDR2
WISPYGGSTYYADSVKG

SEQ ID NO: 36974 - protein, 9 aa, Artificial Sequence
  Description of Artificial Sequence: Synthetic peptide
  atezolizumab[PD-L1] vhCDR3
RHWPGGFDY

SEQ ID NO: 36975 - protein, 108 aa, Artificial Sequence
  Description of Artificial Sequence: Synthetic polypeptide
  atezolizumab[PD-L1] variable light Chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 36976 - protein, 11 aa, Artificial Sequence
  Description of Artificial Sequence: Synthetic peptide
  atezolizumab[PD-L1] vlCDR1
RASQDVSTAVA

SEQ ID NO: 36977 - protein, 7 aa, Artificial Sequence
  Description of Artificial Sequence: Synthetic peptide
  atezolizumab[PD-L1] vlCDR2
SASFLYS

SEQ ID NO: 36978 - protein, 9 aa, Artificial Sequence
  Description of Artificial Sequence: Synthetic peptide
  atezolizumab[PD-L1] vlCDR3
QQYLYHPAT

SEQ ID NO: 36979 - protein, 120 aa, Artificial Sequence
  Description of Artificial Sequence: Synthetic polypeptide
  A09-246-2[PD-L1] variable heavy Chain
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS

SEQ ID NO: 36980 - protein, 5 aa, Artificial Sequence
  Description of Artificial Sequence: Synthetic peptide
  A09-246-2[PD-L1] vhCDR1
SYIMM

SEQ ID NO: 36981 - protein, 17 aa, Artificial Sequence
  Description of Artificial Sequence: Synthetic peptide
  A09-246-2[PD-L1] vhCDR2
SIYPSGGITFYADTVKG

SEQ ID NO: 36982 - protein, 11 aa, Artificial Sequence
  Description of Artificial Sequence: Synthetic peptide
  A09-246-2[PD-L1] vhCDR3
IKLGTVTTVDY

SEQ ID NO: 36983 - protein, 110 aa, Artificial Sequence
  Description of Artificial Sequence: Synthetic polypeptide
  A09-246-2[PD-L1] variable light Chain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 36984 - protein, 14 aa, Artificial Sequence
  Description of Artificial Sequence: Synthetic peptide
  A09-246-2[PD-L1] vlCDR1
TGTSSDVGGYNYVS

SEQ ID NO: 36985 - protein, 7 aa, Artificial Sequence
  Description of Artificial Sequence: Synthetic peptide
  A09-246-2[PD-L1] vlCDR2
DVSNRPS

SEQ ID NO: 36986 - protein, 10 aa, Artificial Sequence
  Description of Artificial Sequence: Synthetic peptide
  A09-246-2[PD-L1] vlCDR3
SSYTSSSTRV

SEQ ID NO: 36987 - protein, 123 aa, Artificial Sequence
  Description of Artificial Sequence: Synthetic polypeptide
  12A4[PD-L1] variable heavy Chain
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 36988 - protein, 5 aa, Artificial Sequence
  Description of Artificial Sequence: Synthetic peptide
  12A4[PD-L1] vhCDR1
TYAIS

SEQ ID NO: 36989 - protein, 17 aa, Artificial Sequence
  Description of Artificial Sequence: Synthetic peptide
  12A4[PD-L1] vhCDR2
GIIPIFGKAHYAQKFQG

SEQ ID NO: 36990 - protein, 14 aa, Artificial Sequence
  Description of Artificial Sequence: Synthetic peptide
  12A4[PD-L1] vhCDR3
KFHFVSGSPFGMDV

SEQ ID NO: 36991 - protein, 106 aa, Artificial Sequence
  Description of Artificial Sequence: Synthetic polypeptide
  12A4[PD-L1] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 36992 - protein, 11 aa, Artificial Sequence
  Description of Artificial Sequence: Synthetic peptide
  12A4[PD-L1] vlCDR1
RASQSVSSYLA

SEQ ID NO: 36993 - protein, 7 aa, Artificial Sequence
  Description of Artificial Sequence: Synthetic peptide
  12A4[PD-L1] vlCDR2
DASNRAT

SEQ ID NO: 36994 - protein, 8 aa, Artificial Sequence
  Description of Artificial Sequence: Synthetic peptide
  12A4[PD-L1] vlCDR3
QQRSNWPT

SEQ ID NO: 36995 - protein, 117 aa, Artificial Sequence
  Description of Artificial Sequence: Synthetic polypeptide
  3G10[PD-L1] variable heavy Chain
QVQLVQSGAEVKKPGASVKVSCKASGYTFTDYGFSWVRQAPGQGLEWMGWITAYNGNTNYAQKLQGRVTMTTDTSTSTVYMELRSLRSDDTAVYYCARDYFYGMDVWGQGTTVTVSS

SEQ ID NO: 36996 - protein, 5 aa, Artificial Sequence
  Description of Artificial Sequence: Synthetic peptide
  3G10[PD-L1] vhCDR1
DYGFS

SEQ ID NO: 36997 - protein, 17 aa, Artificial Sequence
  Description of Artificial Sequence: Synthetic peptide
  3G10[PD-L1] vhCDR2
WITAYNGNTNYAQKLQG

SEQ ID NO: 36998 - protein, 8 aa, Artificial Sequence
  Description of Artificial Sequence: Synthetic peptide
  3G10[PD-L1] vhCDR3
DYFYGMDV

SEQ ID NO: 36999 - protein, 107 aa, Artificial Sequence
  Description of Artificial Sequence: Synthetic polypeptide
  3G10[PD-L1] variable light Chain
EIVLTQSPATLSLSPGERATLSCRASQSVSSYLVWYQQKPGQAPRLLIYDASNRATGIPARFSGSGSGTDFTLTISSLEPEDFAVYYCQQRSNWPRTFGQGTKVEIK

SEQ ID NO: 37000 - protein, 11 aa, Artificial Sequence
  Description of Artificial Sequence: Synthetic peptide
  3G10[PD-L1] vlCDR1
RASQSVSSYLV

SEQ ID NO: 37001 - protein, 7 aa, Artificial Sequence
  Description of Artificial Sequence: Synthetic peptide
  3G10[PD-L1] vlCDR2
DASNRAT

SEQ ID NO: 37002 - protein, 9 aa, Artificial Sequence
  Description of Artificial Sequence: Synthetic peptide
  3G10[PD-L1] vlCDR3
QQRSNWPRT

SEQ ID NO: 37003 - protein, 118 aa, Artificial Sequence
  Description of Artificial Sequence: Synthetic polypeptide
  10A5[PD-L1] variable heavy Chain
QVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 37004 - protein, 5 aa, Artificial Sequence
  Description of Artificial Sequence: Synthetic peptide
  10A5[PD-L1] vhCDR1
SYDVH

SEQ ID NO: 37005 - protein, 17 aa, Artificial Sequence
  Description of Artificial Sequence: Synthetic peptide
  10A5[PD-L1] vhCDR2
WLHADTGITKFSQKFQG

SEQ ID NO: 37006 - protein, 9 aa, Artificial Sequence
  Description of Artificial Sequence: Synthetic peptide
  10A5[PD-L1] vhCDR3
ERIQLWFDY

SEQ ID NO: 37007 - protein, 107 aa, Artificial Sequence
  Description of Artificial Sequence: Synthetic polypeptide
  10A5[PD-L1] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 37008 - protein, 11 aa, Artificial Sequence
  Description of Artificial Sequence: Synthetic peptide
  10A5[PD-L1] vlCDR1
RASQGISSWLA

SEQ ID NO: 37009 - protein, 7 aa, Artificial Sequence
  Description of Artificial Sequence: Synthetic peptide
  10A5[PD-L1] vlCDR2
AASSLQS

SEQ ID NO: 37010 - protein, 9 aa, Artificial Sequence
  Description of Artificial Sequence: Synthetic peptide
  10A5[PD-L1] vlCDR3
QQYNSYPYT

SEQ ID NO: 37011 - protein, 114 aa, Artificial Sequence
  Description of Artificial Sequence: Synthetic polypeptide
  h3D10 Var 1[PD-L1] variable heavy Chain
QVQLVQSGAEVKKPGASVKVSCKASGYTFPDYYMNWVRQAPGQGLEWMGDIDPNYGGTNYAQKFQGRVTMTRDTSISTAYMELSRLRSDDTAVYYCARGALTDWGQGTMVTVSS

SEQ ID NO: 37012 - protein, 5 aa, Artificial Sequence
  Description of Artificial Sequence: Synthetic peptide
  h3D10 Var 1[PD-L1] vhCDR1
DYYMN

SEQ ID NO: 37013 - protein, 17 aa, Artificial Sequence
  Description of Artificial Sequence: Synthetic peptide
  h3D10 Var 1[PD-L1] vhCDR2
DIDPNYGGTNYAQKFQG

SEQ ID NO: 37014 - protein, 5 aa, Artificial Sequence
  Description of Artificial Sequence: Synthetic peptide
  h3D10 Var 1[PD-L1] vhCDR3
GALTD

SEQ ID NO: 37015 - protein, 106 aa, Artificial Sequence
  Description of Artificial Sequence: Synthetic polypeptide
  h3D10 Var 1[PD-L1] variable light Chain
EIVLTQSPATLSLSPGERATLSCRASSSVSYIYWFQQKPGQAPRLLIYAAFNRATGIPARFSGSGSGTDYTLTISSLEPEDFAVYYCQQWSNNPLTFGQGTKVEIK

SEQ ID NO: 37016 - protein, 10 aa, Artificial Sequence
  Description of Artificial Sequence: Synthetic peptide
  h3D10 Var 1[PD-L1] vlCDR1
RASSSVSYIY

SEQ ID NO: 37017 - protein, 7 aa, Artificial Sequence
  Description of Artificial Sequence: Synthetic peptide
  h3D10 Var 1[PD-L1] vlCDR2
AAFNRAT

SEQ ID NO: 37018 - protein, 9 aa, Artificial Sequence
  Description of Artificial Sequence: Synthetic peptide
  h3D10 Var 1[PD-L1] vlCDR3
QQWSNNPLT

SEQ ID NO: 37019 - protein, 114 aa, Artificial Sequence
  Description of Artificial Sequence: Synthetic polypeptide
  h3D10 Var 2[PD-L1] variable heavy Chain
QVQLVQSGAEVKKPGASVKVSCKASGYTFPDYYMNWVRQAPGQSLEWMGDIDPNYGGTNYNQKFQGRVTMTRDTSISTAYMELSRLRSDDTAVYYCARGALTDWGQGTMVTVSS

SEQ ID NO: 37020 - protein, 5 aa, Artificial Sequence
  Description of Artificial Sequence: Synthetic peptide
  h3D10 Var 2[PD-L1] vhCDR1
DYYMN

SEQ ID NO: 37021 - protein, 17 aa, Artificial Sequence
  Description of Artificial Sequence: Synthetic peptide
  h3D10 Var 2[PD-L1] vhCDR2
DIDPNYGGTNYNQKFQG

SEQ ID NO: 37022 - protein, 5 aa, Artificial Sequence
  Description of Artificial Sequence: Synthetic peptide
  h3D10 Var 2[PD-L1] vhCDR3
GALTD

SEQ ID NO: 37023 - protein, 106 aa, Artificial Sequence
  Description of Artificial Sequence: Synthetic polypeptide
  h3D10 Var 2[PD-L1] variable light Chain
EIVLTQSPATLSLSPGERATLSCRASSSVSYIYWFQQKPGQSPRPLIYAAFNRATGIPARFSGSGSGTDYTLTISSLEPEDFAVYYCQQWSNNPLTFGQGTKVEIK

SEQ ID NO: 37024 - protein, 10 aa, Artificial Sequence
  Description of Artificial Sequence: Synthetic peptide
  h3D10 Var 2[PD-L1] vlCDR1
RASSSVSYIY

SEQ ID NO: 37025 - protein, 7 aa, Artificial Sequence
  Description of Artificial Sequence: Synthetic peptide
  h3D10 Var 2[PD-L1] vlCDR2
AAFNRAT

SEQ ID NO: 37026 - protein, 9 aa, Artificial Sequence
  Description of Artificial Sequence: Synthetic peptide
  h3D10 Var 2[PD-L1] vlCDR3
QQWSNNPLT

SEQ ID NO: 37027 - protein, 114 aa, Artificial Sequence; identical to SEQ ID NO: 37019
  Description of Artificial Sequence: Synthetic polypeptide
  h3D10 Var 3[PD-L1] variable heavy Chain

SEQ ID NO: 37028 - protein, 5 aa, Artificial Sequence
  Description of Artificial Sequence: Synthetic peptide
  h3D10 Var 3[PD-L1] vhCDR1
DYYMN

SEQ ID NO: 37029 - protein, 17 aa, Artificial Sequence
  Description of Artificial Sequence: Synthetic peptide
  h3D10 Var 3[PD-L1] vhCDR2
DIDPNYGGTNYNQKFQG

SEQ ID NO: 37030 - protein, 5 aa, Artificial Sequence
  Description of Artificial Sequence: Synthetic peptide
  h3D10 Var 3[PD-L1] vhCDR3
GALTD

SEQ ID NO: 37031 - protein, 106 aa, Artificial Sequence
  Description of Artificial Sequence: Synthetic polypeptide
  h3D10 Var 3[PD-L1] variable light Chain
QIVLTQSPATLSLSPGERATLSCRASSSVSYIYWFQQKPGQSPRPLIYATFNLASGIPARFSGSGSGTSYTLTISRLEPEDFAVYYCQQWSNNPLTFGQGTKVEIK

SEQ ID NO: 37032 - protein, 10 aa, Artificial Sequence
  Description of Artificial Sequence: Synthetic peptide
  h3D10 Var 3[PD-L1] vlCDR1
RASSSVSYIY

SEQ ID NO: 37033 - protein, 7 aa, Artificial Sequence
  Description of Artificial Sequence: Synthetic peptide
  h3D10 Var 3[PD-L1] vlCDR2
ATFNLAS

SEQ ID NO: 37034 - protein, 9 aa, Artificial Sequence
  Description of Artificial Sequence: Synthetic peptide
  h3D10 Var 3[PD-L1] vlCDR3
QQWSNNPLT

SEQ ID NO: 37035 - protein, 114 aa, Artificial Sequence
  Description of Artificial Sequence: Synthetic polypeptide
  h3D10 Var 4[PD-L1] variable heavy Chain
EVQLVQSGAEVKKPGASVKVSCKASGYTFPDYYMNWVRQAPGQSLEWMGDIDPNYGGTNYNQKFQGRVTMTVDRSSSTAYMELSRLRSDDTAVYYCARGALTDWGQGTMVTVSS

SEQ ID NO: 37036 - protein, 5 aa, Artificial Sequence
  Description of Artificial Sequence: Synthetic peptide
  h3D10 Var 4[PD-L1] vhCDR1
DYYMN

SEQ ID NO: 37037 - protein, 17 aa, Artificial Sequence
  Description of Artificial Sequence: Synthetic peptide
  h3D10 Var 4[PD-L1] vhCDR2
DIDPNYGGTNYNQKFQG

SEQ ID NO: 37038 - protein, 5 aa, Artificial Sequence
  Description of Artificial Sequence: Synthetic peptide
  h3D10 Var 4[PD-L1] vhCDR3
GALTD

SEQ ID NO: 37039 - protein, 106 aa, Artificial Sequence; identical to SEQ ID NO: 37023
  Description of Artificial Sequence: Synthetic polypeptide
  h3D10 Var 4[PD-L1] variable light Chain

SEQ ID NO: 37040 - protein, 10 aa, Artificial Sequence
  Description of Artificial Sequence: Synthetic peptide
  h3D10 Var 4[PD-L1] vlCDR1
RASSSVSYIY

SEQ ID NO: 37041 - protein, 7 aa, Artificial Sequence
  Description of Artificial Sequence: Synthetic peptide
  h3D10 Var 4[PD-L1] vlCDR2
AAFNRAT

SEQ ID NO: 37042 - protein, 9 aa, Artificial Sequence
  Description of Artificial Sequence: Synthetic peptide
  h3D10 Var 4[PD-L1] vlCDR3
QQWSNNPLT

SEQ ID NO: 37043 - protein, 114 aa, Artificial Sequence; identical to SEQ ID NO: 37035
  Description of Artificial Sequence: Synthetic polypeptide
  h3D10 Var 5[PD-L1] variable heavy Chain

SEQ ID NO: 37044 - protein, 5 aa, Artificial Sequence
  Description of Artificial Sequence: Synthetic peptide
  h3D10 Var 5[PD-L1] vhCDR1
DYYMN

SEQ ID NO: 37045 - protein, 17 aa, Artificial Sequence
  Description of Artificial Sequence: Synthetic peptide
  h3D10 Var 5[PD-L1] vhCDR2
DIDPNYGGTNYNQKFQG

SEQ ID NO: 37046 - protein, 5 aa, Artificial Sequence
  Description of Artificial Sequence: Synthetic peptide
  h3D10 Var 5[PD-L1] vhCDR3
GALTD

SEQ ID NO: 37047 - protein, 106 aa, Artificial Sequence; identical to SEQ ID NO: 37031
  Description of Artificial Sequence: Synthetic polypeptide
  h3D10 Var 5[PD-L1] variable light Chain

SEQ ID NO: 37048 - protein, 10 aa, Artificial Sequence
  Description of Artificial Sequence: Synthetic peptide
  h3D10 Var 5[PD-L1] vlCDR1
RASSSVSYIY

SEQ ID NO: 37049 - protein, 7 aa, Artificial Sequence
  Description of Artificial Sequence: Synthetic peptide
  h3D10 Var 5[PD-L1] vlCDR2
ATFNLAS

SEQ ID NO: 37050 - protein, 9 aa, Artificial Sequence
  Description of Artificial Sequence: Synthetic peptide
  h3D10 Var 5[PD-L1] vlCDR3
QQWSNNPLT

SEQ ID NO: 37051 - protein, 114 aa, Artificial Sequence
  Description of Artificial Sequence: Synthetic polypeptide
  h3D10 Var 6[PD-L1] variable heavy Chain
EVQLVESGGGLVQPGRSLRLSCTASGYTFPDYYMNWVRQAPGKGLEWVGDIDPNYGGTTYAASVKGRFTISVDRSKSIAYLQMSSLKTEDTAVYYCTRGALTDWGQGTMVTVSS

SEQ ID NO: 37052 - protein, 5 aa, Artificial Sequence
  Description of Artificial Sequence: Synthetic peptide
  h3D10 Var 6[PD-L1] vhCDR1
DYYMN

SEQ ID NO: 37053 - protein, 17 aa, Artificial Sequence
  Description of Artificial Sequence: Synthetic peptide
  h3D10 Var 6[PD-L1] vhCDR2
DIDPNYGGTTYAASVKG

SEQ ID NO: 37054 - protein, 5 aa, Artificial Sequence
  Description of Artificial Sequence: Synthetic peptide
  h3D10 Var 6[PD-L1] vhCDR3
GALTD

SEQ ID NO: 37055 - protein, 106 aa, Artificial Sequence
  Description of Artificial Sequence: Synthetic polypeptide
  h3D10 Var 6[PD-L1] variable light Chain
DIQLTQSPSSLSASVGDRVTITCRASSGVSYIYWFQQKPGKAPKLLIYAAFNLASGVPSRFSGSGSGTEYTLTISSLQPEDFATYYCQQWSNNPLTFGQGTKVEIK

SEQ ID NO: 37056 - protein, 10 aa, Artificial Sequence
  Description of Artificial Sequence: Synthetic peptide
  h3D10 Var 6[PD-L1] vlCDR1
RASSGVSYIY

SEQ ID NO: 37057 - protein, 7 aa, Artificial Sequence
  Description of Artificial Sequence: Synthetic peptide
  h3D10 Var 6[PD-L1] vlCDR2
AAFNLAS

SEQ ID NO: 37058 - protein, 9 aa, Artificial Sequence
  Description of Artificial Sequence: Synthetic peptide
  h3D10 Var 6[PD-L1] vlCDR3
QQWSNNPLT

SEQ ID NO: 37059 - protein, 114 aa, Artificial Sequence
  Description of Artificial Sequence: Synthetic polypeptide
  h3D10 Var 7[PD-L1] variable heavy Chain
EVQLVESGGGLVQPGRSLRLSCTASGYTFPDYYMNWVRQAPGKGLEWVGDIDPNYGGTTYNASVKGRFTISVDRSKSIAYLQMSSLKTEDTAVYYCARGALTDWGQGTMVTVSS

SEQ ID NO: 37060 - protein, 5 aa, Artificial Sequence
  Description of Artificial Sequence: Synthetic peptide
  h3D10 Var 7[PD-L1] vhCDR1
DYYMN

SEQ ID NO: 37061 - protein, 17 aa, Artificial Sequence
  Description of Artificial Sequence: Synthetic peptide
  h3D10 Var 7[PD-L1] vhCDR2
DIDPNYGGTTYNASVKG

SEQ ID NO: 37062 - protein, 5 aa, Artificial Sequence
  Description of Artificial Sequence: Synthetic peptide
  h3D10 Var 7[PD-L1] vhCDR3
GALTD

SEQ ID NO: 37063 - protein, 106 aa, Artificial Sequence
  Description of Artificial Sequence: Synthetic polypeptide
  h3D10 Var 7[PD-L1] variable light Chain
DIQLTQSPSSLSASVGDRVTITCRASSGVSYIYWFQQKPGKAPKPLIYAAFNLASGVPSRFSGSGSGTEYTLTISSLQPEDFATYYCQQWSNNPLTFGQGTKVEIK

SEQ ID NO: 37064 - protein, 10 aa, Artificial Sequence
  Description of Artificial Sequence: Synthetic peptide
  h3D10 Var 7[PD-L1] vlCDR1
RASSGVSYIY

SEQ ID NO: 37065 - protein, 7 aa, Artificial Sequence
  Description of Artificial Sequence: Synthetic peptide
  h3D10 Var 7[PD-L1] vlCDR2
AAFNLAS

SEQ ID NO: 37066 - protein, 9 aa, Artificial Sequence
  Description of Artificial Sequence: Synthetic peptide
  h3D10 Var 7[PD-L1] vlCDR3
QQWSNNPLT

SEQ ID NO: 37067 - protein, 114 aa, Artificial Sequence; identical to SEQ ID NO: 37059
  Description of Artificial Sequence: Synthetic polypeptide
  h3D10 Var 8[PD-L1] variable heavy Chain

SEQ ID NO: 37068 - protein, 5 aa, Artificial Sequence
  Description of Artificial Sequence: Synthetic peptide
  h3D10 Var 8[PD-L1] vhCDR1
DYYMN

SEQ ID NO: 37069 - protein, 17 aa, Artificial Sequence
  Description of Artificial Sequence: Synthetic peptide
  h3D10 Var 8[PD-L1] vhCDR2
DIDPNYGGTTYNASVKG

SEQ ID NO: 37070 - protein, 5 aa, Artificial Sequence
  Description of Artificial Sequence: Synthetic peptide
  h3D10 Var 8[PD-L1] vhCDR3
GALTD

SEQ ID NO: 37071 - protein, 106 aa, Artificial Sequence
  Description of Artificial Sequence: Synthetic polypeptide
  h3D10 Var 8[PD-L1] variable light Chain
DIQLTQSPSILSASVGDRVTITCRASSSVSYIYWFQQKPGKAPKPLIYATFNLASGVPSRFSGSGSGTSYTLTISSLQPEDFATYYCQQWSNNPLTFGQGTKVEIK

SEQ ID NO: 37072 - protein, 10 aa, Artificial Sequence
  Description of Artificial Sequence: Synthetic peptide
  h3D10 Var 8[PD-L1] vlCDR1
RASSSVSYIY

SEQ ID NO: 37073 - protein, 7 aa, Artificial Sequence
  Description of Artificial Sequence: Synthetic peptide
  h3D10 Var 8[PD-L1] vlCDR2
ATFNLAS

SEQ ID NO: 37074 - protein, 9 aa, Artificial Sequence
  Description of Artificial Sequence: Synthetic peptide
  h3D10 Var 8[PD-L1] vlCDR3
QQWSNNPLT

SEQ ID NO: 37075 - protein, 114 aa, Artificial Sequence
  Description of Artificial Sequence: Synthetic polypeptide
  h3D10 Var 9[PD-L1] variable heavy Chain
EVQLVESGGGLVQPGRSLRLSCTASGYTFPDYYMNWVRQAPGKGLEWVGDIDPNYGGTTYNQSVKGRFTISVDRSKSIAYLQMSSLKTEDTAVYYCARGALTDWGQGTMVTVSS

SEQ ID NO: 37076 - protein, 5 aa, Artificial Sequence
  Description of Artificial Sequence: Synthetic peptide
  h3D10 Var 9[PD-L1] vhCDR1
DYYMN

SEQ ID NO: 37077 - protein, 17 aa, Artificial Sequence
  Description of Artificial Sequence: Synthetic peptide
  h3D10 Var 9[PD-L1] vhCDR2
DIDPNYGGTTYNQSVKG

SEQ ID NO: 37078 - protein, 5 aa, Artificial Sequence
  Description of Artificial Sequence: Synthetic peptide
  h3D10 Var 9[PD-L1] vhCDR3
GALTD

SEQ ID NO: 37079 - protein, 106 aa, Artificial Sequence; identical to SEQ ID NO: 37063
  Description of Artificial Sequence: Synthetic polypeptide
  h3D10 Var 9[PD-L1] variable light Chain

SEQ ID NO: 37080 - protein, 10 aa, Artificial Sequence
  Description of Artificial Sequence: Synthetic peptide
  h3D10 Var 9[PD-L1] vlCDR1
RASSGVSYIY

SEQ ID NO: 37081 - protein, 7 aa, Artificial Sequence
  Description of Artificial Sequence: Synthetic peptide
  h3D10 Var 9[PD-L1] vlCDR2
AAFNLAS

SEQ ID NO: 37082 - protein, 9 aa, Artificial Sequence
  Description of Artificial Sequence: Synthetic peptide
  h3D10 Var 9[PD-L1] vlCDR3
QQWSNNPLT

SEQ ID NO: 37083 - protein, 114 aa, Artificial Sequence; identical to SEQ ID NO: 37075
  Description of Artificial Sequence: Synthetic polypeptide
  h3D10 Var 10[PD-L1] variable heavy Chain

SEQ ID NO: 37084 - protein, 5 aa, Artificial Sequence
  Description of Artificial Sequence: Synthetic peptide
  h3D10 Var 10[PD-L1] vhCDR1
DYYMN

SEQ ID NO: 37085 - protein, 17 aa, Artificial Sequence
  Description of Artificial Sequence: Synthetic peptide
  h3D10 Var 10[PD-L1] vhCDR2
DIDPNYGGTTYNQSVKG

SEQ ID NO: 37086 - protein, 5 aa, Artificial Sequence
  Description of Artificial Sequence: Synthetic peptide
  h3D10 Var 10[PD-L1] vhCDR3
GALTD

SEQ ID NO: 37087 - protein, 106 aa, Artificial Sequence; identical to SEQ ID NO: 37071
  Description of Artificial Sequence: Synthetic polypeptide
  h3D10 Var 10[PD-L1] variable light Chain

SEQ ID NO: 37088 - protein, 10 aa, Artificial Sequence
  Description of Artificial Sequence: Synthetic peptide
  h3D10 Var 10[PD-L1] vlCDR1
RASSSVSYIY

SEQ ID NO: 37089 - protein, 7 aa, Artificial Sequence
  Description of Artificial Sequence: Synthetic peptide
  h3D10 Var 10[PD-L1] vlCDR2
ATFNLAS

SEQ ID NO: 37090 - protein, 9 aa, Artificial Sequence
  Description of Artificial Sequence: Synthetic peptide
  h3D10 Var 10[PD-L1] vlCDR3
QQWSNNPLT

SEQ ID NO: 37091 - protein, 114 aa, Artificial Sequence; identical to SEQ ID NO: 37051
  Description of Artificial Sequence: Synthetic polypeptide
  h3D10 Var 11[PD-L1] variable heavy Chain

SEQ ID NO: 37092 - protein, 5 aa, Artificial Sequence
  Description of Artificial Sequence: Synthetic peptide
  h3D10 Var 11[PD-L1] vhCDR1
DYYMN

SEQ ID NO: 37093 - protein, 17 aa, Artificial Sequence
  Description of Artificial Sequence: Synthetic peptide
  h3D10 Var 11[PD-L1] vhCDR2
DIDPNYGGTTYAASVKG

SEQ ID NO: 37094 - protein, 5 aa, Artificial Sequence
  Description of Artificial Sequence: Synthetic peptide
  h3D10 Var 11[PD-L1] vhCDR3
GALTD

SEQ ID NO: 37095 - protein, 106 aa, Artificial Sequence; identical to SEQ ID NO: 37015
  Description of Artificial Sequence: Synthetic polypeptide
  h3D10 Var 11[PD-L1] variable light Chain

SEQ ID NO: 37096 - protein, 10 aa, Artificial Sequence
  Description of Artificial Sequence: Synthetic peptide
  h3D10 Var 11[PD-L1] vlCDR1
RASSSVSYIY

SEQ ID NO: 37097 - protein, 7 aa, Artificial Sequence
  Description of Artificial Sequence: Synthetic peptide
  h3D10 Var 11[PD-L1] vlCDR2
AAFNRAT

SEQ ID NO: 37098 - protein, 9 aa, Artificial Sequence
  Description of Artificial Sequence: Synthetic peptide
  h3D10 Var 11[PD-L1] vlCDR3
QQWSNNPLT

SEQ ID NO: 37099 - protein, 114 aa, Artificial Sequence; identical to SEQ ID NO: 37011
  Description of Artificial Sequence: Synthetic polypeptide
  h3D10 Var 12[PD-L1] variable heavy Chain

SEQ ID NO: 37100 - protein, 5 aa, Artificial Sequence
  Description of Artificial Sequence: Synthetic peptide
  h3D10 Var 12[PD-L1] vhCDR1
DYYMN

SEQ ID NO: 37101 - protein, 17 aa, Artificial Sequence
  Description of Artificial Sequence: Synthetic peptide
  h3D10 Var 12[PD-L1] vhCDR2
DIDPNYGGTNYAQKFQG

SEQ ID NO: 37102 - protein, 5 aa, Artificial Sequence
  Description of Artificial Sequence: Synthetic peptide
  h3D10 Var 12[PD-L1] vhCDR3
GALTD

SEQ ID NO: 37103 - protein, 106 aa, Artificial Sequence; identical to SEQ ID NO: 37055
  Description of Artificial Sequence: Synthetic polypeptide
  h3D10 Var 12[PD-L1] variable light Chain

SEQ ID NO: 37104 - protein, 10 aa, Artificial Sequence
  Description of Artificial Sequence: Synthetic peptide
  h3D10 Var 12[PD-L1] vlCDR1
RASSGVSYIY

SEQ ID NO: 37105 - protein, 7 aa, Artificial Sequence
  Description of Artificial Sequence: Synthetic peptide
  h3D10 Var 12[PD-L1] vlCDR2
AAFNLAS

SEQ ID NO: 37106 - protein, 9 aa, Artificial Sequence
  Description of Artificial Sequence: Synthetic peptide
  h3D10 Var 12[PD-L1] vlCDR3
QQWSNNPLT

SEQ ID NO: 37107 - protein, 114 aa, Artificial Sequence; identical to SEQ ID NO: 37075
  Description of Artificial Sequence: Synthetic polypeptide
  h3D10 Var 13[PD-L1] variable heavy Chain

SEQ ID NO: 37108 - protein, 5 aa, Artificial Sequence
  Description of Artificial Sequence: Synthetic peptide
  h3D10 Var 13[PD-L1] vhCDR1
DYYMN

SEQ ID NO: 37109 - protein, 17 aa, Artificial Sequence
  Description of Artificial Sequence: Synthetic peptide
  h3D10 Var 13[PD-L1] vhCDR2
DIDPNYGGTTYNQSVKG

SEQ ID NO: 37110 - protein, 5 aa, Artificial Sequence
  Description of Artificial Sequence: Synthetic peptide
  h3D10 Var 13[PD-L1] vhCDR3
GALTD

SEQ ID NO: 37111 - protein, 106 aa, Artificial Sequence; identical to SEQ ID NO: 37031
  Description of Artificial Sequence: Synthetic polypeptide
  h3D10 Var 13[PD-L1] variable light Chain

SEQ ID NO: 37112 - protein, 10 aa, Artificial Sequence
  Description of Artificial Sequence: Synthetic peptide
  h3D10 Var 13[PD-L1] vlCDR1
RASSSVSYIY

SEQ ID NO: 37113 - protein, 7 aa, Artificial Sequence
  Description of Artificial Sequence: Synthetic peptide
  h3D10 Var 13[PD-L1] vlCDR2
ATFNLAS

SEQ ID NO: 37114 - protein, 9 aa, Artificial Sequence
  Description of Artificial Sequence: Synthetic peptide
  h3D10 Var 13[PD-L1] vlCDR3
QQWSNNPLT

SEQ ID NO: 37115 - protein, 114 aa, Artificial Sequence; identical to SEQ ID NO: 37035
  Description of Artificial Sequence: Synthetic polypeptide
  h3D10 Var 14[PD-L1] variable heavy Chain

SEQ ID NO: 37116 - protein, 5 aa, Artificial Sequence
  Description of Artificial Sequence: Synthetic peptide
  h3D10 Var 14[PD-L1] vhCDR1
DYYMN

SEQ ID NO: 37117 - protein, 17 aa, Artificial Sequence
  Description of Artificial Sequence: Synthetic peptide
  h3D10 Var 14[PD-L1] vhCDR2
DIDPNYGGTNYNQKFQG

SEQ ID NO: 37118 - protein, 5 aa, Artificial Sequence
  Description of Artificial Sequence: Synthetic peptide
  h3D10 Var 14[PD-L1] vhCDR3
GALTD

SEQ ID NO: 37119 - protein, 106 aa, Artificial Sequence; identical to SEQ ID NO: 37071
  Description of Artificial Sequence: Synthetic polypeptide
  h3D10 Var 14[PD-L1] variable light Chain

SEQ ID NO: 37120 - protein, 10 aa, Artificial Sequence
  Description of Artificial Sequence: Synthetic peptide
  h3D10 Var 14[PD-L1] vlCDR1
RASSSVSYIY

SEQ ID NO: 37121 - protein, 7 aa, Artificial Sequence
  Description of Artificial Sequence: Synthetic peptide
  h3D10 Var 14[PD-L1] vlCDR2
ATFNLAS

SEQ ID NO: 37122 - protein, 9 aa, Artificial Sequence
  Description of Artificial Sequence: Synthetic peptide
  h3D10 Var 14[PD-L1] vlCDR3
QQWSNNPLT

SEQ ID NO: 37123 - protein, 123 aa, Artificial Sequence
  Description of Artificial Sequence: Synthetic polypeptide
  Antibody A[PD-L1] variable heavy Chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSPDYSPYYYYGMDVWGQGTTVTVSS

SEQ ID NO: 37124 - protein, 5 aa, Artificial Sequence
  Description of Artificial Sequence: Synthetic peptide
  Antibody A[PD-L1] vhCDR1
SYAIS

SEQ ID NO: 37125 - protein, 17 aa, Artificial Sequence
  Description of Artificial Sequence: Synthetic peptide
  Antibody A[PD-L1] vhCDR2
GIIPIFGTANYAQKFQG

SEQ ID NO: 37126 - protein, 14 aa, Artificial Sequence
  Description of Artificial Sequence: Synthetic peptide
  Antibody A[PD-L1] vhCDR3
SPDYSPYYYYGMDV

SEQ ID NO: 37127 - protein, 111 aa, Artificial Sequence
  Description of Artificial Sequence: Synthetic polypeptide
  Antibody A[PD-L1] variable light Chain
QSVLTQPPSASGTPGQRVTISCSGSSSNIGSNTVNWYQQLPGTAPKLLIYGNSNRPSGVPDRFSGSKSGTSASLAISGLQSEDEADYYCQSYDSSLSGSVFGGGIKLTVLG

SEQ ID NO: 37128 - protein, 13 aa, Artificial Sequence
  Description of Artificial Sequence: Synthetic peptide
  Antibody A[PD-L1] vlCDR1
SGSSSNIGSNTVN

SEQ ID NO: 37129 - protein, 7 aa, Artificial Sequence
  Description of Artificial Sequence: Synthetic peptide
  Antibody A[PD-L1] vlCDR2
GNSNRPS

SEQ ID NO: 37130 - protein, 11 aa, Artificial Sequence
  Description of Artificial Sequence: Synthetic peptide
  Antibody A[PD-L1] vlCDR3
QSYDSSLSGSV

SEQ ID NO: 37131 - protein, 116 aa, Artificial Sequence
  Description of Artificial Sequence: Synthetic polypeptide
  C5H9v2[PD-L1] variable heavy Chain
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAAFDYWGQGTLVTVSS

SEQ ID NO: 37132 - protein, 5 aa, Artificial Sequence
  Description of Artificial Sequence: Synthetic peptide
  C5H9v2[PD-L1] vhCDR1
SYAMS

SEQ ID NO: 37133 - protein, 17 aa, Artificial Sequence
  Description of Artificial Sequence: Synthetic peptide
  C5H9v2[PD-L1] vhCDR2
SIWRNGIVTVYADSVKG

SEQ ID NO: 37134 - protein, 7 aa, Artificial Sequence
  Description of Artificial Sequence: Synthetic peptide
  C5H9v2[PD-L1] vhCDR3
WSAAFDY

SEQ ID NO: 37135 - protein, 107 aa, Artificial Sequence
  Description of Artificial Sequence: Synthetic polypeptide
  C5H9v2[PD-L1] variable light Chain
DIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIK

SEQ ID NO: 37136 - protein, 11 aa, Artificial Sequence
  Description of Artificial Sequence: Synthetic peptide
  C5H9v2[PD-L1] vlCDR1
RASQSISSYLN

SEQ ID NO: 37137 - protein, 7 aa, Artificial Sequence
  Description of Artificial Sequence: Synthetic peptide
  C5H9v2[PD-L1] vlCDR2
AASSLQS

SEQ ID NO: 37138 - protein, 9 aa, Artificial Sequence
  Description of Artificial Sequence: Synthetic peptide
  C5H9v2[PD-L1] vlCDR3
QQDNGYPST

SEQ ID NO: 37139 - protein, 115 aa, Artificial Sequence
  Description of Artificial Sequence: Synthetic polypeptide
  humanized 29E.2A3[PD-L1] variable heavy Chain
EVQLVQSGAEVKKPGASVKMSCKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 37140 - protein, 5 aa, Artificial Sequence
  Description of Artificial Sequence: Synthetic peptide
  humanized 29E.2A3[PD-L1] vhCDR1
SYVMH

SEQ ID NO: 37141 - protein, 17 aa, Artificial Sequence
  Description of Artificial Sequence: Synthetic peptide
  humanized 29E.2A3[PD-L1] vhCDR2
YVNPFNDGTKYNEMFKG

SEQ ID NO: 37142 - protein, 6 aa, Artificial Sequence
  Description of Artificial Sequence: Synthetic peptide
  humanized 29E.2A3[PD-L1] vhCDR3
QAWGYP

SEQ ID NO: 37143 - protein, 111 aa, Artificial Sequence
  Description of Artificial Sequence: Synthetic polypeptide
  humanized 29E.2A3[PD-L1] variable light Chain
DIVLTQSPATLSLSPGERATLSCRATESVEYYGTSLVQWYQQKPGQPPKLLIYAASSVDSGVPSRFSGSGSGTDFTLTINSLEAEDAATYFCQQSRRVPYTFGQGTKLEIK

SEQ ID NO: 37144 - protein, 15 aa, Artificial Sequence
  Description of Artificial Sequence: Synthetic peptide
  humanized 29E.2A3[PD-L1] vlCDR1
RATESVEYYGTSLVQ

SEQ ID NO: 37145 - protein, 7 aa, Artificial Sequence
  Description of Artificial Sequence: Synthetic peptide
  humanized 29E.2A3[PD-L1] vlCDR2
AASSVDS

SEQ ID NO: 37146 - protein, 9 aa, Artificial Sequence
  Description of Artificial Sequence: Synthetic peptide
  humanized 29E.2A3[PD-L1] vlCDR3
QQSRRVPYT

SEQ ID NO: 37147 - protein, 121 aa, Artificial Sequence
  Description of Artificial Sequence: Synthetic polypeptide
  1B9[PD-L1] variable heavy Chain
DVQLQESGPGLVKPSQSLSLTCTVTGYSITSDHAWNWIRQVPGNKLEWMGYITYRGSTTYSPSLKSRISITRDTSKNQFFLQLNSVTTEDTATYYCARSMITTGYYVMDYWGQGTSVTVSS

SEQ ID NO: 37148 - protein, 6 aa, Artificial Sequence
  Description of Artificial Sequence: Synthetic peptide
  1B9[PD-L1] vhCDR1
SDHAWN

SEQ ID NO: 37149 - protein, 16 aa, Artificial Sequence
  Description of Artificial Sequence: Synthetic peptide
  1B9[PD-L1] vhCDR2
YITYRGSTTYSPSLKS

SEQ ID NO: 37150 - protein, 12 aa, Artificial Sequence
  Description of Artificial Sequence: Synthetic peptide
  1B9[PD-L1] vhCDR3
SMITTGYYVMDY

SEQ ID NO: 37151 - protein, 107 aa, Artificial Sequence
  Description of Artificial Sequence: Synthetic polypeptide
  1B9[PD-L1] variable light Chain
DIVMTQSHKFMSTSLGDRVTITCKASQDVGISVVWYQQKPGQSPKLLIYWASTRHTGVPDRFTGSGSGTDFTLTINNVQSEDLADYFCQQYSSYPLTVGAGTKLELK

SEQ ID NO: 37152 - protein, 11 aa, Artificial Sequence
  Description of Artificial Sequence: Synthetic peptide
  1B9[PD-L1] vlCDR1
KASQDVGISVV

SEQ ID NO: 37153 - protein, 7 aa, Artificial Sequence
  Description of Artificial Sequence: Synthetic peptide
  1B9[PD-L1] vlCDR2
WASTRHT

SEQ ID NO: 37154 - protein, 9 aa, Artificial Sequence
  Description of Artificial Sequence: Synthetic peptide
  1B9[PD-L1] vlCDR3
QQYSSYPLT

SEQ ID NO: 37155 - protein, 121 aa, Artificial Sequence
  Description of Artificial Sequence: Synthetic polypeptide
  4H1[PD-L1] variable heavy Chain
DVQLQESGPGLVKPSQSLSLTCTVTDYSITSDYAWTWIRQFPGNKLEWMGYITYRGTTRYNPSLTSRISFTRDTSKNQLFLQLNSVTTEDTGTYCCARSMITTGYYAMDYWGQGTSVTVSS

SEQ ID NO: 37156 - protein, 6 aa, Artificial Sequence
  Description of Artificial Sequence: Synthetic peptide
  4H1[PD-L1] vhCDR1
SDYAWT

SEQ ID NO: 37157 - protein, 16 aa, Artificial Sequence
  Description of Artificial Sequence: Synthetic peptide
  4H1[PD-L1] vhCDR2
YITYRGTTRYNPSLTS

SEQ ID NO: 37158 - protein, 12 aa, Artificial Sequence
  Description of Artificial Sequence: Synthetic peptide
  4H1[PD-L1] vhCDR3
SMITTGYYAMDY

SEQ ID NO: 37159 - protein, 107 aa, Artificial Sequence
  Description of Artificial Sequence: Synthetic polypeptide
  4H1[PD-L1] variable light Chain
DIVMTQSHKFMSTSVGDRVSISCKASQDVGISVAWYQQKPGQSPKLLIYWASTRHTGVPVRFTGSGSGTDFTLTISNVQSEDLADYFCQQYSSYPPTFGAGTKLELK

SEQ ID NO: 37160 - protein, 11 aa, Artificial Sequence
  Description of Artificial Sequence: Synthetic peptide
  4H1[PD-L1] vlCDR1
KASQDVGISVA

SEQ ID NO: 37161 - protein, 7 aa, Artificial Sequence
  Description of Artificial Sequence: Synthetic peptide
  4H1[PD-L1] vlCDR2
WASTRHT

SEQ ID NO: 37162 - protein, 9 aa, Artificial Sequence
  Description of Artificial Sequence: Synthetic peptide
  4H1[PD-L1] vlCDR3
QQYSSYPPT

SEQ ID NO: 37163 - protein, 120 aa, Artificial Sequence
  Description of Artificial Sequence: Synthetic polypeptide
  mAb-42[PD-L1] variable heavy Chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGRQMFGAGIDFWGPGTLVTVSS

SEQ ID NO: 37164 - protein, 5 aa, Artificial Sequence
  Description of Artificial Sequence: Synthetic peptide
  mAb-42[PD-L1] vhCDR1
SYAIS

SEQ ID NO: 37165 - protein, 17 aa, Artificial Sequence
  Description of Artificial Sequence: Synthetic peptide
  mAb-42[PD-L1] vhCDR2
GIIPIFGTANYAQKFQG

SEQ ID NO: 37166 - protein, 11 aa, Artificial Sequence
  Description of Artificial Sequence: Synthetic peptide
  mAb-42[PD-L1] vhCDR3
GRQMFGAGIDF

SEQ ID NO: 37167 - protein, 112 aa, Artificial Sequence
  Description of Artificial Sequence: Synthetic polypeptide
  mAb-42[PD-L1] variable light Chain
NFMLTQPHSVSESPGKTVTISCTRSSGSIDSNYVQWYQQRPGSAPTTVIYEDNQRPSGVPDRFSGSIDSSSNSASLTISGLKTEDEADYYCQSYDSNNRHVIFGGGTKLTVL

SEQ ID NO: 37168 - protein, 13 aa, Artificial Sequence
  Description of Artificial Sequence: Synthetic peptide
  mAb-42[PD-L1] vlCDR1
TRSSGSIDSNYVQ

SEQ ID NO: 37169 - protein, 7 aa, Artificial Sequence
  Description of Artificial Sequence: Synthetic peptide
  mAb-42[PD-L1] vlCDR2
EDNQRPS

SEQ ID NO: 37170 - protein, 11 aa, Artificial Sequence
  Description of Artificial Sequence: Synthetic peptide
  mAb-42[PD-L1] vlCDR3
QSYDSNNRHVI

SEQ ID NO: 37171 - protein, 120 aa, Artificial Sequence
  Description of Artificial Sequence: Synthetic polypeptide
  BAP058-03[PD-L1] variable heavy Chain
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 37172 - protein, 5 aa, Artificial Sequence
  Description of Artificial Sequence: Synthetic peptide
  BAP058-03[PD-L1] vhCDR1
SYWMY

SEQ ID NO: 37173 - protein, 17 aa, Artificial Sequence
  Description of Artificial Sequence: Synthetic peptide
  BAP058-03[PD-L1] vhCDR2
RIDPNSGSTKYNEKFKN

SEQ ID NO: 37174 - protein, 11 aa, Artificial Sequence
  Description of Artificial Sequence: Synthetic peptide
  BAP058-03[PD-L1] vhCDR3
DYRKGLYAMDY

SEQ ID NO: 37175 - protein, 107 aa, Artificial Sequence
  Description of Artificial Sequence: Synthetic polypeptide
  BAP058-03[PD-L1] variable light Chain
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIK

SEQ ID NO: 37176 - protein, 11 aa, Artificial Sequence
  Description of Artificial Sequence: Synthetic peptide
  BAP058-03[PD-L1] vlCDR1
KASQDVGTAVA

SEQ ID NO: 37177 - protein, 7 aa, Artificial Sequence
  Description of Artificial Sequence: Synthetic peptide
  BAP058-03[PD-L1] vlCDR2
WASTRHT

SEQ ID NO: 37178 - protein, 9 aa, Artificial Sequence
  Description of Artificial Sequence: Synthetic peptide
  BAP058-03[PD-L1] vlCDR3
QQYNSYPLT

SEQ ID NO: 37179 - protein, 120 aa, Artificial Sequence
  Description of Artificial Sequence: Synthetic polypeptide
  BAP058-04[PD-L1] variable heavy Chain
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSS

SEQ ID NO: 37180 - protein, 5 aa, Artificial Sequence
  Description of Artificial Sequence: Synthetic peptide
  BAP058-04[PD-L1] vhCDR1
SYWMY

SEQ ID NO: 37181 - protein, 17 aa, Artificial Sequence
  Description of Artificial Sequence: Synthetic peptide
  BAP058-04[PD-L1] vhCDR2
RIDPNSGSTKYNEKFKN

SEQ ID NO: 37182 - protein, 11 aa, Artificial Sequence
  Description of Artificial Sequence: Synthetic peptide
  BAP058-04[PD-L1] vhCDR3
DYRKGLYAMDY

SEQ ID NO: 37183 - protein, 107 aa, Artificial Sequence
  Description of Artificial Sequence: Synthetic polypeptide
  BAP058-04[PD-L1] variable light Chain
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIK

SEQ ID NO: 37184 - protein, 11 aa, Artificial Sequence
  Description of Artificial Sequence: Synthetic peptide
  BAP058-04[PD-L1] vlCDR1
KASQDVGTAVA

SEQ ID NO: 37185 - protein, 7 aa, Artificial Sequence
  Description of Artificial Sequence: Synthetic peptide
  BAP058-04[PD-L1] vlCDR2
WASTRHT

SEQ ID NO: 37186 - protein, 9 aa, Artificial Sequence
  Description of Artificial Sequence: Synthetic peptide
  BAP058-04[PD-L1] vlCDR3
QQYNSYPLT

SEQ ID NO: 37187 - protein, 120 aa, Artificial Sequence
  Description of Artificial Sequence: Synthetic polypeptide
  BAP058-06[PD-L1] variable heavy Chain
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSS

SEQ ID NO: 37188 - protein, 5 aa, Artificial Sequence
  Description of Artificial Sequence: Synthetic peptide
  BAP058-06[PD-L1] vhCDR1
SYWMY

SEQ ID NO: 37189 - protein, 17 aa, Artificial Sequence
  Description of Artificial Sequence: Synthetic peptide
  BAP058-06[PD-L1] vhCDR2
RIDPNSGSTKYNEKFKN

SEQ ID NO: 37190 - protein, 11 aa, Artificial Sequence
  Description of Artificial Sequence: Synthetic peptide
  BAP058-06[PD-L1] vhCDR3
DYRKGLYAMDY

SEQ ID NO: 37191 - protein, 107 aa, Artificial Sequence; identical to SEQ ID NO: 37183
  Description of Artificial Sequence: Synthetic polypeptide
  BAP058-06[PD-L1] variable light Chain

SEQ ID NO: 37192 - protein, 11 aa, Artificial Sequence
  Description of Artificial Sequence: Synthetic peptide
  BAP058-06[PD-L1] vlCDR1
KASQDVGTAVA

SEQ ID NO: 37193 - protein, 7 aa, Artificial Sequence
  Description of Artificial Sequence: Synthetic peptide
  BAP058-06[PD-L1] vlCDR2
WASTRHT

SEQ ID NO: 37194 - protein, 9 aa, Artificial Sequence
  Description of Artificial Sequence: Synthetic peptide
  BAP058-06[PD-L1] vlCDR3
QQYNSYPLT

SEQ ID NO: 37195 - protein, 120 aa, Artificial Sequence
  Description of Artificial Sequence: Synthetic polypeptide
  BAP058-07[PD-L1] variable heavy Chain
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSS

SEQ ID NO: 37196 - protein, 5 aa, Artificial Sequence
  Description of Artificial Sequence: Synthetic peptide
  BAP058-07[PD-L1] vhCDR1
SYWMY

SEQ ID NO: 37197 - protein, 17 aa, Artificial Sequence
  Description of Artificial Sequence: Synthetic peptide
  BAP058-07[PD-L1] vhCDR2
RIDPNSGSTKYNEKFKN

SEQ ID NO: 37198 - protein, 11 aa, Artificial Sequence
  Description of Artificial Sequence: Synthetic peptide
  BAP058-07[PD-L1] vhCDR3
DYRKGLYAMDY

SEQ ID NO: 37199 - protein, 107 aa, Artificial Sequence
  Description of Artificial Sequence: Synthetic polypeptide
  BAP058-07[PD-L1] variable light Chain
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIK

SEQ ID NO: 37200 - protein, 11 aa, Artificial Sequence
  Description of Artificial Sequence: Synthetic peptide
  BAP058-07[PD-L1] vlCDR1
KASQDVGTAVA

SEQ ID NO: 37201 - protein, 7 aa, Artificial Sequence
  Description of Artificial Sequence: Synthetic peptide
  BAP058-07[PD-L1] vlCDR2
WASTRHT

SEQ ID NO: 37202 - protein, 9 aa, Artificial Sequence
  Description of Artificial Sequence: Synthetic peptide
  BAP058-07[PD-L1] vlCDR3
QQYNSYPLT

SEQ ID NO: 37203 - protein, 120 aa, Artificial Sequence; identical to SEQ ID NO: 37171
  Description of Artificial Sequence: Synthetic polypeptide
  BAP058-11[PD-L1] variable heavy Chain

SEQ ID NO: 37204 - protein, 5 aa, Artificial Sequence
  Description of Artificial Sequence: Synthetic peptide
  BAP058-11[PD-L1] vhCDR1
SYWMY

SEQ ID NO: 37205 - protein, 17 aa, Artificial Sequence
  Description of Artificial Sequence: Synthetic peptide
  BAP058-11[PD-L1] vhCDR2
RIDPNSGSTKYNEKFKN

SEQ ID NO: 37206 - protein, 11 aa, Artificial Sequence
  Description of Artificial Sequence: Synthetic peptide
  BAP058-11[PD-L1] vhCDR3
DYRKGLYAMDY

SEQ ID NO: 37207 - protein, 107 aa, Artificial Sequence
  Description of Artificial Sequence: Synthetic polypeptide
  BAP058-11[PD-L1] variable light Chain
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 37208 - protein, 11 aa, Artificial Sequence
  Description of Artificial Sequence: Synthetic peptide
  BAP058-11[PD-L1] vlCDR1
KASQDVGTAVA

SEQ ID NO: 37209 - protein, 7 aa, Artificial Sequence
  Description of Artificial Sequence: Synthetic peptide
  BAP058-11[PD-L1] vlCDR2
WASTRHT

SEQ ID NO: 37210 - protein, 9 aa, Artificial Sequence
  Description of Artificial Sequence: Synthetic peptide
  BAP058-11[PD-L1] vlCDR3
QQYNSYPLT

SEQ ID NO: 37211 - protein, 120 aa, Artificial Sequence
  Description of Artificial Sequence: Synthetic polypeptide
  BAP058-13[PD-L1] variable heavy Chain
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 37212 - protein, 5 aa, Artificial Sequence
  Description of Artificial Sequence: Synthetic peptide
  BAP058-13[PD-L1] vhCDR1
SYWMY

SEQ ID NO: 37213 - protein, 17 aa, Artificial Sequence
  Description of Artificial Sequence: Synthetic peptide
  BAP058-13[PD-L1] vhCDR2
RIDPNSGSTKYNEKFKN

SEQ ID NO: 37214 - protein, 11 aa, Artificial Sequence
  Description of Artificial Sequence: Synthetic peptide
  BAP058-13[PD-L1] vhCDR3
DYRKGLYAMDY

SEQ ID NO: 37215 - protein, 107 aa, Artificial Sequence
  Description of Artificial Sequence: Synthetic polypeptide
  BAP058-13[PD-L1] variable light Chain
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 37216 - protein, 11 aa, Artificial Sequence
  Description of Artificial Sequence: Synthetic peptide
  BAP058-13[PD-L1] vlCDR1
KASQDVGTAVA

SEQ ID NO: 37217 - protein, 7 aa, Artificial Sequence
  Description of Artificial Sequence: Synthetic peptide
  BAP058-13[PD-L1] vlCDR2
WASTRHT

SEQ ID NO: 37218 - protein, 9 aa, Artificial Sequence
  Description of Artificial Sequence: Synthetic peptide
  BAP058-13[PD-L1] vlCDR3
QQYNSYPLT

SEQ ID NO: 37219 - protein, 121 aa, Artificial Sequence
  Description of Artificial Sequence: Synthetic polypeptide
  H6[PD-L1] variable heavy Chain
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCARGNIVATITPLDYWGQGTLVTVSS

SEQ ID NO: 37220 - protein, 5 aa, Artificial Sequence
  Description of Artificial Sequence: Synthetic peptide
  H6[PD-L1] vhCDR1
SYAIS

SEQ ID NO: 37221 - protein, 17 aa, Artificial Sequence
  Description of Artificial Sequence: Synthetic peptide
  H6[PD-L1] vhCDR2
GIIPIFGTANYAQKFQG

SEQ ID NO: 37222 - protein, 12 aa, Artificial Sequence
  Description of Artificial Sequence: Synthetic peptide
  H6[PD-L1] vhCDR3
GNIVATITPLDY

SEQ ID NO: 37223 - protein, 108 aa, Artificial Sequence
  Description of Artificial Sequence: Synthetic polypeptide
  H6[PD-L1] variable light Chain
SYELMQPPSVSVAPGKTATIACGGENIGRKTVHWYQQKPGQAPVLVIYYDSDRPSGIPERFSGSNSGNTATLTISRVEAGDEADYYCQVWDSSSDHRIFGGGTKLTVL

SEQ ID NO: 37224 - protein, 11 aa, Artificial Sequence
  Description of Artificial Sequence: Synthetic peptide
  H6[PD-L1] vlCDR1
GGENIGRKTVH

SEQ ID NO: 37225 - protein, 7 aa, Artificial Sequence
  Description of Artificial Sequence: Synthetic peptide
  H6[PD-L1] vlCDR2
YDSDRPS

SEQ ID NO: 37226 - protein, 11 aa, Artificial Sequence
  Description of Artificial Sequence: Synthetic peptide
  H6[PD-L1] vlCDR3
QVWDSSSDHRI

SEQ ID NO: 37227 - protein, 121 aa, Artificial Sequence
  Description of Artificial Sequence: Synthetic polypeptide
  RC5[PD-L1] variable heavy Chain
EVQLLESGGGVVQPGGSLRLSCAASGFTFSSYWMSWVRQAPGKGLEWVANIKQDGSEKYYVDSVKGRFTISRDNSKNTVSLQMNSLRAEDTAVYYCAKDRYYNFPLGMDVWGQGTTVTVSS

SEQ ID NO: 37228 - protein, 5 aa, Artificial Sequence
  Description of Artificial Sequence: Synthetic peptide
  RC5[PD-L1] vhCDR1
SYWMS

SEQ ID NO: 37229 - protein, 17 aa, Artificial Sequence
  Description of Artificial Sequence: Synthetic peptide
  RC5[PD-L1] vhCDR2
NIKQDGSEKYYVDSVKG

SEQ ID NO: 37230 - protein, 12 aa, Artificial Sequence
  Description of Artificial Sequence: Synthetic peptide
  RC5[PD-L1] vhCDR3
DRYYNFPLGMDV

SEQ ID NO: 37231 - protein, 107 aa, Artificial Sequence
  Description of Artificial Sequence: Synthetic polypeptide
  RC5[PD-L1] variable light Chain
AIRMTQSPSSLSASVGDRVTITCRASQSISSYLNWYQQKPGKAPKLLIYTTSSLKSGVPSRFSGSGSGTDFTLTISRLQPEDFATYYCQQSYSSTWTFGRGTKVEIK

SEQ ID NO: 37232 - protein, 11 aa, Artificial Sequence
  Description of Artificial Sequence: Synthetic peptide
  RC5[PD-L1] vlCDR1
RASQSISSYLN

SEQ ID NO: 37233 - protein, 7 aa, Artificial Sequence
  Description of Artificial Sequence: Synthetic peptide
  RC5[PD-L1] vlCDR2
TTSSLKS

SEQ ID NO: 37234 - protein, 9 aa, Artificial Sequence
  Description of Artificial Sequence: Synthetic peptide
  RC5[PD-L1] vlCDR3
QQSYSSTWT

SEQ ID NO: 37235 - protein, 123 aa, Artificial Sequence
  Description of Artificial Sequence: Synthetic polypeptide
  SH1A1Q[PD-L1] variable heavy Chain
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGTIYDSSGYSFDYWGQGTLVTVSS

SEQ ID NO: 37236 - protein, 5 aa, Artificial Sequence
  Description of Artificial Sequence: Synthetic peptide
  SH1A1Q[PD-L1] vhCDR1
SYAIS

SEQ ID NO: 37237 - protein, 17 aa, Artificial Sequence
  Description of Artificial Sequence: Synthetic peptide
  SH1A1Q[PD-L1] vhCDR2
GIIPIFGTANYAQKFQG

SEQ ID NO: 37238 - protein, 14 aa, Artificial Sequence
  Description of Artificial Sequence: Synthetic peptide
  SH1A1Q[PD-L1] vhCDR3
EGTIYDSSGYSFDY

SEQ ID NO: 37239 - protein, 110 aa, Artificial Sequence
  Description of Artificial Sequence: Synthetic polypeptide
  SH1A1Q[PD-L1] variable light Chain
QSVLTQPPSVSAAPGQKVTISCSGNNSNIANNYVSWYQQLPGTAPKLLIYDNNYRPSGIPDRFSGSKSGTSATLDITGLQTGDEADYYCGVWDGSLTTGVFGGGTKLTVL

SEQ ID NO: 37240 - protein, 13 aa, Artificial Sequence
  Description of Artificial Sequence: Synthetic peptide
  SH1A1Q[PD-L1] vlCDR1
SGNNSNIANNYVS

SEQ ID NO: 37241 - protein, 7 aa, Artificial Sequence
  Description of Artificial Sequence: Synthetic peptide
  SH1A1Q[PD-L1] vlCDR2
DNNYRPS

SEQ ID NO: 37242 - protein, 11 aa, Artificial Sequence
  Description of Artificial Sequence: Synthetic peptide
  SH1A1Q[PD-L1] vlCDR3
GVWDGSLTTGV

SEQ ID NO: 37243 - protein, 118 aa, Artificial Sequence
  Description of Artificial Sequence: Synthetic polypeptide
  SH1B3[PD-L1] variable heavy Chain
QVQLVESGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 37244 - protein, 5 aa, Artificial Sequence
  Description of Artificial Sequence: Synthetic peptide
  SH1B3[PD-L1] vhCDR1
SYAMH

SEQ ID NO: 37245 - protein, 17 aa, Artificial Sequence
  Description of Artificial Sequence: Synthetic peptide
  SH1B3[PD-L1] vhCDR2
VISFDGSNKYYADSVRG

SEQ ID NO: 37246 - protein, 9 aa, Artificial Sequence
  Description of Artificial Sequence: Synthetic peptide
  SH1B3[PD-L1] vhCDR3
GWLDRDIDY

SEQ ID NO: 37247 - protein, 110 aa, Artificial Sequence
  Description of Artificial Sequence: Synthetic polypeptide
  SH1B3[PD-L1] variable light Chain
LPVLTQPASVSGSPGQSITISCTGTTSDIGGYDYVSWYQQHPGKAPKLMIYDVSKRPSGVSNRFSGSKSGNTASLTISGLQAEDEADYYCSSYTSSSTHVFGTGTKLTVL

SEQ ID NO: 37248 - protein, 14 aa, Artificial Sequence
  Description of Artificial Sequence: Synthetic peptide
  SH1B3[PD-L1] vlCDR1
TGTTSDIGGYDYVS

SEQ ID NO: 37249 - protein, 7 aa, Artificial Sequence
  Description of Artificial Sequence: Synthetic peptide
  SH1B3[PD-L1] vlCDR2
DVSKRPS

SEQ ID NO: 37250 - protein, 10 aa, Artificial Sequence
  Description of Artificial Sequence: Synthetic peptide
  SH1B3[PD-L1] vlCDR3
SSYTSSSTHV

SEQ ID NO: 37251 - protein, 118 aa, Artificial Sequence
  Description of Artificial Sequence: Synthetic polypeptide
  SH1D1[PD-L1] variable heavy Chain
EVQLVESGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 37252 - protein, 5 aa, Artificial Sequence
  Description of Artificial Sequence: Synthetic peptide
  SH1D1[PD-L1] vhCDR1
SYAMH

SEQ ID NO: 37253 - protein, 17 aa, Artificial Sequence
  Description of Artificial Sequence: Synthetic peptide
  SH1D1[PD-L1] vhCDR2
VISFDGSNKYYADSVRG

SEQ ID NO: 37254 - protein, 9 aa, Artificial Sequence
  Description of Artificial Sequence: Synthetic peptide
  SH1D1[PD-L1] vhCDR3
GWLDRDIDY

SEQ ID NO: 37255 - protein, 111 aa, Artificial Sequence
  Description of Artificial Sequence: Synthetic polypeptide
  SH1D1[PD-L1] variable light Chain
QSALTQPASVSGSPGQSITISCTGTSSDVGGYNYVSWYQQHPGKAPKLMIYDVSNRPSGVSNRFSGSKSGNTASLTISGLQAEDEADYYCSSYRSSTLGPVFGGGTKLTVL

SEQ ID NO: 37256 - protein, 14 aa, Artificial Sequence
  Description of Artificial Sequence: Synthetic peptide
  SH1D1[PD-L1] vlCDR1
TGTSSDVGGYNYVS

SEQ ID NO: 37257 - protein, 7 aa, Artificial Sequence
  Description of Artificial Sequence: Synthetic peptide
  SH1D1[PD-L1] vlCDR2
DVSNRPS

SEQ ID NO: 37258 - protein, 11 aa, Artificial Sequence
  Description of Artificial Sequence: Synthetic peptide
  SH1D1[PD-L1] vlCDR3
SSYRSSTLGPV

SEQ ID NO: 37259 - protein, 118 aa, Artificial Sequence; identical to SEQ ID NO: 37243
  Description of Artificial Sequence: Synthetic polypeptide
  SH1D2[PD-L1] variable heavy Chain

SEQ ID NO: 37260 - protein, 5 aa, Artificial Sequence
  Description of Artificial Sequence: Synthetic peptide
  SH1D2[PD-L1] vhCDR1
SYAMH

SEQ ID NO: 37261 - protein, 17 aa, Artificial Sequence
  Description of Artificial Sequence: Synthetic peptide
  SH1D2[PD-L1] vhCDR2
VISFDGSNKYYADSVRG

SEQ ID NO: 37262 - protein, 9 aa, Artificial Sequence
  Description of Artificial Sequence: Synthetic peptide
  SH1D2[PD-L1] vhCDR3
GWLDRDIDY

SEQ ID NO: 37263 - protein, 110 aa, Artificial Sequence
  Description of Artificial Sequence: Synthetic polypeptide
  SH1D2[PD-L1] variable light Chain
QAGLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGYVFGTGTKLTVL

SEQ ID NO: 37264 - protein, 13 aa, Artificial Sequence
  Description of Artificial Sequence: Synthetic peptide
  SH1D2[PD-L1] vlCDR1
SGSSSNIGNNAVN

SEQ ID NO: 37265 - protein, 7 aa, Artificial Sequence
  Description of Artificial Sequence: Synthetic peptide
  SH1D2[PD-L1] vlCDR2
YDDLLPS

SEQ ID NO: 37266 - protein, 11 aa, Artificial Sequence
  Description of Artificial Sequence: Synthetic peptide
  SH1D2[PD-L1] vlCDR3
AAWDDSLNGYV

SEQ ID NO: 37267 - protein, 118 aa, Artificial Sequence; identical to SEQ ID NO: 37251
  Description of Artificial Sequence: Synthetic polypeptide
  SH1D12[PD-L1] variable heavy Chain

SEQ ID NO: 37268 - protein, 5 aa, Artificial Sequence
  Description of Artificial Sequence: Synthetic peptide
  SH1D12[PD-L1] vhCDR1
SYAMH

SEQ ID NO: 37269 - protein, 17 aa, Artificial Sequence
  Description of Artificial Sequence: Synthetic peptide
  SH1D12[PD-L1] vhCDR2
VISFDGSNKYYADSVRG

SEQ ID NO: 37270 - protein, 9 aa, Artificial Sequence
  Description of Artificial Sequence: Synthetic peptide
  SH1D12[PD-L1] vhCDR3
GWLDRDIDY

SEQ ID NO: 37271 - protein, 110 aa, Artificial Sequence
  Description of Artificial Sequence: Synthetic polypeptide
  SH1D12[PD-L1] variable light Chain
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSTTHVFGTGTKVTVL

SEQ ID NO: 37272 - protein, 14 aa, Artificial Sequence
  Description of Artificial Sequence: Synthetic peptide
  SH1D12[PD-L1] vlCDR1
TGTSSDVGGYNYVS

SEQ ID NO: 37273 - protein, 7 aa, Artificial Sequence
  Description of Artificial Sequence: Synthetic peptide
  SH1D12[PD-L1] vlCDR2
DVSKRPS

SEQ ID NO: 37274 - protein, 10 aa, Artificial Sequence
  Description of Artificial Sequence: Synthetic peptide
  SH1D12[PD-L1] vlCDR3
SSYTSSTTHV

SEQ ID NO: 37275 - protein, 118 aa, Artificial Sequence; identical to SEQ ID NO: 37251
  Description of Artificial Sequence: Synthetic polypeptide
  SH1E1[PD-L1] variable heavy Chain

SEQ ID NO: 37276 - protein, 5 aa, Artificial Sequence
  Description of Artificial Sequence: Synthetic peptide
  SH1E1[PD-L1] vhCDR1
SYAMH

SEQ ID NO: 37277 - protein, 17 aa, Artificial Sequence
  Description of Artificial Sequence: Synthetic peptide
  SH1E1[PD-L1] vhCDR2
VISFDGSNKYYADSVRG

SEQ ID NO: 37278 - protein, 9 aa, Artificial Sequence
  Description of Artificial Sequence: Synthetic peptide
  SH1E1[PD-L1] vhCDR3
GWLDRDIDY

SEQ ID NO: 37279 - protein, 110 aa, Artificial Sequence
  Description of Artificial Sequence: Synthetic polypeptide
  SH1E1[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSVWVFGGGTQLTVL

SEQ ID NO: 37280 - protein, 13 aa, Artificial Sequence
  Description of Artificial Sequence: Synthetic peptide
  SH1E1[PD-L1] vlCDR1
SGSSSNIGNNYVS

SEQ ID NO: 37281 - protein, 7 aa, Artificial Sequence
  Description of Artificial Sequence: Synthetic peptide
  SH1E1[PD-L1] vlCDR2
DNNKRPS

SEQ ID NO: 37282 - protein, 11 aa, Artificial Sequence
  Description of Artificial Sequence: Synthetic peptide
  SH1E1[PD-L1] vlCDR3
GTWDSSLSVWV

SEQ ID NO: 37283 - protein, 118 aa, Artificial Sequence; identical to SEQ ID NO: 37243
  Description of Artificial Sequence: Synthetic polypeptide
  SH1G9[PD-L1] variable heavy Chain

SEQ ID NO: 37284 - protein, 5 aa, Artificial Sequence
  Description of Artificial Sequence: Synthetic peptide
  SH1G9[PD-L1] vhCDR1
SYAMH

SEQ ID NO: 37285 - protein, 17 aa, Artificial Sequence
  Description of Artificial Sequence: Synthetic peptide
  SH1G9[PD-L1] vhCDR2
VISFDGSNKYYADSVRG

SEQ ID NO: 37286 - protein, 9 aa, Artificial Sequence
  Description of Artificial Sequence: Synthetic peptide
  SH1G9[PD-L1] vhCDR3
GWLDRDIDY

SEQ ID NO: 37287 - protein, 112 aa, Artificial Sequence
  Description of Artificial Sequence: Synthetic polypeptide
  SH1G9[PD-L1] variable light Chain
QSVLTQPASVSGSPGQSITISCTGTSSDVGGYNYVSWYQQHPGRAPRLMIYDVSNRPSGVSNRFSGSKSGNTASLTISGLQAEDEGDYYCSSYTSGGTLGPVFGGGTKLTVL

SEQ ID NO: 37288 - protein, 14 aa, Artificial Sequence
  Description of Artificial Sequence: Synthetic peptide
  SH1G9[PD-L1] vlCDR1
TGTSSDVGGYNYVS

SEQ ID NO: 37289 - protein, 7 aa, Artificial Sequence
  Description of Artificial Sequence: Synthetic peptide
  SH1G9[PD-L1] vlCDR2
DVSNRPS

SEQ ID NO: 37290 - protein, 12 aa, Artificial Sequence
  Description of Artificial Sequence: Synthetic peptide
  SH1G9[PD-L1] vlCDR3
SSYTSGGTLGPV

SEQ ID NO: 37291 - protein, 120 aa, Artificial Sequence
  Description of Artificial Sequence: Synthetic polypeptide
  SH1E6[PD-L1] variable heavy Chain
QVQLVQSGAEVKKPGSSVKVSCKASGGTFSRYGVHWVRQAPGQGLEWMGRLIPIVSMTNYAQKFQDRVSITTDKSTGTAYMELRSLTSEDTALYYCASVGQQLPWVFFAWGQGTLVTVSS

SEQ ID NO: 37292 - protein, 5 aa, Artificial Sequence
  Description of Artificial Sequence: Synthetic peptide
  SH1E6[PD-L1] vhCDR1
RYGVH

SEQ ID NO: 37293 - protein, 17 aa, Artificial Sequence
  Description of Artificial Sequence: Synthetic peptide
  SH1E6[PD-L1] vhCDR2
RLIPIVSMTNYAQKFQD

SEQ ID NO: 37294 - protein, 11 aa, Artificial Sequence
  Description of Artificial Sequence: Synthetic peptide
  SH1E6[PD-L1] vhCDR3
VGQQLPWVFFA

SEQ ID NO: 37295 - protein, 110 aa, Artificial Sequence
  Description of Artificial Sequence: Synthetic polypeptide
  SH1E6[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVL

SEQ ID NO: 37296 - protein, 13 aa, Artificial Sequence
  Description of Artificial Sequence: Synthetic peptide
  SH1E6[PD-L1] vlCDR1
SGSSSNIGNNYVS

SEQ ID NO: 37297 - protein, 7 aa, Artificial Sequence
  Description of Artificial Sequence: Synthetic peptide
  SH1E6[PD-L1] vlCDR2
DNNKRPS

SEQ ID NO: 37298 - protein, 11 aa, Artificial Sequence
  Description of Artificial Sequence: Synthetic peptide
  SH1E6[PD-L1] vlCDR3
GTWDSSLSAVV

SEQ ID NO: 37299 - protein, 118 aa, Artificial Sequence
  Description of Artificial Sequence: Synthetic polypeptide
  SH1A2[PD-L1] variable heavy Chain
QMQLVQSGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 37300 - protein, 5 aa, Artificial Sequence
  Description of Artificial Sequence: Synthetic peptide
  SH1A2[PD-L1] vhCDR1
SYAMH

SEQ ID NO: 37301 - protein, 17 aa, Artificial Sequence
  Description of Artificial Sequence: Synthetic peptide
  SH1A2[PD-L1] vhCDR2
VISFDGSNKYYADSVRG

SEQ ID NO: 37302 - protein, 9 aa, Artificial Sequence
  Description of Artificial Sequence: Synthetic peptide
  SH1A2[PD-L1] vhCDR3
GWLDRDIDY

SEQ ID NO: 37303 - protein, 110 aa, Artificial Sequence
  Description of Artificial Sequence: Synthetic polypeptide
  SH1A2[PD-L1] variable light Chain
QSVVTQPPSVSAAPGQKVTISCSGSSSNIGNNYVSWYQQVPGTAPKLLIYDNNKRPSGIPDRFSGSNSDTSATLGITGLQTGDEADYYCGTWDSSLSAWVFGGGTKLTVL

SEQ ID NO: 37304 - protein, 13 aa, Artificial Sequence
  Description of Artificial Sequence: Synthetic peptide
  SH1A2[PD-L1] vlCDR1
SGSSSNIGNNYVS

SEQ ID NO: 37305 - protein, 7 aa, Artificial Sequence
  Description of Artificial Sequence: Synthetic peptide
  SH1A2[PD-L1] vlCDR2
DNNKRPS

SEQ ID NO: 37306 - protein, 11 aa, Artificial Sequence
  Description of Artificial Sequence: Synthetic peptide
  SH1A2[PD-L1] vlCDR3
GTWDSSLSAWV

SEQ ID NO: 37307 - protein, 118 aa, Artificial Sequence
  Description of Artificial Sequence: Synthetic polypeptide
  SH1B1[PD-L1] variable heavy Chain
QVQLVQSGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 37308 - protein, 5 aa, Artificial Sequence
  Description of Artificial Sequence: Synthetic peptide
  SH1B1[PD-L1] vhCDR1
SYAMH

SEQ ID NO: 37309 - protein, 17 aa, Artificial Sequence
  Description of Artificial Sequence: Synthetic peptide
  SH1B1[PD-L1] vhCDR2
VISFDGSNKYYADSVRG

SEQ ID NO: 37310 - protein, 9 aa, Artificial Sequence
  Description of Artificial Sequence: Synthetic peptide
  SH1B1[PD-L1] vhCDR3
GWLDRDIDY

SEQ ID NO: 37311 - protein, 112 aa, Artificial Sequence
  Description of Artificial Sequence: Synthetic polypeptide
  SH1B1[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGSVVFGGGTKLTVL

SEQ ID NO: 37312 - protein, 13 aa, Artificial Sequence
  Description of Artificial Sequence: Synthetic peptide
  SH1B1[PD-L1] vlCDR1
SGSSSNIGNNYVS

SEQ ID NO: 37313 - protein, 7 aa, Artificial Sequence
  Description of Artificial Sequence: Synthetic peptide
  SH1B1[PD-L1] vlCDR2
DNNKRPS

SEQ ID NO: 37314 - protein, 13 aa, Artificial Sequence
  Description of Artificial Sequence: Synthetic peptide
  SH1B1[PD-L1] vlCDR3
GTWDSSLSAGSVV

SEQ ID NO: 37315 - protein, 121 aa, Artificial Sequence
  Description of Artificial Sequence: Synthetic polypeptide
  H6B1L[PD-L1] variable heavy Chain
QMQLVQSGAEVKKPGSSVKVSCKASGGTFSSYAYSWVRQAPGQGLEWMGGIIPSFGTANYAQKFQGRVTITADESTSTAYMELSSLRSEDTAVYYCARGPIVATITPLDYWGQGTLVTVSS

SEQ ID NO: 37316 - protein, 5 aa, Artificial Sequence
  Description of Artificial Sequence: Synthetic peptide
  H6B1L[PD-L1] vhCDR1
SYAYS

SEQ ID NO: 37317 - protein, 17 aa, Artificial Sequence
  Description of Artificial Sequence: Synthetic peptide
  H6B1L[PD-L1] vhCDR2
GIIPSFGTANYAQKFQG

SEQ ID NO: 37318 - protein, 12 aa, Artificial Sequence
  Description of Artificial Sequence: Synthetic peptide
  H6B1L[PD-L1] vhCDR3
GPIVATITPLDY

SEQ ID NO: 37319 - protein, 108 aa, Artificial Sequence
  Description of Artificial Sequence: Synthetic polypeptide
  H6B1L[PD-L1] variable light Chain
SYELMQPPSVSVAPGKTATIACGGENIGRKTVHWYQQKPGQAPVLVIYYDSDRPSGIPERFSGSNSGNTATLTISRVEAGDEADYYCLVWDSSSDHRIFGGGTKLTVL

SEQ ID NO: 37320 - protein, 11 aa, Artificial Sequence
  Description of Artificial Sequence: Synthetic peptide
  H6B1L[PD-L1] vlCDR1
GGENIGRKTVH

SEQ ID NO: 37321 - protein, 7 aa, Artificial Sequence
  Description of Artificial Sequence: Synthetic peptide
  H6B1L[PD-L1] vlCDR2
YDSDRPS

SEQ ID NO: 37322 - protein, 11 aa, Artificial Sequence
  Description of Artificial Sequence: Synthetic peptide
  H6B1L[PD-L1] vlCDR3
LVWDSSSDHRI

SEQ ID NO: 37323 - protein, 121 aa, Artificial Sequence
  Description of Artificial Sequence: Synthetic polypeptide
  H6A1[PD-L1] variable heavy Chain
QMQLVQSGAEVKKPGSSVKVSCKASGGTFSSYAYSWVRQAPGQGLEWMGGIIPIFGTANYAQKFQGRVTITADESTSTAYMELSSLRSEDTAVYYCARGPIVATITPLDYWGQGTLVTVSS

SEQ ID NO: 37324 - protein, 5 aa, Artificial Sequence
  Description of Artificial Sequence: Synthetic peptide
  H6A1[PD-L1] vhCDR1
SYAYS

SEQ ID NO: 37325 - protein, 17 aa, Artificial Sequence
  Description of Artificial Sequence: Synthetic peptide
  H6A1[PD-L1] vhCDR2
GIIPIFGTANYAQKFQG

SEQ ID NO: 37326 - protein, 12 aa, Artificial Sequence
  Description of Artificial Sequence: Synthetic peptide
  H6A1[PD-L1] vhCDR3
GPIVATITPLDY

SEQ ID NO: 37327 - protein, 108 aa, Artificial Sequence; identical to SEQ ID NO: 37223
  Description of Artificial Sequence: Synthetic polypeptide
  H6A1[PD-L1] variable light Chain

SEQ ID NO: 37328 - protein, 11 aa, Artificial Sequence
  Description of Artificial Sequence: Synthetic peptide
  H6A1[PD-L1] vlCDR1
GGENIGRKTVH

SEQ ID NO: 37329 - protein, 7 aa, Artificial Sequence
  Description of Artificial Sequence: Synthetic peptide
  H6A1[PD-L1] vlCDR2
YDSDRPS

SEQ ID NO: 37330 - protein, 11 aa, Artificial Sequence
  Description of Artificial Sequence: Synthetic peptide
  H6A1[PD-L1] vlCDR3
QVWDSSSDHRI

SEQ ID NO: 37331 - protein, 121 aa, Artificial Sequence; identical to SEQ ID NO: 37315
  Description of Artificial Sequence: Synthetic polypeptide
  H6B1[PD-L1] variable heavy Chain

SEQ ID NO: 37332 - protein, 5 aa, Artificial Sequence
  Description of Artificial Sequence: Synthetic peptide
  H6B1[PD-L1] vhCDR1
SYAYS

SEQ ID NO: 37333 - protein, 17 aa, Artificial Sequence
  Description of Artificial Sequence: Synthetic peptide
  H6B1[PD-L1] vhCDR2
GIIPSFGTANYAQKFQG

SEQ ID NO: 37334 - protein, 12 aa, Artificial Sequence
  Description of Artificial Sequence: Synthetic peptide
  H6B1[PD-L1] vhCDR3
GPIVATITPLDY

SEQ ID NO: 37335 - protein, 108 aa, Artificial Sequence; identical to SEQ ID NO: 37223
  Description of Artificial Sequence: Synthetic polypeptide
  H6B1[PD-L1] variable light Chain

SEQ ID NO: 37336 - protein, 11 aa, Artificial Sequence
  Description of Artificial Sequence: Synthetic peptide
  H6B1[PD-L1] vlCDR1
GGENIGRKTVH

SEQ ID NO: 37337 - protein, 7 aa, Artificial Sequence
  Description of Artificial Sequence: Synthetic peptide
  H6B1[PD-L1] vlCDR2
YDSDRPS

SEQ ID NO: 37338 - protein, 11 aa, Artificial Sequence
  Description of Artificial Sequence: Synthetic peptide
  H6B1[PD-L1] vlCDR3
QVWDSSSDHRI

SEQ ID NO: 37339 - protein, 121 aa, Artificial Sequence
  Description of Artificial Sequence: Synthetic polypeptide
  H6B2[PD-L1] variable heavy Chain
QMQLVQSGAEVKKPGSSVKVSCKASGGTFSSYAISWVRQAPGQGLEWMGGIIPAFGTANYAQKFQGRVTITADESTSTAYMELSSLRSEDTAVYYCARGPIVATITPLDYWGQGTLVTVSS

SEQ ID NO: 37340 - protein, 5 aa, Artificial Sequence
  Description of Artificial Sequence: Synthetic peptide
  H6B2[PD-L1] vhCDR1
SYAIS

SEQ ID NO: 37341 - protein, 17 aa, Artificial Sequence
  Description of Artificial Sequence: Synthetic peptide
  H6B2[PD-L1] vhCDR2
GIIPAFGTANYAQKFQG

SEQ ID NO: 37342 - protein, 12 aa, Artificial Sequence
  Description of Artificial Sequence: Synthetic peptide
  H6B2[PD-L1] vhCDR3
GPIVATITPLDY

SEQ ID NO: 37343 - protein, 108 aa, Artificial Sequence; identical to SEQ ID NO: 37223
  Description of Artificial Sequence: Synthetic polypeptide
  H6B2[PD-L1] variable light Chain

SEQ ID NO: 37344 - protein, 11 aa, Artificial Sequence
  Description of Artificial Sequence: Synthetic peptide
  H6B2[PD-L1] vlCDR1
GGENIGRKTVH

SEQ ID NO: 37345 - protein, 7 aa, Artificial Sequence
  Description of Artificial Sequence: Synthetic peptide
  H6B2[PD-L1] vlCDR2
YDSDRPS

SEQ ID NO: 37346 - protein, 11 aa, Artificial Sequence
  Description of Artificial Sequence: Synthetic peptide
  H6B2[PD-L1] vlCDR3
QVWDSSSDHRI

SEQ ID NO: 37347 - protein, 118 aa, Artificial Sequence
  Description of Artificial Sequence: Synthetic polypeptide
  G12[PD-L1] variable heavy Chain
EVQLVQSGAEVKKPGASVKVSCKASGYTFTGYYMHWVRQAPGQGLEWMGWINPNSDNTGSAQKFQGRVFMTKTTSLNTAYMELSGLRSEDTAIYYCARERSSGYFDFWGQGTLVTVSS

SEQ ID NO: 37348 - protein, 5 aa, Artificial Sequence
  Description of Artificial Sequence: Synthetic peptide
  G12[PD-L1] vhCDR1
GYYMH

SEQ ID NO: 37349 - protein, 17 aa, Artificial Sequence
  Description of Artificial Sequence: Synthetic peptide
  G12[PD-L1] vhCDR2
WINPNSDNTGSAQKFQG

SEQ ID NO: 37350 - protein, 9 aa, Artificial Sequence
  Description of Artificial Sequence: Synthetic peptide
  G12[PD-L1] vhCDR3
ERSSGYFDF

SEQ ID NO: 37351 - protein, 107 aa, Artificial Sequence
  Description of Artificial Sequence: Synthetic polypeptide
  G12[PD-L1] variable light Chain
DIVMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 37352 - protein, 11 aa, Artificial Sequence
  Description of Artificial Sequence: Synthetic peptide
  G12[PD-L1] vlCDR1
RASQSISSYLN

SEQ ID NO: 37353 - protein, 7 aa, Artificial Sequence
  Description of Artificial Sequence: Synthetic peptide
  G12[PD-L1] vlCDR2
AASSLQS

SEQ ID NO: 37354 - protein, 9 aa, Artificial Sequence
  Description of Artificial Sequence: Synthetic peptide
  G12[PD-L1] vlCDR3
QQSYSTPIT

SEQ ID NO: 37355 - protein, 118 aa, Artificial Sequence
  Description of Artificial Sequence: Synthetic polypeptide
  RSA1[PD-L1] variable heavy Chain
EVQLVQSGGGLVQPGGSLRLSCAASGFTFSSYSMNWVRQAPGKGLEWVSYISSSSSTIYYADSVKGRFTISRDNAKNSLYLQMNSLRDEDTAVYYCARGDYYYGMDVWGQGTTVTVSS

SEQ ID NO: 37356 - protein, 5 aa, Artificial Sequence
  Description of Artificial Sequence: Synthetic peptide
  RSA1[PD-L1] vhCDR1
SYSMN

SEQ ID NO: 37357 - protein, 17 aa, Artificial Sequence
  Description of Artificial Sequence: Synthetic peptide
  RSA1[PD-L1] vhCDR2
YISSSSSTIYYADSVKG

SEQ ID NO: 37358 - protein, 9 aa, Artificial Sequence
  Description of Artificial Sequence: Synthetic peptide
  RSA1[PD-L1] vhCDR3
GDYYYGMDV

SEQ ID NO: 37359 - protein, 108 aa, Artificial Sequence
  Description of Artificial Sequence: Synthetic polypeptide
  RSA1[PD-L1] variable light Chain
NIQMTQSPSSVSASVGDRVTITCRASQDISRWLAWYQQKPGKAPKLLIYAASSLQSGVPSRFSGSGSGTDFALTISSLQPEDFATYYCQQADSFFSITFGQGTRLEIK

SEQ ID NO: 37360 - protein, 11 aa, Artificial Sequence
  Description of Artificial Sequence: Synthetic peptide
  RSA1[PD-L1] vlCDR1
RASQDISRWLA

SEQ ID NO: 37361 - protein, 7 aa, Artificial Sequence
  Description of Artificial Sequence: Synthetic peptide
  RSA1[PD-L1] vlCDR2
AASSLQS

SEQ ID NO: 37362 - protein, 10 aa, Artificial Sequence
  Description of Artificial Sequence: Synthetic peptide
  RSA1[PD-L1] vlCDR3
QQADSFFSIT

SEQ ID NO: 37363 - protein, 120 aa, Artificial Sequence
  Description of Artificial Sequence: Synthetic polypeptide
  RA3[PD-L1] variable heavy Chain
QMQLVQSGAEVKKPGSSVKVSCKASGGTFSRYGVHWVRQAPGQGLEWMGRLIPIVSMTNYAQKFQDRVSITTDKSTGTAYMELRSLTSEDTALYYCASVGQQLPWVFFAWGQGTLVTVSS

SEQ ID NO: 37364 - protein, 5 aa, Artificial Sequence
  Description of Artificial Sequence: Synthetic peptide
  RA3[PD-L1] vhCDR1
RYGVH

SEQ ID NO: 37365 - protein, 17 aa, Artificial Sequence
  Description of Artificial Sequence: Synthetic peptide
  RA3[PD-L1] vhCDR2
RLIPIVSMTNYAQKFQD

SEQ ID NO: 37366 - protein, 11 aa, Artificial Sequence
  Description of Artificial Sequence: Synthetic peptide
  RA3[PD-L1] vhCDR3
VGQQLPWVFFA

SEQ ID NO: 37367 - protein, 107 aa, Artificial Sequence
  Description of Artificial Sequence: Synthetic polypeptide
  RA3[PD-L1] variable light Chain
DIQMTQSPSSLSASVGDRVTITCQASQDISNYLNWYQQKPGKAPKLLIYDASTLQSGVPSRFSGSGSGTDFTLTISSLQPEDFATYYCQQSYSSHWTFGQGTKVEIK

SEQ ID NO: 37368 - protein, 11 aa, Artificial Sequence
  Description of Artificial Sequence: Synthetic peptide
  RA3[PD-L1] vlCDR1
QASQDISNYLN

SEQ ID NO: 37369 - protein, 7 aa, Artificial Sequence
  Description of Artificial Sequence: Synthetic peptide
  RA3[PD-L1] vlCDR2
DASTLQS

SEQ ID NO: 37370 - protein, 9 aa, Artificial Sequence
  Description of Artificial Sequence: Synthetic peptide
  RA3[PD-L1] vlCDR3
QQSYSSHWT

SEQ ID NO: 37371 - protein, 119 aa, Artificial Sequence
  Description of Artificial Sequence: Synthetic polypeptide
  SH1E2[PD-L1] variable heavy Chain
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARAPYYYYYMDVWGQGTTVTVSS

SEQ ID NO: 37372 - protein, 5 aa, Artificial Sequence
  Description of Artificial Sequence: Synthetic peptide
  SH1E2[PD-L1] vhCDR1
SYAIS

SEQ ID NO: 37373 - protein, 17 aa, Artificial Sequence
  Description of Artificial Sequence: Synthetic peptide
  SH1E2[PD-L1] vhCDR2
GIIPIFGTANYAQKFQG

SEQ ID NO: 37374 - protein, 10 aa, Artificial Sequence
  Description of Artificial Sequence: Synthetic peptide
  SH1E2[PD-L1] vhCDR3
APYYYYYMDV

SEQ ID NO: 37375 - protein, 109 aa, Artificial Sequence
  Description of Artificial Sequence: Synthetic polypeptide
  SH1E2[PD-L1] variable light Chain
QSALTQPASVSGSLGQSVTISCTGSSSDVGSYNLVSWYQQHPGKAPNLMIYDVSKRSGVSNRFSGSKSGNTASLTISGLQAEDEADYYCSSYTGISTVVFGGGTKLTVL

SEQ ID NO: 37376 - protein, 14 aa, Artificial Sequence
  Description of Artificial Sequence: Synthetic peptide
  SH1E2[PD-L1] vlCDR1
TGSSSDVGSYNLVS

SEQ ID NO: 37377 - protein, 6 aa, Artificial Sequence
  Description of Artificial Sequence: Synthetic peptide
  SH1E2[PD-L1] vlCDR2
DVSKRS

SEQ ID NO: 37378 - protein, 10 aa, Artificial Sequence
  Description of Artificial Sequence: Synthetic peptide
  SH1E2[PD-L1] vlCDR3
SSYTGISTVV

SEQ ID NO: 37379 - protein, 120 aa, Artificial Sequence; identical to SEQ ID NO: 37291
  Description of Artificial Sequence: Synthetic polypeptide
  SH1E4[PD-L1] variable heavy Chain

SEQ ID NO: 37380 - protein, 5 aa, Artificial Sequence
  Description of Artificial Sequence: Synthetic peptide
  SH1E4[PD-L1] vhCDR1
RYGVH

SEQ ID NO: 37381 - protein, 17 aa, Artificial Sequence
  Description of Artificial Sequence: Synthetic peptide
  SH1E4[PD-L1] vhCDR2
RLIPIVSMTNYAQKFQD

SEQ ID NO: 37382 - protein, 11 aa, Artificial Sequence
  Description of Artificial Sequence: Synthetic peptide
  SH1E4[PD-L1] vhCDR3
VGQQLPWVFFA

SEQ ID NO: 37383 - protein, 112 aa, Artificial Sequence
  Description of Artificial Sequence: Synthetic polypeptide
  SH1E4[PD-L1] variable light Chain
QSVLTQPPSASGSPGQSVTISCTGTSSDIGGYDSVSWYQQHPGKAPKLMIYDVSKRPSGVSNRFSGSKSGNTASLTISGLQAEDEADYYCSSYTSSSIFFYVFGTGTKVTVL

SEQ ID NO: 37384 - protein, 14 aa, Artificial Sequence
  Description of Artificial Sequence: Synthetic peptide
  SH1E4[PD-L1] vlCDR1
TGTSSDIGGYDSVS

SEQ ID NO: 37385 - protein, 7 aa, Artificial Sequence
  Description of Artificial Sequence: Synthetic peptide
  SH1E4[PD-L1] vlCDR2
DVSKRPS

SEQ ID NO: 37386 - protein, 12 aa, Artificial Sequence
  Description of Artificial Sequence: Synthetic peptide
  SH1E4[PD-L1] vlCDR3
SSYTSSSIFFYV

SEQ ID NO: 37387 - protein, 121 aa, Artificial Sequence
  Description of Artificial Sequence: Synthetic polypeptide
  SH1B11[PD-L1] variable heavy Chain
QVQLVQSGSELKKPGSSVKVSCKASGYSFSGYYIHWVRQAPGQGLEWMGWIDPNSGVTNYVRRFQGRVTMTRDTSLSTAYMELSGLTADDTAVYYCARDENLWQFGYLDYWGQGTLVTVSS

SEQ ID NO: 37388 - protein, 5 aa, Artificial Sequence
  Description of Artificial Sequence: Synthetic peptide
  SH1B11[PD-L1] vhCDR1
GYYIH

SEQ ID NO: 37389 - protein, 17 aa, Artificial Sequence
  Description of Artificial Sequence: Synthetic peptide
  SH1B11[PD-L1] vhCDR2
WIDPNSGVTNYVRRFQG

SEQ ID NO: 37390 - protein, 12 aa, Artificial Sequence
  Description of Artificial Sequence: Synthetic peptide
  SH1B11[PD-L1] vhCDR3
DENLWQFGYLDY

SEQ ID NO: 37391 - protein, 107 aa, Artificial Sequence
  Description of Artificial Sequence: Synthetic polypeptide
  SH1B11[PD-L1] variable light Chain
DIVMTQSPSSLSASIGDRVTITCRASQRISAYVNWYQQKPGKAPKVLIYAASSLRSGVPSRFSGSGSGTDFTLTISSLQPEDFATYYCQQTYSSPWTFGQGTKVEIK

SEQ ID NO: 37392 - protein, 11 aa, Artificial Sequence
  Description of Artificial Sequence: Synthetic peptide
  SH1B11[PD-L1] vlCDR1
RASQRISAYVN

SEQ ID NO: 37393 - protein, 7 aa, Artificial Sequence
  Description of Artificial Sequence: Synthetic peptide
  SH1B11[PD-L1] vlCDR2
AASSLRS

SEQ ID NO: 37394 - protein, 9 aa, Artificial Sequence
  Description of Artificial Sequence: Synthetic peptide
  SH1B11[PD-L1] vlCDR3
QQTYSSPWT

SEQ ID NO: 37395 - protein, 119 aa, Artificial Sequence
  Description of Artificial Sequence: Synthetic polypeptide
  SH1C8[PD-L1] variable heavy Chain
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGQWLVTELDYWGQGTLVTVSS

SEQ ID NO: 37396 - protein, 5 aa, Artificial Sequence
  Description of Artificial Sequence: Synthetic peptide
  SH1C8[PD-L1] vhCDR1
SYAMH

SEQ ID NO: 37397 - protein, 17 aa, Artificial Sequence
  Description of Artificial Sequence: Synthetic peptide
  SH1C8[PD-L1] vhCDR2
VISYDGSNKYYADSVKG

SEQ ID NO: 37398 - protein, 10 aa, Artificial Sequence
  Description of Artificial Sequence: Synthetic peptide
  SH1C8[PD-L1] vhCDR3
GQWLVTELDY

SEQ ID NO: 37399 - protein, 111 aa, Artificial Sequence
  Description of Artificial Sequence: Synthetic polypeptide
  SH1C8[PD-L1] variable light Chain
QSVVTQPPSVSAAPGQKVTISCSGSSSDIGNHYVSWYQQLPGTAPKLLIYDNNQRPSGIPDRFSGSKSGTSATLAITGLQTGDEADYYCGTWDNSLSPHLLFGGGTKLTVL

SEQ ID NO: 37400 - protein, 13 aa, Artificial Sequence
  Description of Artificial Sequence: Synthetic peptide
  SH1C8[PD-L1] vlCDR1
SGSSSDIGNHYVS

SEQ ID NO: 37401 - protein, 7 aa, Artificial Sequence
  Description of Artificial Sequence: Synthetic peptide
  SH1C8[PD-L1] vlCDR2
DNNQRPS

SEQ ID NO: 37402 - protein, 12 aa, Artificial Sequence
  Description of Artificial Sequence: Synthetic peptide
  SH1C8[PD-L1] vlCDR3
GTWDNSLSPHLL

SEQ ID NO: 37403 - protein, 123 aa, Artificial Sequence
  Description of Artificial Sequence: Synthetic polypeptide
  H1H9364P2[PD-L1] variable heavy Chain
EVQLVESGGGLVQPGRSLRLSCAASGFTFDDYALHWVRQAPGKGLEWVSGISWTGGTIDYADSVKGRFTISRDNAKNSLYLQMSSLRTEDTAIYYCTRDIRGNWKYGGWFDPWGQGTLVTVSS

SEQ ID NO: 37404 - protein, 5 aa, Artificial Sequence
  Description of Artificial Sequence: Synthetic peptide
  H1H9364P2[PD-L1] vhCDR1
DYALH

SEQ ID NO: 37405 - protein, 17 aa, Artificial Sequence
  Description of Artificial Sequence: Synthetic peptide
  H1H9364P2[PD-L1] vhCDR2
GISWTGGTIDYADSVKG

SEQ ID NO: 37406 - protein, 14 aa, Artificial Sequence
  Description of Artificial Sequence: Synthetic peptide
  H1H9364P2[PD-L1] vhCDR3
DIRGNWKYGGWFDP

SEQ ID NO: 37407 - protein, 108 aa, Artificial Sequence; identical to SEQ ID NO: 11711
  Description of Artificial Sequence: Synthetic polypeptide
  H1H9364P2[PD-L1] variable light Chain

SEQ ID NO: 37408 - protein, 11 aa, Artificial Sequence
  Description of Artificial Sequence: Synthetic peptide
  H1H9364P2[PD-L1] vlCDR1
RASQSISSYLN

SEQ ID NO: 37409 - protein, 7 aa, Artificial Sequence
  Description of Artificial Sequence: Synthetic peptide
  H1H9364P2[PD-L1] vlCDR2
AASSLQS

SEQ ID NO: 37410 - protein, 10 aa, Artificial Sequence
  Description of Artificial Sequence: Synthetic peptide
  H1H9364P2[PD-L1] vlCDR3
QQSYSTPPIT

SEQ ID NO: 37411 - protein, 120 aa, Artificial Sequence
  Description of Artificial Sequence: Synthetic polypeptide
  H1H9373P2[PD-L1] variable heavy Chain
QVQLVQSGTEVKKPGASVKVSCKASGYTFTAYYMHWVRQAPGQGLDWMGWISPNSGFTNYAQKFQGRVTMTRDTSINTFYMELSGLRSDDTAVYYCAREGSTHHNSFDPWGQGTLVTVSS

SEQ ID NO: 37412 - protein, 5 aa, Artificial Sequence
  Description of Artificial Sequence: Synthetic peptide
  H1H9373P2[PD-L1] vhCDR1
AYYMH

SEQ ID NO: 37413 - protein, 17 aa, Artificial Sequence
  Description of Artificial Sequence: Synthetic peptide
  H1H9373P2[PD-L1] vhCDR2
WISPNSGFTNYAQKFQG

SEQ ID NO: 37414 - protein, 11 aa, Artificial Sequence
  Description of Artificial Sequence: Synthetic peptide
  H1H9373P2[PD-L1] vhCDR3
EGSTHHNSFDP

SEQ ID NO: 37415 - protein, 108 aa, Artificial Sequence; identical to SEQ ID NO: 11711
  Description of Artificial Sequence: Synthetic polypeptide
  H1H9373P2[PD-L1] variable light Chain

SEQ ID NO: 37416 - protein, 11 aa, Artificial Sequence
  Description of Artificial Sequence: Synthetic peptide
  H1H9373P2[PD-L1] vlCDR1
RASQSISSYLN

SEQ ID NO: 37417 - protein, 7 aa, Artificial Sequence
  Description of Artificial Sequence: Synthetic peptide
  H1H9373P2[PD-L1] vlCDR2
AASSLQS

SEQ ID NO: 37418 - protein, 10 aa, Artificial Sequence
  Description of Artificial Sequence: Synthetic peptide
  H1H9373P2[PD-L1] vlCDR3
QQSYSTPPIT

SEQ ID NO: 37419 - protein, 120 aa, Artificial Sequence
  Description of Artificial Sequence: Synthetic polypeptide
  H1H8314N[PD-L1] variable heavy Chain
EVQLVESGGGVVRPGGSLRLSCAASGFTFDDYGMTWVRQAPGRGLEWVSGIHWHGKRTGYADSVKGRFTISRDNAKKSLYLQMNSLKGEDTALYHCVRGGMSTGDWFDPWGQGTLVIVSS

SEQ ID NO: 37420 - protein, 5 aa, Artificial Sequence
  Description of Artificial Sequence: Synthetic peptide
  H1H8314N[PD-L1] vhCDR1
DYGMT

SEQ ID NO: 37421 - protein, 17 aa, Artificial Sequence
  Description of Artificial Sequence: Synthetic peptide
  H1H8314N[PD-L1] vhCDR2
GIHWHGKRTGYADSVKG

SEQ ID NO: 37422 - protein, 11 aa, Artificial Sequence
  Description of Artificial Sequence: Synthetic peptide
  H1H8314N[PD-L1] vhCDR3
GGMSTGDWFDP

SEQ ID NO: 37423 - protein, 108 aa, Artificial Sequence
  Description of Artificial Sequence: Synthetic polypeptide
  H1H8314N[PD-L1] variable light Chain
DIQMTQSPSSLSASLGDRVTITCRASQSINSYLNWYQQKPGKAPKLLIYVASSLQSGVPSRFSGSGSGTEFTLTISNLQPEDFATYYCQQSYSTPPITFGQGTRLEIK

SEQ ID NO: 37424 - protein, 11 aa, Artificial Sequence
  Description of Artificial Sequence: Synthetic peptide
  H1H8314N[PD-L1] vlCDR1
RASQSINSYLN

SEQ ID NO: 37425 - protein, 7 aa, Artificial Sequence
  Description of Artificial Sequence: Synthetic peptide
  H1H8314N[PD-L1] vlCDR2
VASSLQS

SEQ ID NO: 37426 - protein, 10 aa, Artificial Sequence
  Description of Artificial Sequence: Synthetic peptide
  H1H8314N[PD-L1] vlCDR3
QQSYSTPPIT

SEQ ID NO: 37427 - protein, 119 aa, Artificial Sequence
  Description of Artificial Sequence: Synthetic polypeptide
  PDL1.3.1[PD-L1] variable heavy Chain
EVQLQQSGTELVKPGASVKLSCTTSGFNIQDTYMHWVKQRPEQGLEWIGWIDPANGNTKYDPKFQGKATIIADTSSNTAYLQLRGLTSEDTAVYYCARSGVSTAHFDYWGQGTTLTVSS

SEQ ID NO: 37428 - protein, 5 aa, Artificial Sequence
  Description of Artificial Sequence: Synthetic peptide
  PDL1.3.1[PD-L1] vhCDR1
DTYMH

SEQ ID NO: 37429 - protein, 17 aa, Artificial Sequence
  Description of Artificial Sequence: Synthetic peptide
  PDL1.3.1[PD-L1] vhCDR2
WIDPANGNTKYDPKFQG

SEQ ID NO: 37430 - protein, 10 aa, Artificial Sequence
  Description of Artificial Sequence: Synthetic peptide
  PDL1.3.1[PD-L1] vhCDR3
SGVSTAHFDY

SEQ ID NO: 37431 - protein, 106 aa, Artificial Sequence
  Description of Artificial Sequence: Synthetic polypeptide
  PDL1.3.1[PD-L1] variable light Chain
QIVLSQSPAILSASPGEKVTMTCRASSSVSFMHWYQQKPGSSPKPWIYATSNLASGVPTRFSGSGSGTSYSLTLSRVEAEDAATYYCQQWSSYPRTFGGGTKLEIK

SEQ ID NO: 37432 - protein, 10 aa, Artificial Sequence
  Description of Artificial Sequence: Synthetic peptide
  PDL1.3.1[PD-L1] vlCDR1
RASSSVSFMH

SEQ ID NO: 37433 - protein, 7 aa, Artificial Sequence
  Description of Artificial Sequence: Synthetic peptide
  PDL1.3.1[PD-L1] vlCDR2
ATSNLAS

SEQ ID NO: 37434 - protein, 9 aa, Artificial Sequence
  Description of Artificial Sequence: Synthetic peptide
  PDL1.3.1[PD-L1] vlCDR3
QQWSSYPRT

SEQ ID NO: 37435 - protein, 119 aa, Artificial Sequence; identical to SEQ ID NO: 21505
  Description of Artificial Sequence: Synthetic polypeptide
  10A7[TIGIT] variable heavy Chain

SEQ ID NO: 37436 - protein, 5 aa, Artificial Sequence
  Description of Artificial Sequence: Synthetic peptide
  10A7[TIGIT] vhCDR1
SFTMH

SEQ ID NO: 37437 - protein, 17 aa, Artificial Sequence
  Description of Artificial Sequence: Synthetic peptide
  10A7[TIGIT] vhCDR2
FIRSGSGIVFYADAVRG

SEQ ID NO: 37438 - protein, 10 aa, Artificial Sequence
  Description of Artificial Sequence: Synthetic peptide
  10A7[TIGIT] vhCDR3
RPLGHNTFDS

SEQ ID NO: 37439 - protein, 113 aa, Artificial Sequence; identical to SEQ ID NO: 21510
  Description of Artificial Sequence: Synthetic polypeptide
  10A7[TIGIT] variable light Chain

SEQ ID NO: 37440 - protein, 17 aa, Artificial Sequence
  Description of Artificial Sequence: Synthetic peptide
  10A7[TIGIT] vlCDR1
KSSQSLYYSGVKENLLA

SEQ ID NO: 37441 - protein, 7 aa, Artificial Sequence
  Description of Artificial Sequence: Synthetic peptide
  10A7[TIGIT] vlCDR2
YASIRFT

SEQ ID NO: 37442 - protein, 9 aa, Artificial Sequence
  Description of Artificial Sequence: Synthetic peptide
  10A7[TIGIT] vlCDR3
QQGINNPLT

SEQ ID NO: 37443 - protein, 119 aa, Artificial Sequence; identical to SEQ ID NO: 21515
  Description of Artificial Sequence: Synthetic polypeptide
  1F4[TIGIT] variable heavy Chain

SEQ ID NO: 37444 - protein, 5 aa, Artificial Sequence
  Description of Artificial Sequence: Synthetic peptide
  1F4[TIGIT] vhCDR1
GHLMN

SEQ ID NO: 37445 - protein, 17 aa, Artificial Sequence
  Description of Artificial Sequence: Synthetic peptide
  1F4[TIGIT] vhCDR2
LIIPYNGGTSYNQKFKG

SEQ ID NO: 37446 - protein, 10 aa, Artificial Sequence
  Description of Artificial Sequence: Synthetic peptide
  1F4[TIGIT] vhCDR3
GLRGFYAMDY

SEQ ID NO: 37447 - protein, 112 aa, Artificial Sequence; identical to SEQ ID NO: 21520
  Description of Artificial Sequence: Synthetic polypeptide
  1F4[TIGIT] variable light Chain

SEQ ID NO: 37448 - protein, 16 aa, Artificial Sequence
  Description of Artificial Sequence: Synthetic peptide
  1F4[TIGIT] vlCDR1
RSSQSLVNSYGNTFLS

SEQ ID NO: 37449 - protein, 7 aa, Artificial Sequence
  Description of Artificial Sequence: Synthetic peptide
  1F4[TIGIT] vlCDR2
GISNRFS

SEQ ID NO: 37450 - protein, 9 aa, Artificial Sequence
  Description of Artificial Sequence: Synthetic peptide
  1F4[TIGIT] vlCDR3
LQGTHQPPT

SEQ ID NO: 37451 - protein, 126 aa, Artificial Sequence
  Description of Artificial Sequence: Synthetic polypeptide
  4.1D3[TIGIT] variable heavy Chain
QVQLQQSGPGLVKPSQTLSLTCAISGDSVSSNSAAWNWIRQSPSRGLEWLGKTYYRFKWYSDYAVSVKGRITINPDTSKNQFSLQLNSVTPEDTAVFYCTRESTTYDLLAGPFDYWGQGTLVTVSS

SEQ ID NO: 37452 - protein, 7 aa, Artificial Sequence
  Description of Artificial Sequence: Synthetic peptide
  4.1D3[TIGIT] vhCDR1
SNSAAWN

SEQ ID NO: 37453 - protein, 18 aa, Artificial Sequence
  Description of Artificial Sequence: Synthetic peptide
  4.1D3[TIGIT] vhCDR2
KTYYRFKWYSDYAVSVKG

SEQ ID NO: 37454 - protein, 14 aa, Artificial Sequence
  Description of Artificial Sequence: Synthetic peptide
  4.1D3[TIGIT] vhCDR3
ESTTYDLLAGPFDY

SEQ ID NO: 37455 - protein, 113 aa, Artificial Sequence
  Description of Artificial Sequence: Synthetic polypeptide
  4.1D3[TIGIT] variable light Chain
DIVMTQSPDSLAVSLGERATINCKSSQTVLYSSNNKKYLAWYQQKPGQPPNLLIYWASTRESGVPDRFSGSGSGTDFTLTISSLQAEDVAVYYCQQYYSTPFTFGPGTKVEIK

SEQ ID NO: 37456 - protein, 17 aa, Artificial Sequence
  Description of Artificial Sequence: Synthetic peptide
  4.1D3[TIGIT] vlCDR1
KSSQTVLYSSNNKKYLA

SEQ ID NO: 37457 - protein, 7 aa, Artificial Sequence
  Description of Artificial Sequence: Synthetic peptide
  4.1D3[TIGIT] vlCDR2
WASTRES

SEQ ID NO: 37458 - protein, 9 aa, Artificial Sequence
  Description of Artificial Sequence: Synthetic peptide
  4.1D3[TIGIT] vlCDR3
QQYYSTPFT

SEQ ID NO: 37459 - protein, 126 aa, Artificial Sequence
  Description of Artificial Sequence: Synthetic polypeptide
  4.1D3.Q1E[TIGIT] variable heavy Chain
EVQLQQSGPGLVKPSQTLSLTCAISGDSVSSNSAAWNWIRQSPSRGLEWLGKTYYRFKWYSDYAVSVKGRITINPDTSKNQFSLQLNSVTPEDTAVFYCTRESTTYDLLAGPFDYWGQGTLVTVSS

SEQ ID NO: 37460 - protein, 7 aa, Artificial Sequence
  Description of Artificial Sequence: Synthetic peptide
  4.1D3.Q1E[TIGIT] vhCDR1
SNSAAWN

SEQ ID NO: 37461 - protein, 18 aa, Artificial Sequence
  Description of Artificial Sequence: Synthetic peptide
  4.1D3.Q1E[TIGIT] vhCDR2
KTYYRFKWYSDYAVSVKG

SEQ ID NO: 37462 - protein, 14 aa, Artificial Sequence
  Description of Artificial Sequence: Synthetic peptide
  4.1D3.Q1E[TIGIT] vhCDR3
ESTTYDLLAGPFDY

SEQ ID NO: 37463 - protein, 113 aa, Artificial Sequence; identical to SEQ ID NO: 37455
  Description of Artificial Sequence: Synthetic polypeptide
  4.1D3.Q1E[TIGIT] variable light Chain

SEQ ID NO: 37464 - protein, 17 aa, Artificial Sequence
  Description of Artificial Sequence: Synthetic peptide
  4.1D3.Q1E[TIGIT] vlCDR1
KSSQTVLYSSNNKKYLA

SEQ ID NO: 37465 - protein, 7 aa, Artificial Sequence
  Description of Artificial Sequence: Synthetic peptide
  4.1D3.Q1E[TIGIT] vlCDR2
WASTRES

SEQ ID NO: 37466 - protein, 9 aa, Artificial Sequence
  Description of Artificial Sequence: Synthetic peptide
  4.1D3.Q1E[TIGIT] vlCDR3
QQYYSTPFT

SEQ ID NO: 37467 - protein, 121 aa, Artificial Sequence
  Description of Artificial Sequence: Synthetic polypeptide
  Hu14D7 VH1[TIGIT] variable heavy Chain
EVQLVESGGGLVQPGGSLKLSCAASGFTFSGAWMDWVRQAPGKGLEWVAEIRTKVNNHATNYGESVKGRFTISRDDSKSTVYLQMNSLRAEDTAVYYCRGALYDGFYFDYWGQGTLVTVSS

SEQ ID NO: 37468 - protein, 5 aa, Artificial Sequence
  Description of Artificial Sequence: Synthetic peptide
  Hu14D7 VH1[TIGIT] vhCDR1
GAWMD

SEQ ID NO: 37469 - protein, 19 aa, Artificial Sequence
  Description of Artificial Sequence: Synthetic peptide
  Hu14D7 VH1[TIGIT] vhCDR2
EIRTKVNNHATNYGESVKG

SEQ ID NO: 37470 - protein, 10 aa, Artificial Sequence
  Description of Artificial Sequence: Synthetic peptide
  Hu14D7 VH1[TIGIT] vhCDR3
ALYDGFYFDY

SEQ ID NO: 37471 - protein, 121 aa, Artificial Sequence
  Description of Artificial Sequence: Synthetic polypeptide
  Hu14D7 VH2[TIGIT] variable heavy Chain
EVQLVESGGGLVQPGGSLKLSCAASGFTFSGAWMDWVRQAPGKGLEWVAEIRTKVNNHATNYGESVKGRFTISRDDSKSSVYLQMNSLRAEDTAVYYCRGALYDGFYFDYWGQGTLVTVSS

SEQ ID NO: 37472 - protein, 5 aa, Artificial Sequence
  Description of Artificial Sequence: Synthetic peptide
  Hu14D7 VH2[TIGIT] vhCDR1
GAWMD

SEQ ID NO: 37473 - protein, 19 aa, Artificial Sequence
  Description of Artificial Sequence: Synthetic peptide
  Hu14D7 VH2[TIGIT] vhCDR2
EIRTKVNNHATNYGESVKG

SEQ ID NO: 37474 - protein, 10 aa, Artificial Sequence
  Description of Artificial Sequence: Synthetic peptide
  Hu14D7 VH2[TIGIT] vhCDR3
ALYDGFYFDY

SEQ ID NO: 37475 - protein, 121 aa, Artificial Sequence
  Description of Artificial Sequence: Synthetic polypeptide
  Hu14D7 VH3[TIGIT] variable heavy Chain
EVQLVESGGGLVQPGGSLKLSCAASGFTFSGAWMDWVRQAPGKGLEWVAEIRTKVNNHATNYGESVKGRFTISRDDSKNTVYLQMNSLRAEDTAVYYCRGALYDGFYFDYWGQGTLVTVSS

SEQ ID NO: 37476 - protein, 5 aa, Artificial Sequence
  Description of Artificial Sequence: Synthetic peptide
  Hu14D7 VH3[TIGIT] vhCDR1
GAWMD

SEQ ID NO: 37477 - protein, 19 aa, Artificial Sequence
  Description of Artificial Sequence: Synthetic peptide
  Hu14D7 VH3[TIGIT] vhCDR2
EIRTKVNNHATNYGESVKG

SEQ ID NO: 37478 - protein, 10 aa, Artificial Sequence
  Description of Artificial Sequence: Synthetic peptide
  Hu14D7 VH3[TIGIT] vhCDR3
ALYDGFYFDY

SEQ ID NO: 37479 - protein, 108 aa, Artificial Sequence
  Description of Artificial Sequence: Synthetic polypeptide
  Hu14D7 VL1[TIGIT] variable light Chain
EIVLTQSPATLSLSPGERATLSCSASSSVSSGYLYWYQQKPGQAPKLWIYGTSTLASGVPARFSGSGSGTDYTLTISSLEPEDFAVYYCHQWSSFPYTFGQGTKLEIK

SEQ ID NO: 37480 - protein, 12 aa, Artificial Sequence
  Description of Artificial Sequence: Synthetic peptide
  Hu14D7 VL1[TIGIT] vlCDR1
SASSSVSSGYLY

SEQ ID NO: 37481 - protein, 7 aa, Artificial Sequence
  Description of Artificial Sequence: Synthetic peptide
  Hu14D7 VL1[TIGIT] vlCDR2
GTSTLAS

SEQ ID NO: 37482 - protein, 9 aa, Artificial Sequence
  Description of Artificial Sequence: Synthetic peptide
  Hu14D7 VL1[TIGIT] vlCDR3
HQWSSFPYT

SEQ ID NO: 37483 - protein, 108 aa, Artificial Sequence
  Description of Artificial Sequence: Synthetic polypeptide
  Hu14D7 VL2[TIGIT] variable light Chain
EIVLTQSPATLSLSPGERATLSCSASSSVSSGYLYWYQQKPGQAPRLWIYGTSTLASGVPARFSGSGSGTDYTLTISSLEPEDFAVYYCHQWSSFPYTFGQGTKLEIK

SEQ ID NO: 37484 - protein, 12 aa, Artificial Sequence
  Description of Artificial Sequence: Synthetic peptide
  Hu14D7 VL2[TIGIT] vlCDR1
SASSSVSSGYLY

SEQ ID NO: 37485 - protein, 7 aa, Artificial Sequence
  Description of Artificial Sequence: Synthetic peptide
  Hu14D7 VL2[TIGIT] vlCDR2
GTSTLAS

SEQ ID NO: 37486 - protein, 9 aa, Artificial Sequence
  Description of Artificial Sequence: Synthetic peptide
  Hu14D7 VL2[TIGIT] vlCDR3
HQWSSFPYT

SEQ ID NO: 37487 - protein, 108 aa, Artificial Sequence
  Description of Artificial Sequence: Synthetic polypeptide
  Hu14D7 VL3[TIGIT] variable light Chain
EIVLTQSPATLSLSPGERATLSCSASSSVSSGYLYWYQQKPGQAPRLWIYGTSTLASGIPARFSGSGSGTDYTLTISSLEPEDFAVYYCHQWSSFPYTFGQGTKLEIK

SEQ ID NO: 37488 - protein, 12 aa, Artificial Sequence
  Description of Artificial Sequence: Synthetic peptide
  Hu14D7 VL3[TIGIT] vlCDR1
SASSSVSSGYLY

SEQ ID NO: 37489 - protein, 7 aa, Artificial Sequence
  Description of Artificial Sequence: Synthetic peptide
  Hu14D7 VL3[TIGIT] vlCDR2
GTSTLAS

SEQ ID NO: 37490 - protein, 9 aa, Artificial Sequence
  Description of Artificial Sequence: Synthetic peptide
  Hu14D7 VL3[TIGIT] vlCDR3
HQWSSFPYT

SEQ ID NO: 37491 - protein, 119 aa, Artificial Sequence
  Description of Artificial Sequence: Synthetic polypeptide
  Hu26B10 VH1[TIGIT] variable heavy Chain
EVQLVQSGAEVKKPGASVKISCKTSGYTFTEFTMHWVKQAPGKGLEWIGGLKPDNGGISYNQKFKGRATLTVDKSTNTAYMELSSLRSEDTAVYYCARGAYYRYDADYWGQGTLVTVSS

SEQ ID NO: 37492 - protein, 5 aa, Artificial Sequence
  Description of Artificial Sequence: Synthetic peptide
  Hu26B10 VH1[TIGIT] vhCDR1
EFTMH

SEQ ID NO: 37493 - protein, 17 aa, Artificial Sequence
  Description of Artificial Sequence: Synthetic peptide
  Hu26B10 VH1[TIGIT] vhCDR2
GLKPDNGGISYNQKFKG

SEQ ID NO: 37494 - protein, 10 aa, Artificial Sequence
  Description of Artificial Sequence: Synthetic peptide
  Hu26B10 VH1[TIGIT] vhCDR3
GAYYRYDADY

SEQ ID NO: 37495 - protein, 119 aa, Artificial Sequence
  Description of Artificial Sequence: Synthetic polypeptide
  Hu26B10 VH2[TIGIT] variable heavy Chain
EVQLVQSGAEVKKPGASVKISCKTSGYTFTEFTMHWVRQAPGKGLEWIGGLKPDNGGISYNQKFKGRATLTVDKSTSTAYMELSSLRSEDTAVYYCARGAYYRYDADYWGQGTLVTVSS

SEQ ID NO: 37496 - protein, 5 aa, Artificial Sequence
  Description of Artificial Sequence: Synthetic peptide
  Hu26B10 VH2[TIGIT] vhCDR1
EFTMH

SEQ ID NO: 37497 - protein, 17 aa, Artificial Sequence
  Description of Artificial Sequence: Synthetic peptide
  Hu26B10 VH2[TIGIT] vhCDR2
GLKPDNGGISYNQKFKG

SEQ ID NO: 37498 - protein, 10 aa, Artificial Sequence
  Description of Artificial Sequence: Synthetic peptide
  Hu26B10 VH2[TIGIT] vhCDR3
GAYYRYDADY

SEQ ID NO: 37499 - protein, 119 aa, Artificial Sequence
  Description of Artificial Sequence: Synthetic polypeptide
  Hu26B10 VH3[TIGIT] variable heavy Chain
EVQLVQSGAEVKKPGASVKISCKVSGYTFTEFTMHWVRQAPGKGLEWIGGLKPDNGGISYNQKFKGRATLTVDTSTSTAYMELSSLRSEDTAVYYCARGAYYRYDADYWGQGTLVTVSS

SEQ ID NO: 37500 - protein, 5 aa, Artificial Sequence
  Description of Artificial Sequence: Synthetic peptide
  Hu26B10 VH3[TIGIT] vhCDR1
EFTMH

SEQ ID NO: 37501 - protein, 17 aa, Artificial Sequence
  Description of Artificial Sequence: Synthetic peptide
  Hu26B10 VH3[TIGIT] vhCDR2
GLKPDNGGISYNQKFKG

SEQ ID NO: 37502 - protein, 10 aa, Artificial Sequence
  Description of Artificial Sequence: Synthetic peptide
  Hu26B10 VH3[TIGIT] vhCDR3
GAYYRYDADY

SEQ ID NO: 37503 - protein, 107 aa, Artificial Sequence
  Description of Artificial Sequence: Synthetic polypeptide
  Hu26B10 VL1[TIGIT] variable light Chain
DIQLTQSPSSLSASVGDRVTITCKASQDVKTAVAWYQQKPGKAPKLLIYSASYRNTGVPDRFSGSGSGTDFTFTISSLQPEDFATYYCQQHYSTPFTFGQGTKLEIK

SEQ ID NO: 37504 - protein, 11 aa, Artificial Sequence
  Description of Artificial Sequence: Synthetic peptide
  Hu26B10 VL1[TIGIT] vlCDR1
KASQDVKTAVA

SEQ ID NO: 37505 - protein, 7 aa, Artificial Sequence
  Description of Artificial Sequence: Synthetic peptide
  Hu26B10 VL1[TIGIT] vlCDR2
SASYRNT

SEQ ID NO: 37506 - protein, 9 aa, Artificial Sequence
  Description of Artificial Sequence: Synthetic peptide
  Hu26B10 VL1[TIGIT] vlCDR3
QQHYSTPFT

SEQ ID NO: 37507 - protein, 107 aa, Artificial Sequence
  Description of Artificial Sequence: Synthetic polypeptide
  Hu26B10 VL2[TIGIT] variable light Chain
DIQLTQSPSSLSASVGDRVTITCKASQDVKTAVAWYQQKPGKAPKLLIYSASYRNTGVPSRFSGSGSGTDFTFTISSLQPEDFATYYCQQHYSTPFTFGQGTKLEIK

SEQ ID NO: 37508 - protein, 11 aa, Artificial Sequence
  Description of Artificial Sequence: Synthetic peptide
  Hu26B10 VL2[TIGIT] vlCDR1
KASQDVKTAVA

SEQ ID NO: 37509 - protein, 7 aa, Artificial Sequence
  Description of Artificial Sequence: Synthetic peptide
  Hu26B10 VL2[TIGIT] vlCDR2
SASYRNT

SEQ ID NO: 37510 - protein, 9 aa, Artificial Sequence
  Description of Artificial Sequence: Synthetic peptide
  Hu26B10 VL2[TIGIT] vlCDR3
QQHYSTPFT

SEQ ID NO: 37511 - protein, 107 aa, Artificial Sequence
  Description of Artificial Sequence: Synthetic polypeptide
  Hu26B10 VL3[TIGIT] variable light Chain
DIQLTQSPSSLSASVGDRVTITCKASQDVKTAVAWYQQKPGKAPKLLIYSASYRNTGVPSRFSGSGSGTDFTLTISSLQPEDFATYYCQQHYSTPFTFGQGTKLEIK

SEQ ID NO: 37512 - protein, 11 aa, Artificial Sequence
  Description of Artificial Sequence: Synthetic peptide
  Hu26B10 VL3[TIGIT] vlCDR1
KASQDVKTAVA

SEQ ID NO: 37513 - protein, 7 aa, Artificial Sequence
  Description of Artificial Sequence: Synthetic peptide
  Hu26B10 VL3[TIGIT] vlCDR2
SASYRNT

SEQ ID NO: 37514 - protein, 9 aa, Artificial Sequence
  Description of Artificial Sequence: Synthetic peptide
  Hu26B10 VL3[TIGIT] vlCDR3
QQHYSTPFT

SEQ ID NO: 37515 - protein, 119 aa, Artificial Sequence
  Description of Artificial Sequence: Synthetic polypeptide
  MEB125.31C6.A1.205 VH4/VL1[TIGIT] variable heavy Chain
EVQLVQSGAEVKKPGASVKVSCKASGYTFSSYVMHWVRQAPGQGLEWIGYIDPYNDGAKYAQKFQGRVTLTSDKSTSTVYMELSSLRSEDTAVYYCARGGPYGWYFDVWGQGTTVTVSS

SEQ ID NO: 37516 - protein, 5 aa, Artificial Sequence
  Description of Artificial Sequence: Synthetic peptide
  MEB125.31C6.A1.205 VH4/VL1[TIGIT] vhCDR1
SYVMH

SEQ ID NO: 37517 - protein, 17 aa, Artificial Sequence
  Description of Artificial Sequence: Synthetic peptide
  MEB125.31C6.A1.205 VH4/VL1[TIGIT] vhCDR2
YIDPYNDGAKYAQKFQG

SEQ ID NO: 37518 - protein, 10 aa, Artificial Sequence
  Description of Artificial Sequence: Synthetic peptide
  MEB125.31C6.A1.205 VH4/VL1[TIGIT] vhCDR3
GGPYGWYFDV

SEQ ID NO: 37519 - protein, 107 aa, Artificial Sequence
  Description of Artificial Sequence: Synthetic polypeptide
  MEB125.31C6.A1.205 VH4/VL1[TIGIT] variable heavy Chain
DIQMTQSPSSLSASVGDRVTITCRASEHIYSYLSWYQQKPGKAPKLLIYNAKTLAEGVPSRFSGSGSGTDFTLTISSLQPEDFATYYCQHHFGSPLTFGQGTRLEIK

SEQ ID NO: 37520 - protein, 11 aa, Artificial Sequence
  Description of Artificial Sequence: Synthetic peptide
  MEB125.31C6.A1.205 VH4/VL1[TIGIT] vhCDR1
RASEHIYSYLS

SEQ ID NO: 37521 - protein, 7 aa, Artificial Sequence
  Description of Artificial Sequence: Synthetic peptide
  MEB125.31C6.A1.205 VH4/VL1[TIGIT] vhCDR2
NAKTLAE

SEQ ID NO: 37522 - protein, 9 aa, Artificial Sequence
  Description of Artificial Sequence: Synthetic peptide
  MEB125.31C6.A1.205 VH4/VL1[TIGIT] vhCDR3
QHHFGSPLT

SEQ ID NO: 37523 - protein, 119 aa, Artificial Sequence
  Description of Artificial Sequence: Synthetic polypeptide
  MEB125.31C6.A1.205 VH5/VL4[TIGIT] variable heavy Chain
EVQLVQSGAEVKKPGSSVKVSCKASGYTFSSYVMHWVRQAPGQGLEWIGYIDPYNDGAKYAQKFQGRVTLTSDKSTSTAYMELSSLRSEDTAVYYCARGGPYGWYFDVWGQGTTVTVSS

SEQ ID NO: 37524 - protein, 5 aa, Artificial Sequence
  Description of Artificial Sequence: Synthetic peptide
  MEB125.31C6.A1.205 VH5/VL4[TIGIT] vhCDR1
SYVMH

SEQ ID NO: 37525 - protein, 17 aa, Artificial Sequence
  Description of Artificial Sequence: Synthetic peptide
  MEB125.31C6.A1.205 VH5/VL4[TIGIT] vhCDR2
YIDPYNDGAKYAQKFQG

SEQ ID NO: 37526 - protein, 10 aa, Artificial Sequence
  Description of Artificial Sequence: Synthetic peptide
  MEB125.31C6.A1.205 VH5/VL4[TIGIT] vhCDR3
GGPYGWYFDV

SEQ ID NO: 37527 - protein, 107 aa, Artificial Sequence
  Description of Artificial Sequence: Synthetic polypeptide
  MEB125.31C6.A1.205 VH5/VL4[TIGIT] variable heavy Chain
DIQMTQSPSSLSASVGDRVTITCRASEHIYSYLSWYQQKPGKVPKLLIYNAKTLAEGVPSRFSGSGSGTQFTLTISSLQPEDVATYYCQHHFGSPLTFGQGTRLEIK

SEQ ID NO: 37528 - protein, 11 aa, Artificial Sequence
  Description of Artificial Sequence: Synthetic peptide
  MEB125.31C6.A1.205 VH5/VL4[TIGIT] vhCDR1
RASEHIYSYLS

SEQ ID NO: 37529 - protein, 7 aa, Artificial Sequence
  Description of Artificial Sequence: Synthetic peptide
  MEB125.31C6.A1.205 VH5/VL4[TIGIT] vhCDR2
NAKTLAE

SEQ ID NO: 37530 - protein, 9 aa, Artificial Sequence
  Description of Artificial Sequence: Synthetic peptide
  MEB125.31C6.A1.205 VH5/VL4[TIGIT] vhCDR3
QHHFGSPLT

SEQ ID NO: 37531 - protein, 119 aa, Artificial Sequence; identical to SEQ ID NO: 37523
  Description of Artificial Sequence: Synthetic polypeptide
  MEB125.31C6.A1.205 VH5/VL3[TIGIT] variable heavy Chain

SEQ ID NO: 37532 - protein, 5 aa, Artificial Sequence
  Description of Artificial Sequence: Synthetic peptide
  MEB125.31C6.A1.205 VH5/VL3[TIGIT] vhCDR1
SYVMH

SEQ ID NO: 37533 - protein, 17 aa, Artificial Sequence
  Description of Artificial Sequence: Synthetic peptide
  MEB125.31C6.A1.205 VH5/VL3[TIGIT] vhCDR2
YIDPYNDGAKYAQKFQG

SEQ ID NO: 37534 - protein, 10 aa, Artificial Sequence
  Description of Artificial Sequence: Synthetic peptide
  MEB125.31C6.A1.205 VH5/VL3[TIGIT] vhCDR3
GGPYGWYFDV

SEQ ID NO: 37535 - protein, 107 aa, Artificial Sequence
  Description of Artificial Sequence: Synthetic polypeptide
  MEB125.31C6.A1.205 VH5/VL3[TIGIT] variable heavy Chain
DIQMTQSPSSLSASVGDRVTITCRASEHIYSYLSWYQQKPGKVPKLLIYNAKTLAEGVPSRFSGSGSGTDFTLTISSLQPEDVATYYCQHHFGSPLTFGQGTRLEIK

SEQ ID NO: 37536 - protein, 11 aa, Artificial Sequence
  Description of Artificial Sequence: Synthetic peptide
  MEB125.31C6.A1.205 VH5/VL3[TIGIT] vhCDR1
RASEHIYSYLS

SEQ ID NO: 37537 - protein, 7 aa, Artificial Sequence
  Description of Artificial Sequence: Synthetic peptide
  MEB125.31C6.A1.205 VH5/VL3[TIGIT] vhCDR2
NAKTLAE

SEQ ID NO: 37538 - protein, 9 aa, Artificial Sequence
  Description of Artificial Sequence: Synthetic peptide
  MEB125.31C6.A1.205 VH5/VL3[TIGIT] vhCDR3
QHHFGSPLT

SEQ ID NO: 37539 - protein, 118 aa, Artificial Sequence
  Description of Artificial Sequence: Synthetic polypeptide
  15A6[TIGIT] variable heavy Chain
QLQLQESGPGLVKPSETLSLTCTVSGGSISSSRYFWGWIRQPPGKGLEWIGYIYYRGSTYYNPSLKSRVTIAVDTSKNQFSLKLSSVTAADTAVYYCASSSAWYFDYWGQGNLVTVSS

SEQ ID NO: 37540 - protein, 7 aa, Artificial Sequence
  Description of Artificial Sequence: Synthetic peptide
  15A6[TIGIT] vhCDR1
SSRYFWG

SEQ ID NO: 37541 - protein, 16 aa, Artificial Sequence
  Description of Artificial Sequence: Synthetic peptide
  15A6[TIGIT] vhCDR2
YIYYRGSTYYNPSLKS

SEQ ID NO: 37542 - protein, 8 aa, Artificial Sequence
  Description of Artificial Sequence: Synthetic peptide
  15A6[TIGIT] vhCDR3
SSAWYFDY

SEQ ID NO: 37543 - protein, 107 aa, Artificial Sequence
  Description of Artificial Sequence: Synthetic polypeptide
  15A6[TIGIT] variable light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSLYTFGQGTKLEIK

SEQ ID NO: 37544 - protein, 12 aa, Artificial Sequence
  Description of Artificial Sequence: Synthetic peptide
  15A6[TIGIT] vlCDR1
RASQSVSSSYLA

SEQ ID NO: 37545 - protein, 7 aa, Artificial Sequence
  Description of Artificial Sequence: Synthetic peptide
  15A6[TIGIT] vlCDR2
GASSRAT

SEQ ID NO: 37546 - protein, 8 aa, Artificial Sequence
  Description of Artificial Sequence: Synthetic peptide
  15A6[TIGIT] vlCDR3
QQYGSLYT

SEQ ID NO: 37547 - protein, 130 aa, Artificial Sequence
  Description of Artificial Sequence: Synthetic polypeptide
  22G2[TIGIT] variable heavy Chain
QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYYFFGVDVWGQGTTVTVSS

SEQ ID NO: 37548 - protein, 7 aa, Artificial Sequence
  Description of Artificial Sequence: Synthetic peptide
  22G2[TIGIT] vhCDR1
SGIYYWS

SEQ ID NO: 37549 - protein, 16 aa, Artificial Sequence
  Description of Artificial Sequence: Synthetic peptide
  22G2[TIGIT] vhCDR2
YIYYSGSTNYNPSLKS

SEQ ID NO: 37550 - protein, 20 aa, Artificial Sequence
  Description of Artificial Sequence: Synthetic peptide
  22G2[TIGIT] vhCDR3
DYYVSGNYYNVDYYFFGVDV

SEQ ID NO: 37551 - protein, 109 aa, Artificial Sequence
  Description of Artificial Sequence: Synthetic polypeptide
  22G2[TIGIT] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIK

SEQ ID NO: 37552 - protein, 11 aa, Artificial Sequence
  Description of Artificial Sequence: Synthetic peptide
  22G2[TIGIT] vlCDR1
RASQSVSSYLA

SEQ ID NO: 37553 - protein, 7 aa, Artificial Sequence
  Description of Artificial Sequence: Synthetic peptide
  22G2[TIGIT] vlCDR2
DASNRAT

SEQ ID NO: 37554 - protein, 11 aa, Artificial Sequence
  Description of Artificial Sequence: Synthetic peptide
  22G2[TIGIT] vlCDR3
QQRSNWPPLFT

SEQ ID NO: 37555 - protein, 126 aa, Artificial Sequence
  Description of Artificial Sequence: Synthetic polypeptide
  11G11[TIGIT] variable heavy Chain
QLQLQESGPGLVKPSETLSLTCTVSGGSISSSSHYWGWIRQPPGKGLEWIGNIFYSGHTYYNPSLKSRVTISVDTSKNQFSLKLSSVTAADTAVYYCARQGLLWFGGLSPYYFDYWGQGTLVTVSS

SEQ ID NO: 37556 - protein, 7 aa, Artificial Sequence
  Description of Artificial Sequence: Synthetic peptide
  11G11[TIGIT] vhCDR1
SSSHYWG

SEQ ID NO: 37557 - protein, 16 aa, Artificial Sequence
  Description of Artificial Sequence: Synthetic peptide
  11G11[TIGIT] vhCDR2
NIFYSGHTYYNPSLKS

SEQ ID NO: 37558 - protein, 16 aa, Artificial Sequence
  Description of Artificial Sequence: Synthetic peptide
  11G11[TIGIT] vhCDR3
QGLLWFGGLSPYYFDY

SEQ ID NO: 37559 - protein, 106 aa, Artificial Sequence
  Description of Artificial Sequence: Synthetic polypeptide
  11G11[TIGIT] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKLEIK

SEQ ID NO: 37560 - protein, 11 aa, Artificial Sequence
  Description of Artificial Sequence: Synthetic peptide
  11G11[TIGIT] vlCDR1
RASQSVSSYLA

SEQ ID NO: 37561 - protein, 7 aa, Artificial Sequence
  Description of Artificial Sequence: Synthetic peptide
  11G11[TIGIT] vlCDR2
DASNRAT

SEQ ID NO: 37562 - protein, 8 aa, Artificial Sequence
  Description of Artificial Sequence: Synthetic peptide
  11G11[TIGIT] vlCDR3
QQRSNWPT

SEQ ID NO: 37563 - protein, 128 aa, Artificial Sequence
  Description of Artificial Sequence: Synthetic polypeptide
  10D7[TIGIT] variable heavy Chain
QGQLVQSGAEVKKPGSSVKVSCKASGGIFRNYAISWVRQAPGQGLEWMGGIIPFFGTANYAQKFQGRVTITADESTSTAYMELSSLRSEDTAVYYCARGGAAAGTTRYGYYYYGMDVWGQGTTVTVSS

SEQ ID NO: 37564 - protein, 5 aa, Artificial Sequence
  Description of Artificial Sequence: Synthetic peptide
  10D7[TIGIT] vhCDR1
NYAIS

SEQ ID NO: 37565 - protein, 17 aa, Artificial Sequence
  Description of Artificial Sequence: Synthetic peptide
  10D7[TIGIT] vhCDR2
GIIPFFGTANYAQKFQG

SEQ ID NO: 37566 - protein, 19 aa, Artificial Sequence
  Description of Artificial Sequence: Synthetic peptide
  10D7[TIGIT] vhCDR3
GGAAAGTTRYGYYYYGMDV

SEQ ID NO: 37567 - protein, 107 aa, Artificial Sequence
  Description of Artificial Sequence: Synthetic polypeptide
  10D7[TIGIT] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPITFGQGTRLEIK

SEQ ID NO: 37568 - protein, 11 aa, Artificial Sequence
  Description of Artificial Sequence: Synthetic peptide
  10D7[TIGIT] vlCDR1
RASQGISSWLA

SEQ ID NO: 37569 - protein, 7 aa, Artificial Sequence
  Description of Artificial Sequence: Synthetic peptide
  10D7[TIGIT] vlCDR2
AASSLQS

SEQ ID NO: 37570 - protein, 9 aa, Artificial Sequence
  Description of Artificial Sequence: Synthetic peptide
  10D7[TIGIT] vlCDR3
QQYNSYPIT

SEQ ID NO: 37571 - protein, 116 aa, Artificial Sequence
  Description of Artificial Sequence: Synthetic polypeptide
  313R19[TIGIT] variable heavy Chain
QVQLQESGPGLVKPSETLSLTCTVSGFSLSSSYMSWIRQPPGKGLEWIGIIGSNGNTYYANWAKGRVTISKSSNQVSLKLSSVTAADTAVYYCARGGYRTSGMDPWGQGTLVTVSS

SEQ ID NO: 37572 - protein, 5 aa, Artificial Sequence
  Description of Artificial Sequence: Synthetic peptide
  313R19[TIGIT] vhCDR1
SSYMS

SEQ ID NO: 37573 - protein, 14 aa, Artificial Sequence
  Description of Artificial Sequence: Synthetic peptide
  313R19[TIGIT] vhCDR2
IIGSNGNTYYANWA

SEQ ID NO: 37574 - protein, 10 aa, Artificial Sequence
  Description of Artificial Sequence: Synthetic peptide
  313R19[TIGIT] vhCDR3
GGYRTSGMDP

SEQ ID NO: 37575 - protein, 110 aa, Artificial Sequence
  Description of Artificial Sequence: Synthetic polypeptide
  313R19[TIGIT] variable light Chain
DIQMTQSPSSLSASVGDRVTITCQASQNIYSDLAWYQQKPGKAPKLLIYRASTLASGVPSRFSGSGSGTDFTLTISSLQPEDFATYYCQQEHLVAWIYNVFGQGTKVEIK

SEQ ID NO: 37576 - protein, 11 aa, Artificial Sequence
  Description of Artificial Sequence: Synthetic peptide
  313R19[TIGIT] vlCDR1
QASQNIYSDLA

SEQ ID NO: 37577 - protein, 7 aa, Artificial Sequence
  Description of Artificial Sequence: Synthetic peptide
  313R19[TIGIT] vlCDR2
RASTLAS

SEQ ID NO: 37578 - protein, 12 aa, Artificial Sequence
  Description of Artificial Sequence: Synthetic peptide
  313R19[TIGIT] vlCDR3
QQEHLVAWIYNV

SEQ ID NO: 37579 - protein, 118 aa, Artificial Sequence
  Description of Artificial Sequence: Synthetic polypeptide
  313M32[TIGIT] variable heavy Chain
QVQLQESGPGLVKPSETLSLTCAVSGYSITSDYAWNWIRQPPGKGLEWIGYISYSGSTSYNPSLRSRVTISRDTSKNQFFLKLSSVTAADTAVYYCARRQVGLGFAYWGQGTLVTVSS

SEQ ID NO: 37580 - protein, 6 aa, Artificial Sequence
  Description of Artificial Sequence: Synthetic peptide
  313M32[TIGIT] vhCDR1
SDYAWN

SEQ ID NO: 37581 - protein, 16 aa, Artificial Sequence
  Description of Artificial Sequence: Synthetic peptide
  313M32[TIGIT] vhCDR2
YISYSGSTSYNPSLRS

SEQ ID NO: 37582 - protein, 9 aa, Artificial Sequence
  Description of Artificial Sequence: Synthetic peptide
  313M32[TIGIT] vhCDR3
RQVGLGFAY

SEQ ID NO: 37583 - protein, 99 aa, Artificial Sequence
  Description of Artificial Sequence: Synthetic polypeptide
  313M32[TIGIT] variable light Chain
DIQMTQSPSSLSASVGDRVTITCKASQDVSTAVAWYQQKPGKAPKLLIYSASYRYTGVPSRFSGSGSGTDFTFTISSLQPEDIATYYCQQHYSTPWTFG

SEQ ID NO: 37584 - protein, 11 aa, Artificial Sequence
  Description of Artificial Sequence: Synthetic peptide
  313M32[TIGIT] vlCDR1
KASQDVSTAVA

SEQ ID NO: 37585 - protein, 7 aa, Artificial Sequence
  Description of Artificial Sequence: Synthetic peptide
  313M32[TIGIT] vlCDR2
SASYRYT

SEQ ID NO: 37586 - protein, 9 aa, Artificial Sequence
  Description of Artificial Sequence: Synthetic peptide
  313M32[TIGIT] vlCDR3
QQHYSTPWT

SEQ ID NO: 37587 - protein, 113 aa, Artificial Sequence
  Description of Artificial Sequence: Synthetic polypeptide
  APE5137[TIM-3] variable heavy Chain
EVQLLESGGGLVQPGGSLRLSCAAASGFTFSSYDMSWVRQAPGKGLDWVSTISGGGTYTYYQDSVKGRFTISRDNSKNTLYLQMNSLRAEDTAVYYCASMDYWGQGTTVTVSS

SEQ ID NO: 37588 - protein, 6 aa, Artificial Sequence
  Description of Artificial Sequence: Synthetic peptide
  APE5137[TIM-3] vhCDR1
SSYDMS

SEQ ID NO: 37589 - protein, 17 aa, Artificial Sequence
  Description of Artificial Sequence: Synthetic peptide
  APE5137[TIM-3] vhCDR2
TISGGGTYTYYQDSVKG

SEQ ID NO: 37590 - protein, 3 aa, Artificial Sequence
  Description of Artificial Sequence: Synthetic peptide
  APE5137[TIM-3] vhCDR3
MDY

SEQ ID NO: 37591 - protein, 107 aa, Artificial Sequence
  Description of Artificial Sequence: Synthetic polypeptide
  APE5137[TIM-3] variable light Chain
DIQMTQSPSSLSASVGDRVTITCRASQSIRRYLNWYHQKPGKAPKLLIYGASTLQSGVPSRFSGSGSGTDFTLTISSLQPEDFAVYYCQQSHSAPLTFGGGTKVEIK

SEQ ID NO: 37592 - protein, 11 aa, Artificial Sequence
  Description of Artificial Sequence: Synthetic peptide
  APE5137[TIM-3] vlCDR1
RASQSIRRYLN

SEQ ID NO: 37593 - protein, 7 aa, Artificial Sequence
  Description of Artificial Sequence: Synthetic peptide
  APE5137[TIM-3] vlCDR2
GASTLQS

SEQ ID NO: 37594 - protein, 9 aa, Artificial Sequence
  Description of Artificial Sequence: Synthetic peptide
  APE5137[TIM-3] vlCDR3
QQSHSAPLT

SEQ ID NO: 37595 - protein, 119 aa, Artificial Sequence
  Description of Artificial Sequence: Synthetic polypeptide
  APE5121[TIM-3] variable heavy Chain
EVQVLESGGGLVQPGGSLRLYCVASGFTFSGSYAMSWVRQAPGKGLEWVSAISGSGGSTYYADSVKGRFTISRDNSKNTLYLQMNSLRAEDTAVYYCAKKYYVGPADYWGQGTLVTVSS

SEQ ID NO: 37596 - protein, 6 aa, Artificial Sequence
  Description of Artificial Sequence: Synthetic peptide
  APE5121[TIM-3] vhCDR1
GSYAMS

SEQ ID NO: 37597 - protein, 17 aa, Artificial Sequence
  Description of Artificial Sequence: Synthetic peptide
  APE5121[TIM-3] vhCDR2
AISGSGGSTYYADSVKG

SEQ ID NO: 37598 - protein, 9 aa, Artificial Sequence
  Description of Artificial Sequence: Synthetic peptide
  APE5121[TIM-3] vhCDR3
KYYVGPADY

SEQ ID NO: 37599 - protein, 113 aa, Artificial Sequence
  Description of Artificial Sequence: Synthetic polypeptide
  APE5121[TIM-3] variable light Chain
DIVMTQSPDSLAVSLGERATINCKSSQSVLYSSNNKNYLAWYQHKPGQPPKLLIYWASTRESGVPDRFSGSGSGTDFTLTISSLQAEDVAVYYCQQYYSSPLTFGGGTKIEVK

SEQ ID NO: 37600 - protein, 17 aa, Artificial Sequence
  Description of Artificial Sequence: Synthetic peptide
  APE5121[TIM-3] vlCDR1
KSSQSVLYSSNNKNYLA

SEQ ID NO: 37601 - protein, 7 aa, Artificial Sequence
  Description of Artificial Sequence: Synthetic peptide
  APE5121[TIM-3] vlCDR2
WASTRES

SEQ ID NO: 37602 - protein, 9 aa, Artificial Sequence
  Description of Artificial Sequence: Synthetic peptide
  APE5121[TIM-3] vlCDR3
QQYYSSPLT

SEQ ID NO: 37603 - protein, 118 aa, Artificial Sequence
  Description of Artificial Sequence: Synthetic polypeptide
  ABTIM3-hum03[TIM-3] variable heavy Chain
QVQLVQSGAEVKKPGASVKVSCKASGYTFTSYNMHWVRQAPGQGLEWIGDIYPGQGDTSYNQKFKGRATMTADKSTSTVYMELSSLRSEDTAVYYCARVGGAFPMDYWGQGTLVTVSS

SEQ ID NO: 37604 - protein, 5 aa, Artificial Sequence
  Description of Artificial Sequence: Synthetic peptide
  ABTIM3-hum03[TIM-3] vhCDR1
SYNMH

SEQ ID NO: 37605 - protein, 17 aa, Artificial Sequence
  Description of Artificial Sequence: Synthetic peptide
  ABTIM3-hum03[TIM-3] vhCDR2
DIYPGQGDTSYNQKFKG

SEQ ID NO: 37606 - protein, 9 aa, Artificial Sequence
  Description of Artificial Sequence: Synthetic peptide
  ABTIM3-hum03[TIM-3] vhCDR3
VGGAFPMDY

SEQ ID NO: 37607 - protein, 111 aa, Artificial Sequence
  Description of Artificial Sequence: Synthetic polypeptide
  ABTIM3-hum03[TIM-3] variable light Chain
DIVLTQSPDSLAVSLGERATINCRASESVEYYGTSLMQWYQQKPGQPPKLLIYAASNVESGVPDRFSGSGSGTDFTLTISSLQAEDVAVYYCQQSRKDPSTFGGGTKVEIK

SEQ ID NO: 37608 - protein, 15 aa, Artificial Sequence
  Description of Artificial Sequence: Synthetic peptide
  ABTIM3-hum03[TIM-3] vlCDR1
RASESVEYYGTSLMQ

SEQ ID NO: 37609 - protein, 7 aa, Artificial Sequence
  Description of Artificial Sequence: Synthetic peptide
  ABTIM3-hum03[TIM-3] vlCDR2
AASNVES

SEQ ID NO: 37610 - protein, 9 aa, Artificial Sequence
  Description of Artificial Sequence: Synthetic peptide
  ABTIM3-hum03[TIM-3] vlCDR3
QQSRKDPST

SEQ ID NO: 37611 - protein, 118 aa, Artificial Sequence; identical to SEQ ID NO: 20786
  Description of Artificial Sequence: Synthetic polypeptide
  ABTIM3-hum11[TIM-3] variable heavy Chain

SEQ ID NO: 37612 - protein, 5 aa, Artificial Sequence
  Description of Artificial Sequence: Synthetic peptide
  ABTIM3-hum11[TIM-3] vhCDR1
SYNMH

SEQ ID NO: 37613 - protein, 17 aa, Artificial Sequence
  Description of Artificial Sequence: Synthetic peptide
  ABTIM3-hum11[TIM-3] vhCDR2
DIYPGNGDTSYNQKFKG

SEQ ID NO: 37614 - protein, 9 aa, Artificial Sequence
  Description of Artificial Sequence: Synthetic peptide
  ABTIM3-hum11[TIM-3] vhCDR3
VGGAFPMDY

SEQ ID NO: 37615 - protein, 111 aa, Artificial Sequence; identical to SEQ ID NO: 20791
  Description of Artificial Sequence: Synthetic polypeptide
  ABTIM3-hum11[TIM-3] variable light Chain

SEQ ID NO: 37616 - protein, 15 aa, Artificial Sequence
  Description of Artificial Sequence: Synthetic peptide
  ABTIM3-hum11[TIM-3] vlCDR1
RASESVEYYGTSLMQ

SEQ ID NO: 37617 - protein, 7 aa, Artificial Sequence
  Description of Artificial Sequence: Synthetic peptide
  ABTIM3-hum11[TIM-3] vlCDR2
AASNVES

SEQ ID NO: 37618 - protein, 9 aa, Artificial Sequence
  Description of Artificial Sequence: Synthetic peptide
  ABTIM3-hum11[TIM-3] vlCDR3
QQSRKDPST

SEQ ID NO: 37619 - protein, 118 aa, Artificial Sequence; identical to SEQ ID NO: 37603
  Description of Artificial Sequence: Synthetic polypeptide
  ABTIM3-hum21[TIM-3] variable heavy Chain

SEQ ID NO: 37620 - protein, 5 aa, Artificial Sequence
  Description of Artificial Sequence: Synthetic peptide
  ABTIM3-hum21[TIM-3] vhCDR1
SYNMH

SEQ ID NO: 37621 - protein, 17 aa, Artificial Sequence
  Description of Artificial Sequence: Synthetic peptide
  ABTIM3-hum21[TIM-3] vhCDR2
DIYPGQGDTSYNQKFKG

SEQ ID NO: 37622 - protein, 9 aa, Artificial Sequence
  Description of Artificial Sequence: Synthetic peptide
  ABTIM3-hum21[TIM-3] vhCDR3
VGGAFPMDY

SEQ ID NO: 37623 - protein, 111 aa, Artificial Sequence; identical to SEQ ID NO: 37607
  Description of Artificial Sequence: Synthetic polypeptide
  ABTIM3-hum21[TIM-3] variable light Chain

SEQ ID NO: 37624 - protein, 15 aa, Artificial Sequence
  Description of Artificial Sequence: Synthetic peptide
  ABTIM3-hum21[TIM-3] vlCDR1
RASESVEYYGTSLMQ

SEQ ID NO: 37625 - protein, 7 aa, Artificial Sequence
  Description of Artificial Sequence: Synthetic peptide
  ABTIM3-hum21[TIM-3] vlCDR2
AASNVES

SEQ ID NO: 37626 - protein, 9 aa, Artificial Sequence
  Description of Artificial Sequence: Synthetic peptide
  ABTIM3-hum21[TIM-3] vlCDR3
QQSRKDPST

SEQ ID NO: 37627 - protein, 121 aa, Artificial Sequence
  Description of Artificial Sequence: Synthetic polypeptide
  4177[TIM-3] variable heavy Chain
QVQLQESGPGLVKPSETLSLTCTVSGGSISSYYWSWIRQPPGKGLEWIGYIFHSGSTNYNPSLKSRVTISVDTSKNQFSLKLSSVTAADTAVYYCARDGEYFDMLTGFDYWGQGTLVTVSS

SEQ ID NO: 37628 - protein, 5 aa, Artificial Sequence
  Description of Artificial Sequence: Synthetic peptide
  4177[TIM-3] vhCDR1
SYYWS

SEQ ID NO: 37629 - protein, 16 aa, Artificial Sequence
  Description of Artificial Sequence: Synthetic peptide
  4177[TIM-3] vhCDR2
YIFHSGSTNYNPSLKS

SEQ ID NO: 37630 - protein, 13 aa, Artificial Sequence
  Description of Artificial Sequence: Synthetic peptide
  4177[TIM-3] vhCDR3
DGEYFDMLTGFDY

SEQ ID NO: 37631 - protein, 109 aa, Artificial Sequence
  Description of Artificial Sequence: Synthetic polypeptide
  4177[TIM-3] variable light Chain
RCDIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK

SEQ ID NO: 37632 - protein, 11 aa, Artificial Sequence
  Description of Artificial Sequence: Synthetic peptide
  4177[TIM-3] vlCDR1
RASQGISSWLA

SEQ ID NO: 37633 - protein, 7 aa, Artificial Sequence
  Description of Artificial Sequence: Synthetic peptide
  4177[TIM-3] vlCDR2
AASSLQS

SEQ ID NO: 37634 - protein, 9 aa, Artificial Sequence
  Description of Artificial Sequence: Synthetic peptide
  4177[TIM-3] vlCDR3
QQYNSYPRT

SEQ ID NO: 37635 - protein, 121 aa, Artificial Sequence
  Description of Artificial Sequence: Synthetic polypeptide
  4545[TIM-3] variable heavy Chain
QVQLQESGPGLVKPSETLSLTCTVSGGSFSRGGYYWNWIRQPPGKGLEWIGYIYYSGSTNYNPSLKSRVTISLDTSKNQFSLKLSSVTAADTAVYYCARDHYSSSWTFDYWGQGTLVTVSS

SEQ ID NO: 37636 - protein, 7 aa, Artificial Sequence
  Description of Artificial Sequence: Synthetic peptide
  4545[TIM-3] vhCDR1
RGGYYWN

SEQ ID NO: 37637 - protein, 16 aa, Artificial Sequence
  Description of Artificial Sequence: Synthetic peptide
  4545[TIM-3] vhCDR2
YIYYSGSTNYNPSLKS

SEQ ID NO: 37638 - protein, 11 aa, Artificial Sequence
  Description of Artificial Sequence: Synthetic peptide
  4545[TIM-3] vhCDR3
DHYSSSWTFDY

SEQ ID NO: 37639 - protein, 107 aa, Artificial Sequence
  Description of Artificial Sequence: Synthetic polypeptide
  4545[TIM-3] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKLEIK

SEQ ID NO: 37640 - protein, 11 aa, Artificial Sequence
  Description of Artificial Sequence: Synthetic peptide
  4545[TIM-3] vlCDR1
RASQSVSSYLA

SEQ ID NO: 37641 - protein, 7 aa, Artificial Sequence
  Description of Artificial Sequence: Synthetic peptide
  4545[TIM-3] vlCDR2
DASNRAT

SEQ ID NO: 37642 - protein, 9 aa, Artificial Sequence
  Description of Artificial Sequence: Synthetic peptide
  4545[TIM-3] vlCDR3
QQRSNWPPT

SEQ ID NO: 37643 - protein, 117 aa, Artificial Sequence; identical to SEQ ID NO: 20766
  Description of Artificial Sequence: Synthetic polypeptide
  8213[TIM-3] variable heavy Chain

SEQ ID NO: 37644 - protein, 5 aa, Artificial Sequence
  Description of Artificial Sequence: Synthetic peptide
  8213[TIM-3] vhCDR1
SYWMH

SEQ ID NO: 37645 - protein, 17 aa, Artificial Sequence
  Description of Artificial Sequence: Synthetic peptide
  8213[TIM-3] vhCDR2
EINPSNGRTNYNEKFKT

SEQ ID NO: 37646 - protein, 8 aa, Artificial Sequence
  Description of Artificial Sequence: Synthetic peptide
  8213[TIM-3] vhCDR3
GYYLYFDY

SEQ ID NO: 37647 - protein, 107 aa, Artificial Sequence; identical to SEQ ID NO: 20771
  Description of Artificial Sequence: Synthetic polypeptide
  8213[TIM-3] variable light Chain

SEQ ID NO: 37648 - protein, 11 aa, Artificial Sequence
  Description of Artificial Sequence: Synthetic peptide
  8213[TIM-3] vlCDR1
HASQGIRINIG

SEQ ID NO: 37649 - protein, 7 aa, Artificial Sequence
  Description of Artificial Sequence: Synthetic peptide
  8213[TIM-3] vlCDR2
HGTNLED

SEQ ID NO: 37650 - protein, 9 aa, Artificial Sequence
  Description of Artificial Sequence: Synthetic peptide
  8213[TIM-3] vlCDR3
VQYGQFPWT

SEQ ID NO: 37651 - protein, 117 aa, Artificial Sequence
  Description of Artificial Sequence: Synthetic polypeptide
  mAb15[TIM-3] variable heavy Chain
QVQLKESGPGLVAPSQSLSITCTVSGFSLTGYGVTWVRQPPGKGLEWLGMIWGDGNTDYNSGLKSRLNISKDNSKSQVFLKMNSLQTDDTARYYCARSYYYGPPDYWGQGTTLTVSS

SEQ ID NO: 37652 - protein, 5 aa, Artificial Sequence
  Description of Artificial Sequence: Synthetic peptide
  mAb15[TIM-3] vhCDR1
GYGVT

SEQ ID NO: 37653 - protein, 16 aa, Artificial Sequence
  Description of Artificial Sequence: Synthetic peptide
  mAb15[TIM-3] vhCDR2
MIWGDGNTDYNSGLKS

SEQ ID NO: 37654 - protein, 9 aa, Artificial Sequence
  Description of Artificial Sequence: Synthetic peptide
  mAb15[TIM-3] vhCDR3
SYYYGPPDY

SEQ ID NO: 37655 - protein, 113 aa, Artificial Sequence
  Description of Artificial Sequence: Synthetic polypeptide
  mAb15[TIM-3] variable light Chain
DIVMTQSPSSLAMSVGQKVTMSCKSSQSLLNSRSQKNYLAWYQRKPGQSPKLLLYFASTRESGVPDRFIGSGSGTDFTLTISSVQAEDLADYFCHQHYNTPYTFGGGTKLEIK

SEQ ID NO: 37656 - protein, 17 aa, Artificial Sequence
  Description of Artificial Sequence: Synthetic peptide
  mAb15[TIM-3] vlCDR1
KSSQSLLNSRSQKNYLA

SEQ ID NO: 37657 - protein, 7 aa, Artificial Sequence
  Description of Artificial Sequence: Synthetic peptide
  mAb15[TIM-3] vlCDR2
FASTRES

SEQ ID NO: 37658 - protein, 9 aa, Artificial Sequence
  Description of Artificial Sequence: Synthetic peptide
  mAb15[TIM-3] vlCDR3
HQHYNTPYT

SEQ ID NO: 37659 - protein, 121 aa, Artificial Sequence
  Description of Artificial Sequence: Synthetic polypeptide
  mAb58[TIM-3] variable heavy Chain
QIQLVQSGPELKKPGETVKISCKASGYTFTTYGMSWVKQAPGKGLKLMGWINTYSGAPTYADDFKGRFAFSLETSASAAYLQINNLKNEDTATYFCARKPPHYYVNSFDYWGQGTTLTVSS

SEQ ID NO: 37660 - protein, 5 aa, Artificial Sequence
  Description of Artificial Sequence: Synthetic peptide
  mAb58[TIM-3] vhCDR1
TYGMS

SEQ ID NO: 37661 - protein, 17 aa, Artificial Sequence
  Description of Artificial Sequence: Synthetic peptide
  mAb58[TIM-3] vhCDR2
WINTYSGAPTYADDFKG

SEQ ID NO: 37662 - protein, 12 aa, Artificial Sequence
  Description of Artificial Sequence: Synthetic peptide
  mAb58[TIM-3] vhCDR3
KPPHYYVNSFDY

SEQ ID NO: 37663 - protein, 107 aa, Artificial Sequence
  Description of Artificial Sequence: Synthetic polypeptide
  mAb58[TIM-3] variable light Chain
DIVMTQSPATLSVTPGDRVSLSCRASQSISDYLHWYQQKSHESPRLLIKYASQSISGIPSRFSGSGSGSDFTLSINSVEPEDVGVYYCQNGHSFPYTFGGGTKLEIK

SEQ ID NO: 37664 - protein, 11 aa, Artificial Sequence
  Description of Artificial Sequence: Synthetic peptide
  mAb58[TIM-3] vlCDR1
RASQSISDYLH

SEQ ID NO: 37665 - protein, 7 aa, Artificial Sequence
  Description of Artificial Sequence: Synthetic peptide
  mAb58[TIM-3] vlCDR2
YASQSIS

SEQ ID NO: 37666 - protein, 9 aa, Artificial Sequence
  Description of Artificial Sequence: Synthetic peptide
  mAb58[TIM-3] vlCDR3
QNGHSFPYT

SEQ ID NO: 37667 - protein, 120 aa, Artificial Sequence
  Description of Artificial Sequence: Synthetic polypeptide
  TIM3-0433[TIM-3] variable heavy Chain
QITLKESGPTLVKPTQTLTLTCTFSGFSLSTSGMSVGWIRQPPGKGLEWLAHIWLNDDVFFNPALKSRLTITKDTSKNQVVLTMTNMDPVDTATYYCVRANGYLYALDYWGQGTLVTVSS

SEQ ID NO: 37668 - protein, 7 aa, Artificial Sequence
  Description of Artificial Sequence: Synthetic peptide
  TIM3-0433[TIM-3] vhCDR1
TSGMSVG

SEQ ID NO: 37669 - protein, 16 aa, Artificial Sequence
  Description of Artificial Sequence: Synthetic peptide
  TIM3-0433[TIM-3] vhCDR2
HIWLNDDVFFNPALKS

SEQ ID NO: 37670 - protein, 10 aa, Artificial Sequence
  Description of Artificial Sequence: Synthetic peptide
  TIM3-0433[TIM-3] vhCDR3
ANGYLYALDY

SEQ ID NO: 37671 - protein, 106 aa, Artificial Sequence
  Description of Artificial Sequence: Synthetic polypeptide
  TIM3-0433[TIM-3] variable light Chain
ETTLTQSPAFMSATPGDKVNIACSASSSVSYTQWYQQKPGEAPKLWIYDAFKLAPGIPPRFSGSGYGTDFTLTINNIESEDAAYYFCHQWSSYPWTFGQGTKLEIK

SEQ ID NO: 37672 - protein, 10 aa, Artificial Sequence
  Description of Artificial Sequence: Synthetic peptide
  TIM3-0433[TIM-3] vlCDR1
SASSSVSYTQ

SEQ ID NO: 37673 - protein, 7 aa, Artificial Sequence
  Description of Artificial Sequence: Synthetic peptide
  TIM3-0433[TIM-3] vlCDR2
DAFKLAP

SEQ ID NO: 37674 - protein, 9 aa, Artificial Sequence
  Description of Artificial Sequence: Synthetic peptide
  TIM3-0433[TIM-3] vlCDR3
HQWSSYPWT

SEQ ID NO: 37675 - protein, 120 aa, Artificial Sequence; identical to SEQ ID NO: 37667
  Description of Artificial Sequence: Synthetic polypeptide
  TIM3-0434[TIM-3] variable heavy Chain

SEQ ID NO: 37676 - protein, 7 aa, Artificial Sequence
  Description of Artificial Sequence: Synthetic peptide
  TIM3-0434[TIM-3] vhCDR1
TSGMSVG

SEQ ID NO: 37677 - protein, 16 aa, Artificial Sequence
  Description of Artificial Sequence: Synthetic peptide
  TIM3-0434[TIM-3] vhCDR2
HIWLNDDVFFNPALKS

SEQ ID NO: 37678 - protein, 10 aa, Artificial Sequence
  Description of Artificial Sequence: Synthetic peptide
  TIM3-0434[TIM-3] vhCDR3
ANGYLYALDY

SEQ ID NO: 37679 - protein, 106 aa, Artificial Sequence
  Description of Artificial Sequence: Synthetic polypeptide
  TIM3-0434[TIM-3] variable light Chain
DIQLTQSPSFLSASVGDRVTITCSASSSVSYTQWYQQKPGKAPKLWIYDAFKLAPGVPSRFSGSGSGTEFTLTISSLQPEDFATYFCHQWSSYPWTFGQGTKLEIK

SEQ ID NO: 37680 - protein, 10 aa, Artificial Sequence
  Description of Artificial Sequence: Synthetic peptide
  TIM3-0434[TIM-3] vlCDR1
SASSSVSYTQ

SEQ ID NO: 37681 - protein, 7 aa, Artificial Sequence
  Description of Artificial Sequence: Synthetic peptide
  TIM3-0434[TIM-3] vlCDR2
DAFKLAP

SEQ ID NO: 37682 - protein, 9 aa, Artificial Sequence
  Description of Artificial Sequence: Synthetic peptide
  TIM3-0434[TIM-3] vlCDR3
HQWSSYPWT

SEQ ID NO: 37683 - protein, 119 aa, Artificial Sequence
  Description of Artificial Sequence: Synthetic polypeptide
  TIM3-0438[TIM-3] variable heavy Chain
EVQLVESGGGLVQPGGSLRLSCAASGFNIKTTYMHWVRQAPGKGLEWVGRIDPADDNTKYAPKFQGKATISADTSKNTAYLQMNSLRAEDTAVYYCVRDFGYVAWFAYWGQGTLVTVSS

SEQ ID NO: 37684 - protein, 5 aa, Artificial Sequence
  Description of Artificial Sequence: Synthetic peptide
  TIM3-0438[TIM-3] vhCDR1
TTYMH

SEQ ID NO: 37685 - protein, 17 aa, Artificial Sequence
  Description of Artificial Sequence: Synthetic peptide
  TIM3-0438[TIM-3] vhCDR2
RIDPADDNTKYAPKFQG

SEQ ID NO: 37686 - protein, 10 aa, Artificial Sequence
  Description of Artificial Sequence: Synthetic peptide
  TIM3-0438[TIM-3] vhCDR3
DFGYVAWFAY

SEQ ID NO: 37687 - protein, 107 aa, Artificial Sequence
  Description of Artificial Sequence: Synthetic polypeptide
  TIM3-0438[TIM-3] variable light Chain
DIVMTQSPLSLPVTPGEPASISCRASQSVDNYVAWYLQKPGQSPQLLIYYASNRYIGVPDRFSGSGSGTDFTLKISRVEAEDVGVYYCQQHYSSPYTFGQGTKVEIK

SEQ ID NO: 37688 - protein, 11 aa, Artificial Sequence
  Description of Artificial Sequence: Synthetic peptide
  TIM3-0438[TIM-3] vlCDR1
RASQSVDNYVA

SEQ ID NO: 37689 - protein, 7 aa, Artificial Sequence
  Description of Artificial Sequence: Synthetic peptide
  TIM3-0438[TIM-3] vlCDR2
YASNRYI

SEQ ID NO: 37690 - protein, 9 aa, Artificial Sequence
  Description of Artificial Sequence: Synthetic peptide
  TIM3-0438[TIM-3] vlCDR3
QQHYSSPYT

SEQ ID NO: 37691 - protein, 119 aa, Artificial Sequence
  Description of Artificial Sequence: Synthetic polypeptide
  TIM3-0443[TIM-3] variable heavy Chain
EVQLVESGGGLVQPGGSLRLSCAASGFNIKTTYMHWVRQAPGKGLEWVGRIDPADDNTKYAPKFQGKATISADTSKNTAYLQMNSLRAEDTAVYYCVRDFGYVAWFAYWGQGTLVTFSS

SEQ ID NO: 37692 - protein, 5 aa, Artificial Sequence
  Description of Artificial Sequence: Synthetic peptide
  TIM3-0443[TIM-3] vhCDR1
TTYMH

SEQ ID NO: 37693 - protein, 17 aa, Artificial Sequence
  Description of Artificial Sequence: Synthetic peptide
  TIM3-0443[TIM-3] vhCDR2
RIDPADDNTKYAPKFQG

SEQ ID NO: 37694 - protein, 10 aa, Artificial Sequence
  Description of Artificial Sequence: Synthetic peptide
  TIM3-0443[TIM-3] vhCDR3
DFGYVAWFAY

SEQ ID NO: 37695 - protein, 107 aa, Artificial Sequence; identical to SEQ ID NO: 37687
  Description of Artificial Sequence: Synthetic polypeptide
  TIM3-0443[TIM-3] variable light Chain

SEQ ID NO: 37696 - protein, 11 aa, Artificial Sequence
  Description of Artificial Sequence: Synthetic peptide
  TIM3-0443[TIM-3] vlCDR1
RASQSVDNYVA

SEQ ID NO: 37697 - protein, 7 aa, Artificial Sequence
  Description of Artificial Sequence: Synthetic peptide
  TIM3-0443[TIM-3] vlCDR2
YASNRYI

SEQ ID NO: 37698 - protein, 9 aa, Artificial Sequence
  Description of Artificial Sequence: Synthetic peptide
  TIM3-0443[TIM-3] vlCDR3
QQHYSSPYT

SEQ ID NO: 37699 - protein, 15 aa, Artificial Sequence
  Description of Artificial Sequence: Synthetic peptide
GGGGSGGGGSGGGGS

SEQ ID NO: 37700 - protein, 18 aa, Artificial Sequence
  Description of Artificial Sequence: Synthetic peptide
GSTSGSGKPGSGEGSTKG

SEQ ID NO: 37701 - protein, 14 aa, Artificial Sequence
  Description of Artificial Sequence: Synthetic peptide
IRPRAIGGSKPRVA

SEQ ID NO: 37702 - protein, 15 aa, Artificial Sequence
  Description of Artificial Sequence: Synthetic peptide
GKGGSGKGGSGKGGS

SEQ ID NO: 37703 - protein, 15 aa, Artificial Sequence
  Description of Artificial Sequence: Synthetic peptide
GGKGSGGKGSGGKGS

SEQ ID NO: 37704 - protein, 15 aa, Artificial Sequence
  Description of Artificial Sequence: Synthetic peptide
GGGKSGGGKSGGGKS

SEQ ID NO: 37705 - protein, 15 aa, Artificial Sequence
  Description of Artificial Sequence: Synthetic peptide
GKGKSGKGKSGKGKS

SEQ ID NO: 37706 - protein, 15 aa, Artificial Sequence
  Description of Artificial Sequence: Synthetic peptide
GGGKSGGKGSGKGGS

SEQ ID NO: 37707 - protein, 15 aa, Artificial Sequence
  Description of Artificial Sequence: Synthetic peptide
GKPGSGKPGSGKPGS

SEQ ID NO: 37708 - protein, 20 aa, Artificial Sequence
  Description of Artificial Sequence: Synthetic peptide
GKPGSGKPGSGKPGSGKPGS

SEQ ID NO: 37709 - protein, 20 aa, Artificial Sequence
  Description of Artificial Sequence: Synthetic peptide
GKGKSGKGKSGKGKSGKGKS

SEQ ID NO: 37710 - protein, 20 aa, Artificial Sequence
  Description of Artificial Sequence: Synthetic peptide
GGGGSGGGGSGGGGSGGGGS

SEQ ID NO: 37711 - protein, 14 aa, Artificial Sequence
  Description of Artificial Sequence: Synthetic peptide
STAGDTHLGGEDFD

SEQ ID NO: 37712 - protein, 15 aa, Artificial Sequence
  Description of Artificial Sequence: Synthetic peptide
GEGGSGEGGSGEGGS

SEQ ID NO: 37713 - protein, 15 aa, Artificial Sequence
  Description of Artificial Sequence: Synthetic peptide
GGEGSGGEGSGGEGS

SEQ ID NO: 37714 - protein, 15 aa, Artificial Sequence
  Description of Artificial Sequence: Synthetic peptide
GGGESGGGESGGGES

SEQ ID NO: 37715 - protein, 15 aa, Artificial Sequence
  Description of Artificial Sequence: Synthetic peptide
GEGESGEGESGEGES

SEQ ID NO: 37716 - protein, 15 aa, Artificial Sequence
  Description of Artificial Sequence: Synthetic peptide
GGGESGGEGSGEGGS

SEQ ID NO: 37717 - protein, 20 aa, Artificial Sequence
  Description of Artificial Sequence: Synthetic peptide
GEGESGEGESGEGESGEGES

SEQ ID NO: 37718 - protein, 15 aa, Artificial Sequence
  Description of Artificial Sequence: Synthetic peptide
GGGGSGGGGSGGGGS

SEQ ID NO: 37719 - protein, 20 aa, Artificial Sequence
  Description of Artificial Sequence: Synthetic peptide
GGGGSGGGGSGGGGSGGGGS

SEQ ID NO: 37720 - protein, 18 aa, Artificial Sequence
  Description of Artificial Sequence: Synthetic peptide
GSTSGSGKPGSGEGSTKG

SEQ ID NO: 37721 - protein, 19 aa, Artificial Sequence
  Description of Artificial Sequence: Synthetic peptide
PRGASKSGSASQTGSAPGS

SEQ ID NO: 37722 - protein, 19 aa, Artificial Sequence
  Description of Artificial Sequence: Synthetic peptide
GTAAAGAGAAGGAAAGAAG

SEQ ID NO: 37723 - protein, 19 aa, Artificial Sequence
  Description of Artificial Sequence: Synthetic peptide
GTSGSSGSGSGGSGSGGGG

SEQ ID NO: 37724 - protein, 20 aa, Artificial Sequence
  Description of Artificial Sequence: Synthetic peptide
GKPGSGKPGSGKPGSGKPGS

SEQ ID NO: 37725 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 37726 - protein, 231 aa, Artificial Sequence; identical to SEQ ID NO: 21532
  Description of Artificial Sequence: Synthetic polypeptide

SEQ ID NO: 37727 - protein, 107 aa, Artificial Sequence [sequence omitted]

SEQ ID NO: 37728 - protein, 329 aa, Artificial Sequence; identical to SEQ ID NO: 37725
  Description of Artificial Sequence: Synthetic polypeptide

SEQ ID NO: 37729 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37730 - protein, 107 aa, Artificial Sequence [sequence omitted]

SEQ ID NO: 37731 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 37732 - protein, 231 aa, Artificial Sequence; identical to SEQ ID NO: 37729
  Description of Artificial Sequence: Synthetic polypeptide

SEQ ID NO: 37733 - protein, 107 aa, Artificial Sequence [sequence omitted]

SEQ ID NO: 37734 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKSGFYPSDIAVEWESDGQPENNYKTTPPVLDSDGSFFLYSKLEVDKSRWEQGDVFSCSVMHEALHNHYTQKSLSLSPGK

SEQ ID NO: 37735 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 37736 - protein, 107 aa, Artificial Sequence [sequence omitted]

SEQ ID NO: 37737 - protein, 329 aa, Artificial Sequence; identical to SEQ ID NO: 37725
  Description of Artificial Sequence: Synthetic polypeptide

SEQ ID NO: 37738 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37739 - protein, 107 aa, Artificial Sequence [sequence omitted]

SEQ ID NO: 37740 - protein, 329 aa, Artificial Sequence; identical to SEQ ID NO: 37725
  Description of Artificial Sequence: Synthetic polypeptide

SEQ ID NO: 37741 - protein, 231 aa, Artificial Sequence; identical to SEQ ID NO: 21532
  Description of Artificial Sequence: Synthetic polypeptide

SEQ ID NO: 37742 - protein, 107 aa, Artificial Sequence [sequence omitted]

SEQ ID NO: 37743 - protein, 329 aa, Artificial Sequence; identical to SEQ ID NO: 37725
  Description of Artificial Sequence: Synthetic polypeptide

SEQ ID NO: 37744 - protein, 231 aa, Artificial Sequence; identical to SEQ ID NO: 37729
  Description of Artificial Sequence: Synthetic polypeptide

SEQ ID NO: 37745 - protein, 107 aa, Artificial Sequence [sequence omitted]

SEQ ID NO: 37746 - protein, 329 aa, Artificial Sequence; identical to SEQ ID NO: 37731
  Description of Artificial Sequence: Synthetic polypeptide

SEQ ID NO: 37747 - protein, 231 aa, Artificial Sequence; identical to SEQ ID NO: 37729
  Description of Artificial Sequence: Synthetic polypeptide

SEQ ID NO: 37748 - protein, 107 aa, Artificial Sequence [sequence omitted]

SEQ ID NO: 37749 - protein, 330 aa, Artificial Sequence; identical to SEQ ID NO: 37734
  Description of Artificial Sequence: Synthetic polypeptide

SEQ ID NO: 37750 - protein, 231 aa, Artificial Sequence; identical to SEQ ID NO: 37735
  Description of Artificial Sequence: Synthetic polypeptide

SEQ ID NO: 37751 - protein, 107 aa, Artificial Sequence [sequence omitted]

SEQ ID NO: 37752 - protein, 329 aa, Artificial Sequence; identical to SEQ ID NO: 37725
  Description of Artificial Sequence: Synthetic polypeptide

SEQ ID NO: 37753 - protein, 329 aa, Artificial Sequence; identical to SEQ ID NO: 37738
  Description of Artificial Sequence: Synthetic polypeptide

SEQ ID NO: 37754 - protein, 107 aa, Artificial Sequence [sequence omitted]

SEQ ID NO: 37755 - protein, 20 aa, Artificial Sequence
  Description of Artificial Sequence: Synthetic peptide
GKPGSGKPGSGKPGSGKPGS

SEQ ID NO: 37756 - protein, 5 aa, Artificial Sequence
  Description of Artificial Sequence: Synthetic peptide
GSGGS

SEQ ID NO: 37757 - protein, 5 aa, Artificial Sequence
  Description of Artificial Sequence: Synthetic peptide
GGGGS

SEQ ID NO: 37758 - protein, 4 aa, Artificial Sequence
  Description of Artificial Sequence: Synthetic peptide
GGGS

SEQ ID NO: 37759 - protein, 122 aa, Artificial Sequence; identical to SEQ ID NO: 10908
  Description of Artificial Sequence: Synthetic polypeptide
  VH of XENP19690

SEQ ID NO: 37760 - protein, 5 aa, Artificial Sequence
  Description of Artificial Sequence: Synthetic peptide
  XENP19690 vhCDR1
NYWMN

SEQ ID NO: 37761 - protein, 19 aa, Artificial Sequence
  Description of Artificial Sequence: Synthetic peptide
  XENP19690 vhCDR2
EIRLYSNNYATHYAESVKG

SEQ ID NO: 37762 - protein, 11 aa, Artificial Sequence
  Description of Artificial Sequence: Synthetic peptide
  XENP19690 vhCDR3
YYGNYGGYFDV

SEQ ID NO: 37763 - protein, 107 aa, Artificial Sequence; identical to SEQ ID NO: 10999
  Description of Artificial Sequence: Synthetic polypeptide
  VL of XENP19690

SEQ ID NO: 37764 - protein, 11 aa, Artificial Sequence
  Description of Artificial Sequence: Synthetic peptide
  XENP19690 vlCDR1
RASQSVGNDVA

SEQ ID NO: 37765 - protein, 7 aa, Artificial Sequence
  Description of Artificial Sequence: Synthetic peptide
  XENP19690 vlCDR2
YASHRYT

SEQ ID NO: 37766 - protein, 9 aa, Artificial Sequence
  Description of Artificial Sequence: Synthetic peptide
  XENP19690 vlCDR3
QQDFSSPRT

SEQ ID NO: 37767 - protein, 249 aa, Artificial Sequence; identical to SEQ ID NO: 11375
  Description of Artificial Sequence: Synthetic polypeptide
  scFV of XENP19690

SEQ ID NO: 37768 - protein, 122 aa, Artificial Sequence; identical to SEQ ID NO: 10917
  Description of Artificial Sequence: Synthetic polypeptide
  VH of XENP21215

SEQ ID NO: 37769 - protein, 5 aa, Artificial Sequence
  Description of Artificial Sequence: Synthetic peptide
  XENP21215 vhCDR1
NYWMN

SEQ ID NO: 37770 - protein, 19 aa, Artificial Sequence
  Description of Artificial Sequence: Synthetic peptide
  XENP21215 vhCDR2
EIRLYSNNYATHYAESVKG

SEQ ID NO: 37771 - protein, 11 aa, Artificial Sequence
  Description of Artificial Sequence: Synthetic peptide
  XENP21215 vhCDR3
YYGNYGGYFDV

SEQ ID NO: 37772 - protein, 107 aa, Artificial Sequence; identical to SEQ ID NO: 22811
  Description of Artificial Sequence: Synthetic polypeptide
  VL of XENP21215

SEQ ID NO: 37773 - protein, 11 aa, Artificial Sequence
  Description of Artificial Sequence: Synthetic peptide
  XENP21215 vlCDR1
RASQSVGNDVA

SEQ ID NO: 37774 - protein, 7 aa, Artificial Sequence
  Description of Artificial Sequence: Synthetic peptide
  XENP21215 vlCDR2
YASHRYT

SEQ ID NO: 37775 - protein, 9 aa, Artificial Sequence
  Description of Artificial Sequence: Synthetic peptide
  XENP21215 vlCDR3
QQDWSSPRT

SEQ ID NO: 37776 - protein, 249 aa, Artificial Sequence
  Description of Artificial Sequence: Synthetic polypeptide
  scFV of XENP21215
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK

SEQ ID NO: 37777 - protein, 107 aa, Artificial Sequence; identical to SEQ ID NO: 10999
  Description of Artificial Sequence: Synthetic polypeptide
  VH of XENP19692

SEQ ID NO: 37778 - protein, 11 aa, Artificial Sequence
  Description of Artificial Sequence: Synthetic peptide
  XENP19692 vhCDR1
RASQSVGNDVA

SEQ ID NO: 37779 - protein, 7 aa, Artificial Sequence
  Description of Artificial Sequence: Synthetic peptide
  XENP19692 vhCDR2
YASHRYT

SEQ ID NO: 37780 - protein, 9 aa, Artificial Sequence
  Description of Artificial Sequence: Synthetic peptide
  XENP19692 vhCDR3
QQDFSSPRT

SEQ ID NO: 37781 - protein, 122 aa, Artificial Sequence; identical to SEQ ID NO: 10908
  Description of Artificial Sequence: Synthetic polypeptide
  VL of XENP19692

SEQ ID NO: 37782 - protein, 5 aa, Artificial Sequence
  Description of Artificial Sequence: Synthetic peptide
  XENP19692 vlCDR1
NYWMN

SEQ ID NO: 37783 - protein, 19 aa, Artificial Sequence
  Description of Artificial Sequence: Synthetic peptide
  XENP19692 vlCDR2
EIRLYSNNYATHYAESVKG

SEQ ID NO: 37784 - protein, 11 aa, Artificial Sequence
  Description of Artificial Sequence: Synthetic peptide
  XENP19692 vlCDR3
YYGNYGGYFDV

SEQ ID NO: 37785 - protein, 249 aa, Artificial Sequence; identical to SEQ ID NO: 11393
  Description of Artificial Sequence: Synthetic polypeptide
  scFV of XENP19692

SEQ ID NO: 37786 - protein, 107 aa, Artificial Sequence; identical to SEQ ID NO: 11359
  Description of Artificial Sequence: Synthetic polypeptide
  VH of XENP19669

SEQ ID NO: 37787 - protein, 11 aa, Artificial Sequence
  Description of Artificial Sequence: Synthetic peptide
  XENP19669 vhCDR1
RASQSVGNDVA

SEQ ID NO: 37788 - protein, 7 aa, Artificial Sequence
  Description of Artificial Sequence: Synthetic peptide
  XENP19669 vhCDR2
YASHRYT

SEQ ID NO: 37789 - protein, 9 aa, Artificial Sequence
  Description of Artificial Sequence: Synthetic peptide
  XENP19669 vhCDR3
QQDFSSPRT

SEQ ID NO: 37790 - protein, 122 aa, Artificial Sequence; identical to SEQ ID NO: 11358
  Description of Artificial Sequence: Synthetic polypeptide
  VL of XENP19669

SEQ ID NO: 37791 - protein, 5 aa, Artificial Sequence
  Description of Artificial Sequence: Synthetic peptide
  XENP19669 vlCDR1
NYWMN

SEQ ID NO: 37792 - protein, 19 aa, Artificial Sequence
  Description of Artificial Sequence: Synthetic peptide
  XENP19669 vlCDR2
EIRLYSNNYATHYAESVKG

SEQ ID NO: 37793 - protein, 11 aa, Artificial Sequence
  Description of Artificial Sequence: Synthetic peptide
  XENP19669 vlCDR3
YYGNYGGYFDV

SEQ ID NO: 37794 - protein, 249 aa, Artificial Sequence; identical to SEQ ID NO: 11366
  Description of Artificial Sequence: Synthetic polypeptide
  scFV of XENP19669

SEQ ID NO: 37795 - protein, 120 aa, Artificial Sequence; identical to SEQ ID NO: 11412
  Description of Artificial Sequence: Synthetic polypeptide
  VH of XENP20162

SEQ ID NO: 37796 - protein, 5 aa, Artificial Sequence
  Description of Artificial Sequence: Synthetic peptide
  XENP20162 vhCDR1
NYWLG

SEQ ID NO: 37797 - protein, 17 aa, Artificial Sequence
  Description of Artificial Sequence: Synthetic peptide
  XENP20162 vhCDR2
NFYPGSSNTYYNEKFQG

SEQ ID NO: 37798 - protein, 11 aa, Artificial Sequence
  Description of Artificial Sequence: Synthetic peptide
  XENP20162 vhCDR3
HYGTNYRYFDV

SEQ ID NO: 37799 - protein, 107 aa, Artificial Sequence; identical to SEQ ID NO: 11413
  Description of Artificial Sequence: Synthetic polypeptide
  VL of XENP20162

SEQ ID NO: 37800 - protein, 11 aa, Artificial Sequence
  Description of Artificial Sequence: Synthetic peptide
  XENP20162 vlCDR1
RASQSVSNDVA

SEQ ID NO: 37801 - protein, 7 aa, Artificial Sequence
  Description of Artificial Sequence: Synthetic peptide
  XENP20162 vlCDR2
YASNRYT

SEQ ID NO: 37802 - protein, 9 aa, Artificial Sequence
  Description of Artificial Sequence: Synthetic peptide
  XENP20162 vlCDR3
QQDYSSPYT

SEQ ID NO: 37803 - protein, 247 aa, Artificial Sequence; identical to SEQ ID NO: 11411
  Description of Artificial Sequence: Synthetic polypeptide
  scFV of XENP20162

SEQ ID NO: 37804 - protein, 118 aa, Artificial Sequence; identical to SEQ ID NO: 409
  Description of Artificial Sequence: Synthetic polypeptide
  VH of [CTLA-4]_H0.25_L0 Anti-CTLA-4 Fv sequences (XENP19235 Fab, XENP19769 scFv)

SEQ ID NO: 37805 - protein, 5 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vhCDR1
SYAMH

SEQ ID NO: 37806 - protein, 17 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vhCDR2
FISYDGNNKYYADSVKG

SEQ ID NO: 37807 - protein, 9 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vhCDR3
TGWLGPFDY

SEQ ID NO: 37808 - protein, 108 aa, Artificial Sequence; identical to SEQ ID NO: 23
  Description of Artificial Sequence: Synthetic polypeptide
  VL of [CTLA-4]_H0.25_L0 Anti-CTLA-4 Fv sequences (XENP19235 Fab, XENP19769 scFv)

SEQ ID NO: 37809 - protein, 12 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vlCDR1
RASQSVGSSYLA

SEQ ID NO: 37810 - protein, 7 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vlCDR2
GAFSRAT

SEQ ID NO: 37811 - protein, 9 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vlCDR3
QQYGSSPWT

SEQ ID NO: 37812 - protein, 246 aa, Artificial Sequence; identical to SEQ ID NO: 408
  Description of Artificial Sequence: Synthetic polypeptide
  scFV of [CTLA-4]_H0.25_L0 Anti-CTLA-4 Fv sequences (XENP19235 Fab, XENP19769 scFv)

SEQ ID NO: 37813 - protein, 118 aa, Artificial Sequence; identical to SEQ ID NO: 418
  Description of Artificial Sequence: Synthetic polypeptide
  VH of [CTLA-4]_H0.26_L0 Anti-CTLA-4 Fv sequences (XENP19236 Fab, XENP19770 scFv)

SEQ ID NO: 37814 - protein, 5 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vhCDR1
SYGMH

SEQ ID NO: 37815 - protein, 17 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vhCDR2
FISYDGNNKYYADSVKG

SEQ ID NO: 37816 - protein, 9 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vhCDR3
TGWLGPFDY

SEQ ID NO: 37817 - protein, 108 aa, Artificial Sequence; identical to SEQ ID NO: 23
  Description of Artificial Sequence: Synthetic polypeptide
  VL of [CTLA-4]_H0.26_L0 Anti-CTLA-4 Fv sequences (XENP19236 Fab, XENP19770 scFv)

SEQ ID NO: 37818 - protein, 12 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vlCDR1
RASQSVGSSYLA

SEQ ID NO: 37819 - protein, 7 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vlCDR2
GAFSRAT

SEQ ID NO: 37820 - protein, 9 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vlCDR3
QQYGSSPWT

SEQ ID NO: 37821 - protein, 246 aa, Artificial Sequence; identical to SEQ ID NO: 417
  Description of Artificial Sequence: Synthetic polypeptide
  scFV of [CTLA-4]_H0.26_L0 Anti-CTLA-4 Fv sequences (XENP19236 Fab, XENP19770 scFv)

SEQ ID NO: 37822 - protein, 118 aa, Artificial Sequence; identical to SEQ ID NO: 427
  Description of Artificial Sequence: Synthetic polypeptide
  VH of [CTLA-4]_H0.27_L0 Anti-CTLA-4 Fv sequences (XENP19237 Fab, XENP19771 scFv)

SEQ ID NO: 37823 - protein, 5 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vhCDR1
SYSMH

SEQ ID NO: 37824 - protein, 17 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vhCDR2
FISYDGNNKYYADSVKG

SEQ ID NO: 37825 - protein, 9 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vhCDR3
TGWLGPFDY

SEQ ID NO: 37826 - protein, 108 aa, Artificial Sequence; identical to SEQ ID NO: 23
  Description of Artificial Sequence: Synthetic polypeptide
  VL of [CTLA-4]_H0.27_L0 Anti-CTLA-4 Fv sequences (XENP19237 Fab, XENP19771 scFv)

SEQ ID NO: 37827 - protein, 12 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vlCDR1
RASQSVGSSYLA

SEQ ID NO: 37828 - protein, 7 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vlCDR2
GAFSRAT

SEQ ID NO: 37829 - protein, 9 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vlCDR3
QQYGSSPWT

SEQ ID NO: 37830 - protein, 246 aa, Artificial Sequence; identical to SEQ ID NO: 426
  Description of Artificial Sequence: Synthetic polypeptide
  scFV of [CTLA-4]_H0.27_L0 Anti-CTLA-4 Fv sequences (XENP19237 Fab, XENP19771 scFv)

SEQ ID NO: 37831 - protein, 246 aa, Artificial Sequence; identical to SEQ ID NO: 444
  Description of Artificial Sequence: Synthetic polypeptide
  scFV of [CTLA-4]_H0.29_L0 Fab XENP19773, scFv XENP19239

SEQ ID NO: 37832 - protein, 118 aa, Artificial Sequence; identical to SEQ ID NO: 526
  Description of Artificial Sequence: Synthetic polypeptide
  VH of [CTLA-4]_H0.38_L0 (Fab XENP19248, scFv XENP19782)

SEQ ID NO: 37833 - protein, 5 aa, Artificial Sequence
  Description of Artificial Sequence: Synthetic peptide
  [CTLA-4]_H0.38_L0 (Fab XENP19248, scFv XENP19782) vhCDR1
SYTMH

SEQ ID NO: 37834 - protein, 17 aa, Artificial Sequence
  Description of Artificial Sequence: Synthetic peptide
  [CTLA-4]_H0.38_L0 (Fab XENP19248, scFv XENP19782) vhCDR2
FISYDGNNKYYADSVKG

SEQ ID NO: 37835 - protein, 9 aa, Artificial Sequence
  Description of Artificial Sequence: Synthetic peptide
  [CTLA-4]_H0.38_L0 (Fab XENP19248, scFv XENP19782) vhCDR3
TGWLGPFDY

SEQ ID NO: 37836 - protein, 108 aa, Artificial Sequence; identical to SEQ ID NO: 23
  Description of Artificial Sequence: Synthetic polypeptide
  VL of [CTLA-4]_H0.38_L0 (Fab XENP19248, scFv XENP19782)

SEQ ID NO: 37837 - protein, 12 aa, Artificial Sequence
  Description of Artificial Sequence: Synthetic peptide
  [CTLA-4]_H0.38_L0 (Fab XENP19248, scFv XENP19782) vlCDR1
RASQSVGSSYLA

SEQ ID NO: 37838 - protein, 7 aa, Artificial Sequence
  Description of Artificial Sequence: Synthetic peptide
  [CTLA-4]_H0.38_L0 (Fab XENP19248, scFv XENP19782) vlCDR2
GAFSRAT

SEQ ID NO: 37839 - protein, 9 aa, Artificial Sequence
  Description of Artificial Sequence: Synthetic peptide
  [CTLA-4]_H0.38_L0 (Fab XENP19248, scFv XENP19782) vlCDR3
QQYGSSPWT

SEQ ID NO: 37840 - protein, 246 aa, Artificial Sequence; identical to SEQ ID NO: 525
  Description of Artificial Sequence: Synthetic polypeptide
  scFV of [CTLA-4]_H0.38_L0 (Fab XENP19248, scFv XENP19782)

SEQ ID NO: 37841 - protein, 118 aa, Artificial Sequence; identical to SEQ ID NO: 535
  Description of Artificial Sequence: Synthetic polypeptide
  VH of [CTLA-4]_H0.39_L0 (Fab XENP19249, scFv XENP19783)

SEQ ID NO: 37842 - protein, 5 aa, Artificial Sequence
  Description of Artificial Sequence: Synthetic peptide
  [CTLA-4]_H0.39_L0 (Fab XENP19249, scFv XENP19783) vhCDR1
SYTMH

SEQ ID NO: 37843 - protein, 17 aa, Artificial Sequence
  Description of Artificial Sequence: Synthetic peptide
  [CTLA-4]_H0.39_L0 (Fab XENP19249, scFv XENP19783) vhCDR2
FISYDGNNKYYADSVKG

SEQ ID NO: 37844 - protein, 9 aa, Artificial Sequence
  Description of Artificial Sequence: Synthetic peptide
  [CTLA-4]_H0.39_L0 (Fab XENP19249, scFv XENP19783) vhCDR3
TGWLGPFDY

SEQ ID NO: 37845 - protein, 108 aa, Artificial Sequence; identical to SEQ ID NO: 23
  Description of Artificial Sequence: Synthetic polypeptide
  VL of [CTLA-4]_H0.39_L0 (Fab XENP19249, scFv XENP19783)

SEQ ID NO: 37846 - protein, 12 aa, Artificial Sequence
  Description of Artificial Sequence: Synthetic peptide
  [CTLA-4]_H0.39_L0 (Fab XENP19249, scFv XENP19783) vlCDR1
RASQSVGSSYLA

SEQ ID NO: 37847 - protein, 7 aa, Artificial Sequence
  Description of Artificial Sequence: Synthetic peptide
  [CTLA-4]_H0.39_L0 (Fab XENP19249, scFv XENP19783) vlCDR2
GAFSRAT

SEQ ID NO: 37848 - protein, 9 aa, Artificial Sequence
  Description of Artificial Sequence: Synthetic peptide
  [CTLA-4]_H0.39_L0 (Fab XENP19249, scFv XENP19783) vlCDR3
QQYGSSPWT

SEQ ID NO: 37849 - protein, 246 aa, Artificial Sequence; identical to SEQ ID NO: 534
  Description of Artificial Sequence: Synthetic polypeptide
  scFV of [CTLA-4]_H0.39_L0 (Fab XENP19249, scFv XENP19783)

SEQ ID NO: 37850 - protein, 118 aa, Artificial Sequence; identical to SEQ ID NO: 544
  Description of Artificial Sequence: Synthetic polypeptide
  VH of [CTLA-4]_H0.40_L0 (Fab XENP19250, scFv XENP19784)

SEQ ID NO: 37851 - protein, 5 aa, Artificial Sequence
  Description of Artificial Sequence: Synthetic peptide
  [CTLA-4]_H0.40_L0 (Fab XENP19250, scFv XENP19784) vhCDR1
SYTMH

SEQ ID NO: 37852 - protein, 17 aa, Artificial Sequence
  Description of Artificial Sequence: Synthetic peptide
  [CTLA-4]_H0.40_L0 (Fab XENP19250, scFv XENP19784) vhCDR2
FISYDGNNKYYADSVKG

SEQ ID NO: 37853 - protein, 9 aa, Artificial Sequence
  Description of Artificial Sequence: Synthetic peptide
  [CTLA-4]_H0.40_L0 (Fab XENP19250, scFv XENP19784) vhCDR3
TGWLGPFDY

SEQ ID NO: 37854 - protein, 108 aa, Artificial Sequence; identical to SEQ ID NO: 23
  Description of Artificial Sequence: Synthetic polypeptide
  VL of [CTLA-4]_H0.40_L0 (Fab XENP19250, scFv XENP19784)

SEQ ID NO: 37855 - protein, 12 aa, Artificial Sequence
  Description of Artificial Sequence: Synthetic peptide
  [CTLA-4]_H0.40_L0 (Fab XENP19250, scFv XENP19784) vlCDR1
RASQSVGSSYLA

SEQ ID NO: 37856 - protein, 7 aa, Artificial Sequence
  Description of Artificial Sequence: Synthetic peptide
  [CTLA-4]_H0.40_L0 (Fab XENP19250, scFv XENP19784) vlCDR2
GAFSRAT

SEQ ID NO: 37857 - protein, 9 aa, Artificial Sequence
  Description of Artificial Sequence: Synthetic peptide
  [CTLA-4]_H0.40_L0 (Fab XENP19250, scFv XENP19784) vlCDR3
QQYGSSPWT

SEQ ID NO: 37858 - protein, 246 aa, Artificial Sequence; identical to SEQ ID NO: 543
  Description of Artificial Sequence: Synthetic polypeptide
  scFV of [CTLA-4]_H0.40_L0 (Fab XENP19250, scFv XENP19784)

SEQ ID NO: 37859 - protein, 118 aa, Artificial Sequence; identical to SEQ ID NO: 814
  Description of Artificial Sequence: Synthetic polypeptide
  VH of [CTLA-4]_H0.70_L0  (Fab XENP19280, scFv XENP19818)

SEQ ID NO: 37860 - protein, 5 aa, Artificial Sequence
  Description of Artificial Sequence: Synthetic peptide
  [CTLA-4]_H0.70_L0  (Fab XENP19280, scFv XENP19818) vhCDR1
SYTMH

SEQ ID NO: 37861 - protein, 17 aa, Artificial Sequence
  Description of Artificial Sequence: Synthetic peptide
  [CTLA-4]_H0.70_L0  (Fab XENP19280, scFv XENP19818) vhCDR2
FISYDGSNKYYADSVKG

SEQ ID NO: 37862 - protein, 9 aa, Artificial Sequence
  Description of Artificial Sequence: Synthetic peptide
  [CTLA-4]_H0.70_L0  (Fab XENP19280, scFv XENP19818) vhCDR3
TGWLGPFDY

SEQ ID NO: 37863 - protein, 108 aa, Artificial Sequence; identical to SEQ ID NO: 23
  Description of Artificial Sequence: Synthetic polypeptide
  VL of [CTLA-4]_H0.70_L0  (Fab XENP19280, scFv XENP19818)

SEQ ID NO: 37864 - protein, 12 aa, Artificial Sequence
  Description of Artificial Sequence: Synthetic peptide
  [CTLA-4]_H0.70_L0  (Fab XENP19280, scFv XENP19818) vlCDR1
RASQSVGSSYLA

SEQ ID NO: 37865 - protein, 7 aa, Artificial Sequence
  Description of Artificial Sequence: Synthetic peptide
  [CTLA-4]_H0.70_L0  (Fab XENP19280, scFv XENP19818) vlCDR2
GAFSRAT

SEQ ID NO: 37866 - protein, 9 aa, Artificial Sequence
  Description of Artificial Sequence: Synthetic peptide
  [CTLA-4]_H0.70_L0  (Fab XENP19280, scFv XENP19818) vlCDR3
QQYGSSPWT

SEQ ID NO: 37867 - protein, 246 aa, Artificial Sequence; identical to SEQ ID NO: 813
  Description of Artificial Sequence: Synthetic polypeptide
  scFV of [CTLA-4]_H0.70_L0  (Fab XENP19280, scFv XENP19818)

SEQ ID NO: 37868 - protein, 118 aa, Artificial Sequence; identical to SEQ ID NO: 22
  Description of Artificial Sequence: Synthetic polypeptide
  VH of [CTLA-4]_H0_L0.22  (Fab XENP19437, scFv XENP19910)

SEQ ID NO: 37869 - protein, 5 aa, Artificial Sequence
  Description of Artificial Sequence: Synthetic peptide
  [CTLA-4]_H0_L0.22  (Fab XENP19437, scFv XENP19910) vhCDR1
SYTMH

SEQ ID NO: 37870 - protein, 17 aa, Artificial Sequence
  Description of Artificial Sequence: Synthetic peptide
  [CTLA-4]_H0_L0.22  (Fab XENP19437, scFv XENP19910) vhCDR2
FISYDGNNKYYADSVKG

SEQ ID NO: 37871 - protein, 9 aa, Artificial Sequence
  Description of Artificial Sequence: Synthetic peptide
  [CTLA-4]_H0_L0.22  (Fab XENP19437, scFv XENP19910) vhCDR3
TGWLGPFDY

SEQ ID NO: 37872 - protein, 108 aa, Artificial Sequence; identical to SEQ ID NO: 1607
  Description of Artificial Sequence: Synthetic polypeptide
  VL of [CTLA-4]_H0_L0.22  (Fab XENP19437, scFv XENP19910)

SEQ ID NO: 37873 - protein, 12 aa, Artificial Sequence
  Description of Artificial Sequence: Synthetic peptide
  [CTLA-4]_H0_L0.22  (Fab XENP19437, scFv XENP19910) vlCDR1
RASQSVSSSYLA

SEQ ID NO: 37874 - protein, 7 aa, Artificial Sequence
  Description of Artificial Sequence: Synthetic peptide
  [CTLA-4]_H0_L0.22  (Fab XENP19437, scFv XENP19910) vlCDR2
GAFSRAT

SEQ ID NO: 37875 - protein, 9 aa, Artificial Sequence
  Description of Artificial Sequence: Synthetic peptide
  [CTLA-4]_H0_L0.22  (Fab XENP19437, scFv XENP19910) vlCDR3
QQYGSSPWT

SEQ ID NO: 37876 - protein, 246 aa, Artificial Sequence; identical to SEQ ID NO: 1605
  Description of Artificial Sequence: Synthetic polypeptide
  scFV of [CTLA-4]_H0_L0.22  (Fab XENP19437, scFv XENP19910)

SEQ ID NO: 37877 - protein, 118 aa, Artificial Sequence; identical to SEQ ID NO: 130
  Description of Artificial Sequence: Synthetic polypeptide
  VH of [CTLA-4]_H2_L0  (Fab XENP,19545 scFv XENP19552)

SEQ ID NO: 37878 - protein, 5 aa, Artificial Sequence
  Description of Artificial Sequence: Synthetic peptide
  [CTLA-4]_H2_L0  (Fab XENP,19545 scFv XENP19552) vhCDR1
SYTMH

SEQ ID NO: 37879 - protein, 17 aa, Artificial Sequence
  Description of Artificial Sequence: Synthetic peptide
  [CTLA-4]_H2_L0  (Fab XENP,19545 scFv XENP19552) vhCDR2
FISYDGNNKYYPGSVKG

SEQ ID NO: 37880 - protein, 9 aa, Artificial Sequence
  Description of Artificial Sequence: Synthetic peptide
  [CTLA-4]_H2_L0  (Fab XENP,19545 scFv XENP19552) vhCDR3
TGWLGPFDY

SEQ ID NO: 37881 - protein, 108 aa, Artificial Sequence; identical to SEQ ID NO: 23
  Description of Artificial Sequence: Synthetic polypeptide
  VL of [CTLA-4]_H2_L0  (Fab XENP,19545 scFv XENP19552)

SEQ ID NO: 37882 - protein, 12 aa, Artificial Sequence
  Description of Artificial Sequence: Synthetic peptide
  [CTLA-4]_H2_L0  (Fab XENP,19545 scFv XENP19552) vlCDR1
RASQSVGSSYLA

SEQ ID NO: 37883 - protein, 7 aa, Artificial Sequence
  Description of Artificial Sequence: Synthetic peptide
  [CTLA-4]_H2_L0  (Fab XENP,19545 scFv XENP19552) vlCDR2
GAFSRAT

SEQ ID NO: 37884 - protein, 9 aa, Artificial Sequence
  Description of Artificial Sequence: Synthetic peptide
  [CTLA-4]_H2_L0  (Fab XENP,19545 scFv XENP19552) vlCDR3
QQYGSSPWT

SEQ ID NO: 37885 - protein, 246 aa, Artificial Sequence; identical to SEQ ID NO: 129
  Description of Artificial Sequence: Synthetic polypeptide
  scFV of [CTLA-4]_H2_L0  (Fab XENP,19545 scFv XENP19552)

SEQ ID NO: 37886 - protein, 118 aa, Artificial Sequence; identical to SEQ ID NO: 2614
  Description of Artificial Sequence: Synthetic polypeptide
  VH of [CTLA-4]_H3.21_L0.124  (Fab XENP20422, scFv XENP20431)

SEQ ID NO: 37887 - protein, 5 aa, Artificial Sequence
  Description of Artificial Sequence: Synthetic peptide
  [CTLA-4]_H3.21_L0.124  (Fab XENP20422, scFv XENP20431) vhCDR1
SYTMH

SEQ ID NO: 37888 - protein, 17 aa, Artificial Sequence
  Description of Artificial Sequence: Synthetic peptide
  [CTLA-4]_H3.21_L0.124  (Fab XENP20422, scFv XENP20431) vhCDR2
FISYDGNTKYYADSVKG

SEQ ID NO: 37889 - protein, 9 aa, Artificial Sequence
  Description of Artificial Sequence: Synthetic peptide
  [CTLA-4]_H3.21_L0.124  (Fab XENP20422, scFv XENP20431) vhCDR3
GGLLGPFDL

SEQ ID NO: 37890 - protein, 108 aa, Artificial Sequence; identical to SEQ ID NO: 2723
  Description of Artificial Sequence: Synthetic polypeptide
  VL of [CTLA-4]_H3.21_L0.124  (Fab XENP20422, scFv XENP20431)

SEQ ID NO: 37891 - protein, 12 aa, Artificial Sequence
  Description of Artificial Sequence: Synthetic peptide
  [CTLA-4]_H3.21_L0.124  (Fab XENP20422, scFv XENP20431) vlCDR1
RASQSVGSSYLA

SEQ ID NO: 37892 - protein, 7 aa, Artificial Sequence
  Description of Artificial Sequence: Synthetic peptide
  [CTLA-4]_H3.21_L0.124  (Fab XENP20422, scFv XENP20431) vlCDR2
GASSRAT

SEQ ID NO: 37893 - protein, 9 aa, Artificial Sequence
  Description of Artificial Sequence: Synthetic peptide
  [CTLA-4]_H3.21_L0.124  (Fab XENP20422, scFv XENP20431) vlCDR3
QQYGSSPWT

SEQ ID NO: 37894 - protein, 246 aa, Artificial Sequence; identical to SEQ ID NO: 2838
  Description of Artificial Sequence: Synthetic polypeptide
  scFV of [CTLA-4]_H3.21_L0.124  (Fab XENP20422, scFv XENP20431)

SEQ ID NO: 37895 - protein, 118 aa, Artificial Sequence; identical to SEQ ID NO: 2614
  Description of Artificial Sequence: Synthetic polypeptide
  VH of [CTLA-4]_H3.21_L0.129  (Fab XENP20423, scFv XENP20432)

SEQ ID NO: 37896 - protein, 5 aa, Artificial Sequence
  Description of Artificial Sequence: Synthetic peptide
  [CTLA-4]_H3.21_L0.129  (Fab XENP20423, scFv XENP20432) vhCDR1
SYTMH

SEQ ID NO: 37897 - protein, 17 aa, Artificial Sequence
  Description of Artificial Sequence: Synthetic peptide
  [CTLA-4]_H3.21_L0.129  (Fab XENP20423, scFv XENP20432) vhCDR2
FISYDGNTKYYADSVKG

SEQ ID NO: 37898 - protein, 9 aa, Artificial Sequence
  Description of Artificial Sequence: Synthetic peptide
  [CTLA-4]_H3.21_L0.129  (Fab XENP20423, scFv XENP20432) vhCDR3
GGLLGPFDL

SEQ ID NO: 37899 - protein, 108 aa, Artificial Sequence; identical to SEQ ID NO: 2768
  Description of Artificial Sequence: Synthetic polypeptide
  VL of [CTLA-4]_H3.21_L0.129  (Fab XENP20423, scFv XENP20432)

SEQ ID NO: 37900 - protein, 12 aa, Artificial Sequence
  Description of Artificial Sequence: Synthetic peptide
  [CTLA-4]_H3.21_L0.129  (Fab XENP20423, scFv XENP20432) vlCDR1
RASQSVGSSYLA

SEQ ID NO: 37901 - protein, 7 aa, Artificial Sequence
  Description of Artificial Sequence: Synthetic peptide
  [CTLA-4]_H3.21_L0.129  (Fab XENP20423, scFv XENP20432) vlCDR2
GASSRAT

SEQ ID NO: 37902 - protein, 9 aa, Artificial Sequence
  Description of Artificial Sequence: Synthetic peptide
  [CTLA-4]_H3.21_L0.129  (Fab XENP20423, scFv XENP20432) vlCDR3
QQYGSSPWT

SEQ ID NO: 37903 - protein, 246 aa, Artificial Sequence; identical to SEQ ID NO: 2847
  Description of Artificial Sequence: Synthetic polypeptide
  scFV of [CTLA-4]_H3.21_L0.129  (Fab XENP20423, scFv XENP20432)

SEQ ID NO: 37904 - protein, 118 aa, Artificial Sequence; identical to SEQ ID NO: 2614
  Description of Artificial Sequence: Synthetic polypeptide
  VH of [CTLA-4]_H3.21_L0.132  (Fab XENP20424, scFv XENP20433)

SEQ ID NO: 37905 - protein, 5 aa, Artificial Sequence
  Description of Artificial Sequence: Synthetic peptide
  [CTLA-4]_H3.21_L0.132  (Fab XENP20424, scFv XENP20433) vhCDR1
SYTMH

SEQ ID NO: 37906 - protein, 17 aa, Artificial Sequence
  Description of Artificial Sequence: Synthetic peptide
  [CTLA-4]_H3.21_L0.132  (Fab XENP20424, scFv XENP20433) vhCDR2
FISYDGNTKYYADSVKG

SEQ ID NO: 37907 - protein, 9 aa, Artificial Sequence
  Description of Artificial Sequence: Synthetic peptide
  [CTLA-4]_H3.21_L0.132  (Fab XENP20424, scFv XENP20433) vhCDR3
GGLLGPFDL

SEQ ID NO: 37908 - protein, 108 aa, Artificial Sequence; identical to SEQ ID NO: 2795
  Description of Artificial Sequence: Synthetic polypeptide
  VL of [CTLA-4]_H3.21_L0.132  (Fab XENP20424, scFv XENP20433)

SEQ ID NO: 37909 - protein, 12 aa, Artificial Sequence
  Description of Artificial Sequence: Synthetic peptide
  [CTLA-4]_H3.21_L0.132  (Fab XENP20424, scFv XENP20433) vlCDR1
RASQSVSSSYLA

SEQ ID NO: 37910 - protein, 7 aa, Artificial Sequence
  Description of Artificial Sequence: Synthetic peptide
  [CTLA-4]_H3.21_L0.132  (Fab XENP20424, scFv XENP20433) vlCDR2
GASSRAT

SEQ ID NO: 37911 - protein, 9 aa, Artificial Sequence
  Description of Artificial Sequence: Synthetic peptide
  [CTLA-4]_H3.21_L0.132  (Fab XENP20424, scFv XENP20433) vlCDR3
QQYGSSPWT

SEQ ID NO: 37912 - protein, 246 aa, Artificial Sequence; identical to SEQ ID NO: 2856
  Description of Artificial Sequence: Synthetic polypeptide
  scFV of [CTLA-4]_H3.21_L0.132  (Fab XENP20424, scFv XENP20433)

SEQ ID NO: 37913 - protein, 118 aa, Artificial Sequence; identical to SEQ ID NO: 2632
  Description of Artificial Sequence: Synthetic polypeptide
  VH of [CTLA-4]_H3.23_L0.124  (Fab XENP20425, scFv XENP20434)

SEQ ID NO: 37914 - protein, 5 aa, Artificial Sequence
  Description of Artificial Sequence: Synthetic peptide
  [CTLA-4]_H3.23_L0.124  (Fab XENP20425, scFv XENP20434) vhCDR1
SYTMH

SEQ ID NO: 37915 - protein, 17 aa, Artificial Sequence
  Description of Artificial Sequence: Synthetic peptide
  [CTLA-4]_H3.23_L0.124  (Fab XENP20425, scFv XENP20434) vhCDR2
FISYDGNYKYYADSVKG

SEQ ID NO: 37916 - protein, 9 aa, Artificial Sequence
  Description of Artificial Sequence: Synthetic peptide
  [CTLA-4]_H3.23_L0.124  (Fab XENP20425, scFv XENP20434) vhCDR3
GGHLGPFDL

SEQ ID NO: 37917 - protein, 108 aa, Artificial Sequence; identical to SEQ ID NO: 2723
  Description of Artificial Sequence: Synthetic polypeptide
  VL of [CTLA-4]_H3.23_L0.124  (Fab XENP20425, scFv XENP20434)

SEQ ID NO: 37918 - protein, 12 aa, Artificial Sequence
  Description of Artificial Sequence: Synthetic peptide
  [CTLA-4]_H3.23_L0.124  (Fab XENP20425, scFv XENP20434) vlCDR1
RASQSVGSSYLA

SEQ ID NO: 37919 - protein, 7 aa, Artificial Sequence
  Description of Artificial Sequence: Synthetic peptide
  [CTLA-4]_H3.23_L0.124  (Fab XENP20425, scFv XENP20434) vlCDR2
GASSRAT

SEQ ID NO: 37920 - protein, 9 aa, Artificial Sequence
  Description of Artificial Sequence: Synthetic peptide
  [CTLA-4]_H3.23_L0.124  (Fab XENP20425, scFv XENP20434) vlCDR3
QQYGSSPWT

SEQ ID NO: 37921 - protein, 246 aa, Artificial Sequence; identical to SEQ ID NO: 2865
  Description of Artificial Sequence: Synthetic polypeptide
  scFV of [CTLA-4]_H3.23_L0.124  (Fab XENP20425, scFv XENP20434)

SEQ ID NO: 37922 - protein, 118 aa, Artificial Sequence; identical to SEQ ID NO: 2632
  Description of Artificial Sequence: Synthetic polypeptide
  VH of [CTLA-4]_H3.23_L0.129  (Fab XENP20426, scFv XENP20435)

SEQ ID NO: 37923 - protein, 5 aa, Artificial Sequence
  Description of Artificial Sequence: Synthetic peptide
  [CTLA-4]_H3.23_L0.129  (Fab XENP20426, scFv XENP20435) vhCDR1
SYTMH

SEQ ID NO: 37924 - protein, 17 aa, Artificial Sequence
  Description of Artificial Sequence: Synthetic peptide
  [CTLA-4]_H3.23_L0.129  (Fab XENP20426, scFv XENP20435) vhCDR2
FISYDGNYKYYADSVKG

SEQ ID NO: 37925 - protein, 9 aa, Artificial Sequence
  Description of Artificial Sequence: Synthetic peptide
  [CTLA-4]_H3.23_L0.129  (Fab XENP20426, scFv XENP20435) vhCDR3
GGHLGPFDL

SEQ ID NO: 37926 - protein, 108 aa, Artificial Sequence; identical to SEQ ID NO: 2768
  Description of Artificial Sequence: Synthetic polypeptide
  VL of [CTLA-4]_H3.23_L0.129  (Fab XENP20426, scFv XENP20435)

SEQ ID NO: 37927 - protein, 12 aa, Artificial Sequence
  Description of Artificial Sequence: Synthetic peptide
  [CTLA-4]_H3.23_L0.129  (Fab XENP20426, scFv XENP20435) vlCDR1
RASQSVGSSYLA

SEQ ID NO: 37928 - protein, 7 aa, Artificial Sequence
  Description of Artificial Sequence: Synthetic peptide
  [CTLA-4]_H3.23_L0.129  (Fab XENP20426, scFv XENP20435) vlCDR2
GASSRAT

SEQ ID NO: 37929 - protein, 9 aa, Artificial Sequence
  Description of Artificial Sequence: Synthetic peptide
  [CTLA-4]_H3.23_L0.129  (Fab XENP20426, scFv XENP20435) vlCDR3
QQYGSSPWT

SEQ ID NO: 37930 - protein, 246 aa, Artificial Sequence; identical to SEQ ID NO: 2874
  Description of Artificial Sequence: Synthetic polypeptide
  scFV of [CTLA-4]_H3.23_L0.129  (Fab XENP20426, scFv XENP20435)

SEQ ID NO: 37931 - protein, 118 aa, Artificial Sequence; identical to SEQ ID NO: 2632
  Description of Artificial Sequence: Synthetic polypeptide
  VH of [CTLA-4]_H3.23_L0.132  (Fab XENP20427, scFv XENP20436)

SEQ ID NO: 37932 - protein, 5 aa, Artificial Sequence
  Description of Artificial Sequence: Synthetic peptide
  [CTLA-4]_H3.23_L0.132  (Fab XENP20427, scFv XENP20436) vhCDR1
SYTMH

SEQ ID NO: 37933 - protein, 17 aa, Artificial Sequence
  Description of Artificial Sequence: Synthetic peptide
  [CTLA-4]_H3.23_L0.132  (Fab XENP20427, scFv XENP20436) vhCDR2
FISYDGNYKYYADSVKG

SEQ ID NO: 37934 - protein, 9 aa, Artificial Sequence
  Description of Artificial Sequence: Synthetic peptide
  [CTLA-4]_H3.23_L0.132  (Fab XENP20427, scFv XENP20436) vhCDR3
GGHLGPFDL

SEQ ID NO: 37935 - protein, 108 aa, Artificial Sequence; identical to SEQ ID NO: 2795
  Description of Artificial Sequence: Synthetic polypeptide
  VL of [CTLA-4]_H3.23_L0.132  (Fab XENP20427, scFv XENP20436)

SEQ ID NO: 37936 - protein, 12 aa, Artificial Sequence
  Description of Artificial Sequence: Synthetic peptide
  [CTLA-4]_H3.23_L0.132  (Fab XENP20427, scFv XENP20436) vlCDR1
RASQSVSSSYLA

SEQ ID NO: 37937 - protein, 7 aa, Artificial Sequence
  Description of Artificial Sequence: Synthetic peptide
  [CTLA-4]_H3.23_L0.132  (Fab XENP20427, scFv XENP20436) vlCDR2
GASSRAT

SEQ ID NO: 37938 - protein, 9 aa, Artificial Sequence
  Description of Artificial Sequence: Synthetic peptide
  [CTLA-4]_H3.23_L0.132  (Fab XENP20427, scFv XENP20436) vlCDR3
QQYGSSPWT

SEQ ID NO: 37939 - protein, 246 aa, Artificial Sequence; identical to SEQ ID NO: 2883
  Description of Artificial Sequence: Synthetic polypeptide
  scFV of [CTLA-4]_H3.23_L0.132  (Fab XENP20427, scFv XENP20436)

SEQ ID NO: 37940 - protein, 118 aa, Artificial Sequence; identical to SEQ ID NO: 2650
  Description of Artificial Sequence: Synthetic polypeptide
  VH of [CTLA-4]_H3.25_L0.124  (Fab XENP20428, scFv XENP20437)

SEQ ID NO: 37941 - protein, 5 aa, Artificial Sequence
  Description of Artificial Sequence: Synthetic peptide
  [CTLA-4]_H3.25_L0.124  (Fab XENP20428, scFv XENP20437) vhCDR1
SYTMH

SEQ ID NO: 37942 - protein, 17 aa, Artificial Sequence
  Description of Artificial Sequence: Synthetic peptide
  [CTLA-4]_H3.25_L0.124  (Fab XENP20428, scFv XENP20437) vhCDR2
FISYDGNYKYYADSVKG

SEQ ID NO: 37943 - protein, 9 aa, Artificial Sequence
  Description of Artificial Sequence: Synthetic peptide
  [CTLA-4]_H3.25_L0.124  (Fab XENP20428, scFv XENP20437) vhCDR3
GGLLGPFDL

SEQ ID NO: 37944 - protein, 108 aa, Artificial Sequence; identical to SEQ ID NO: 2723
  Description of Artificial Sequence: Synthetic polypeptide
  VL of [CTLA-4]_H3.25_L0.124  (Fab XENP20428, scFv XENP20437)

SEQ ID NO: 37945 - protein, 12 aa, Artificial Sequence
  Description of Artificial Sequence: Synthetic peptide
  [CTLA-4]_H3.25_L0.124  (Fab XENP20428, scFv XENP20437) vlCDR1
RASQSVGSSYLA

SEQ ID NO: 37946 - protein, 7 aa, Artificial Sequence
  Description of Artificial Sequence: Synthetic peptide
  [CTLA-4]_H3.25_L0.124  (Fab XENP20428, scFv XENP20437) vlCDR2
GASSRAT

SEQ ID NO: 37947 - protein, 9 aa, Artificial Sequence
  Description of Artificial Sequence: Synthetic peptide
  [CTLA-4]_H3.25_L0.124  (Fab XENP20428, scFv XENP20437) vlCDR3
QQYGSSPWT

SEQ ID NO: 37948 - protein, 246 aa, Artificial Sequence; identical to SEQ ID NO: 2892
  Description of Artificial Sequence: Synthetic polypeptide
  scFV of [CTLA-4]_H3.25_L0.124  (Fab XENP20428, scFv XENP20437)

SEQ ID NO: 37949 - protein, 118 aa, Artificial Sequence; identical to SEQ ID NO: 2650
  Description of Artificial Sequence: Synthetic polypeptide
  VH of [CTLA-4]_H3.25_L0.129  (Fab XENP20429, scFv XENP20438)

SEQ ID NO: 37950 - protein, 5 aa, Artificial Sequence
  Description of Artificial Sequence: Synthetic peptide
  [CTLA-4]_H3.25_L0.129  (Fab XENP20429, scFv XENP20438) vhCDR1
SYTMH

SEQ ID NO: 37951 - protein, 17 aa, Artificial Sequence
  Description of Artificial Sequence: Synthetic peptide
  [CTLA-4]_H3.25_L0.129  (Fab XENP20429, scFv XENP20438) vhCDR2
FISYDGNYKYYADSVKG

SEQ ID NO: 37952 - protein, 9 aa, Artificial Sequence
  Description of Artificial Sequence: Synthetic peptide
  [CTLA-4]_H3.25_L0.129  (Fab XENP20429, scFv XENP20438) vhCDR3
GGLLGPFDL

SEQ ID NO: 37953 - protein, 108 aa, Artificial Sequence; identical to SEQ ID NO: 2768
  Description of Artificial Sequence: Synthetic polypeptide
  VL of [CTLA-4]_H3.25_L0.129  (Fab XENP20429, scFv XENP20438)

SEQ ID NO: 37954 - protein, 12 aa, Artificial Sequence
  Description of Artificial Sequence: Synthetic peptide
  [CTLA-4]_H3.25_L0.129  (Fab XENP20429, scFv XENP20438) vlCDR1
RASQSVGSSYLA

SEQ ID NO: 37955 - protein, 7 aa, Artificial Sequence
  Description of Artificial Sequence: Synthetic peptide
  [CTLA-4]_H3.25_L0.129  (Fab XENP20429, scFv XENP20438) vlCDR2
GASSRAT

SEQ ID NO: 37956 - protein, 9 aa, Artificial Sequence
  Description of Artificial Sequence: Synthetic peptide
  [CTLA-4]_H3.25_L0.129  (Fab XENP20429, scFv XENP20438) vlCDR3
QQYGSSPWT

SEQ ID NO: 37957 - protein, 246 aa, Artificial Sequence; identical to SEQ ID NO: 2901
  Description of Artificial Sequence: Synthetic polypeptide
  scFV of [CTLA-4]_H3.25_L0.129  (Fab XENP20429, scFv XENP20438)

SEQ ID NO: 37958 - protein, 118 aa, Artificial Sequence; identical to SEQ ID NO: 2650
  Description of Artificial Sequence: Synthetic polypeptide
  VH of [CTLA-4]_H3.25_L0.132  (Fab XENP20430, scFv XENP20439)

SEQ ID NO: 37959 - protein, 5 aa, Artificial Sequence
  Description of Artificial Sequence: Synthetic peptide
  [CTLA-4]_H3.25_L0.132  (Fab XENP20430, scFv XENP20439) vhCDR1
SYTMH

SEQ ID NO: 37960 - protein, 17 aa, Artificial Sequence
  Description of Artificial Sequence: Synthetic peptide
  [CTLA-4]_H3.25_L0.132  (Fab XENP20430, scFv XENP20439) vhCDR2
FISYDGNYKYYADSVKG

SEQ ID NO: 37961 - protein, 9 aa, Artificial Sequence
  Description of Artificial Sequence: Synthetic peptide
  [CTLA-4]_H3.25_L0.132  (Fab XENP20430, scFv XENP20439) vhCDR3
GGLLGPFDL

SEQ ID NO: 37962 - protein, 108 aa, Artificial Sequence; identical to SEQ ID NO: 2795
  Description of Artificial Sequence: Synthetic polypeptide
  VL of [CTLA-4]_H3.25_L0.132  (Fab XENP20430, scFv XENP20439)

SEQ ID NO: 37963 - protein, 12 aa, Artificial Sequence
  Description of Artificial Sequence: Synthetic peptide
  [CTLA-4]_H3.25_L0.132  (Fab XENP20430, scFv XENP20439) vlCDR1
RASQSVSSSYLA

SEQ ID NO: 37964 - protein, 7 aa, Artificial Sequence
  Description of Artificial Sequence: Synthetic peptide
  [CTLA-4]_H3.25_L0.132  (Fab XENP20430, scFv XENP20439) vlCDR2
GASSRAT

SEQ ID NO: 37965 - protein, 9 aa, Artificial Sequence
  Description of Artificial Sequence: Synthetic peptide
  [CTLA-4]_H3.25_L0.132  (Fab XENP20430, scFv XENP20439) vlCDR3
QQYGSSPWT

SEQ ID NO: 37966 - protein, 246 aa, Artificial Sequence; identical to SEQ ID NO: 2910
  Description of Artificial Sequence: Synthetic polypeptide
  scFV of [CTLA-4]_H3.25_L0.132  (Fab XENP20430, scFv XENP20439)

SEQ ID NO: 37967 - protein, 118 aa, Artificial Sequence; identical to SEQ ID NO: 2461
  Description of Artificial Sequence: Synthetic polypeptide
  VH of [CTLA-4]_H3.4_L0.118  (Fab XENP20341, scFv XENP20378)

SEQ ID NO: 37968 - protein, 5 aa, Artificial Sequence
  Description of Artificial Sequence: Synthetic peptide
  [CTLA-4]_H3.4_L0.118  (Fab XENP20341, scFv XENP20378) vhCDR1
SYTMH

SEQ ID NO: 37969 - protein, 17 aa, Artificial Sequence
  Description of Artificial Sequence: Synthetic peptide
  [CTLA-4]_H3.4_L0.118  (Fab XENP20341, scFv XENP20378) vhCDR2
FISYDGNHKYYADSVKG

SEQ ID NO: 37970 - protein, 9 aa, Artificial Sequence
  Description of Artificial Sequence: Synthetic peptide
  [CTLA-4]_H3.4_L0.118  (Fab XENP20341, scFv XENP20378) vhCDR3
TGHLGPFDL

SEQ ID NO: 37971 - protein, 108 aa, Artificial Sequence; identical to SEQ ID NO: 2669
  Description of Artificial Sequence: Synthetic polypeptide
  VL of [CTLA-4]_H3.4_L0.118  (Fab XENP20341, scFv XENP20378)

SEQ ID NO: 37972 - protein, 12 aa, Artificial Sequence
  Description of Artificial Sequence: Synthetic peptide
  [CTLA-4]_H3.4_L0.118  (Fab XENP20341, scFv XENP20378) vlCDR1
RASQSVGSSYLA

SEQ ID NO: 37973 - protein, 7 aa, Artificial Sequence
  Description of Artificial Sequence: Synthetic peptide
  [CTLA-4]_H3.4_L0.118  (Fab XENP20341, scFv XENP20378) vlCDR2
GAFSRAT

SEQ ID NO: 37974 - protein, 9 aa, Artificial Sequence
  Description of Artificial Sequence: Synthetic peptide
  [CTLA-4]_H3.4_L0.118  (Fab XENP20341, scFv XENP20378) vlCDR3
QQYGSSPWT

SEQ ID NO: 37975 - protein, 246 aa, Artificial Sequence; identical to SEQ ID NO: 2667
  Description of Artificial Sequence: Synthetic polypeptide
  scFV of [CTLA-4]_H3.4_L0.118  (Fab XENP20341, scFv XENP20378)

SEQ ID NO: 37976 - protein, 118 aa, Artificial Sequence; identical to SEQ ID NO: 2461
  Description of Artificial Sequence: Synthetic polypeptide
  VH of [CTLA-4]_H3.4_L0.119  (Fab XENP20342, scFv XENP20379)

SEQ ID NO: 37977 - protein, 5 aa, Artificial Sequence
  Description of Artificial Sequence: Synthetic peptide
  [CTLA-4]_H3.4_L0.119  (Fab XENP20342, scFv XENP20379) vhCDR1
SYTMH

SEQ ID NO: 37978 - protein, 17 aa, Artificial Sequence
  Description of Artificial Sequence: Synthetic peptide
  [CTLA-4]_H3.4_L0.119  (Fab XENP20342, scFv XENP20379) vhCDR2
FISYDGNHKYYADSVKG

SEQ ID NO: 37979 - protein, 9 aa, Artificial Sequence
  Description of Artificial Sequence: Synthetic peptide
  [CTLA-4]_H3.4_L0.119  (Fab XENP20342, scFv XENP20379) vhCDR3
TGHLGPFDL

SEQ ID NO: 37980 - protein, 108 aa, Artificial Sequence; identical to SEQ ID NO: 23
  Description of Artificial Sequence: Synthetic polypeptide
  VL of [CTLA-4]_H3.4_L0.119  (Fab XENP20342, scFv XENP20379)

SEQ ID NO: 37981 - protein, 12 aa, Artificial Sequence
  Description of Artificial Sequence: Synthetic peptide
  [CTLA-4]_H3.4_L0.119  (Fab XENP20342, scFv XENP20379) vlCDR1
RASQSVGSSYLA

SEQ ID NO: 37982 - protein, 7 aa, Artificial Sequence
  Description of Artificial Sequence: Synthetic peptide
  [CTLA-4]_H3.4_L0.119  (Fab XENP20342, scFv XENP20379) vlCDR2
GAFSRAT

SEQ ID NO: 37983 - protein, 9 aa, Artificial Sequence
  Description of Artificial Sequence: Synthetic peptide
  [CTLA-4]_H3.4_L0.119  (Fab XENP20342, scFv XENP20379) vlCDR3
QQYGSSPWT

SEQ ID NO: 37984 - protein, 246 aa, Artificial Sequence; identical to SEQ ID NO: 2676
  Description of Artificial Sequence: Synthetic polypeptide
  scFV of [CTLA-4]_H3.4_L0.119  (Fab XENP20342, scFv XENP20379)

SEQ ID NO: 37985 - protein, 118 aa, Artificial Sequence; identical to SEQ ID NO: 2461
  Description of Artificial Sequence: Synthetic polypeptide
  VH of [CTLA-4]_H3.4_L0.12  (Fab XENP20071, scFv XENP20078)

SEQ ID NO: 37986 - protein, 5 aa, Artificial Sequence
  Description of Artificial Sequence: Synthetic peptide
  [CTLA-4]_H3.4_L0.12  (Fab XENP20071, scFv XENP20078) vhCDR1
SYTMH

SEQ ID NO: 37987 - protein, 17 aa, Artificial Sequence
  Description of Artificial Sequence: Synthetic peptide
  [CTLA-4]_H3.4_L0.12  (Fab XENP20071, scFv XENP20078) vhCDR2
FISYDGNHKYYADSVKG

SEQ ID NO: 37988 - protein, 9 aa, Artificial Sequence
  Description of Artificial Sequence: Synthetic peptide
  [CTLA-4]_H3.4_L0.12  (Fab XENP20071, scFv XENP20078) vhCDR3
TGHLGPFDL

SEQ ID NO: 37989 - protein, 108 aa, Artificial Sequence; identical to SEQ ID NO: 1517
  Description of Artificial Sequence: Synthetic polypeptide
  VL of [CTLA-4]_H3.4_L0.12  (Fab XENP20071, scFv XENP20078)

SEQ ID NO: 37990 - protein, 12 aa, Artificial Sequence
  Description of Artificial Sequence: Synthetic peptide
  [CTLA-4]_H3.4_L0.12  (Fab XENP20071, scFv XENP20078) vlCDR1
RASQSVGSSYLA

SEQ ID NO: 37991 - protein, 7 aa, Artificial Sequence
  Description of Artificial Sequence: Synthetic peptide
  [CTLA-4]_H3.4_L0.12  (Fab XENP20071, scFv XENP20078) vlCDR2
GAFSRAT

SEQ ID NO: 37992 - protein, 9 aa, Artificial Sequence
  Description of Artificial Sequence: Synthetic peptide
  [CTLA-4]_H3.4_L0.12  (Fab XENP20071, scFv XENP20078) vlCDR3
QQYGSSPWT

SEQ ID NO: 37993 - protein, 246 aa, Artificial Sequence; identical to SEQ ID NO: 2460
  Description of Artificial Sequence: Synthetic polypeptide
  scFV of [CTLA-4]_H3.4_L0.12  (Fab XENP20071, scFv XENP20078)

SEQ ID NO: 37994 - protein, 118 aa, Artificial Sequence; identical to SEQ ID NO: 2461
  Description of Artificial Sequence: Synthetic polypeptide
  VH of [CTLA-4]_H3.4_L0.121  (Fab XENP20344, scFv XENP20381)

SEQ ID NO: 37995 - protein, 5 aa, Artificial Sequence
  Description of Artificial Sequence: Synthetic peptide
  [CTLA-4]_H3.4_L0.121  (Fab XENP20344, scFv XENP20381) vhCDR1
SYTMH

SEQ ID NO: 37996 - protein, 17 aa, Artificial Sequence
  Description of Artificial Sequence: Synthetic peptide
  [CTLA-4]_H3.4_L0.121  (Fab XENP20344, scFv XENP20381) vhCDR2
FISYDGNHKYYADSVKG

SEQ ID NO: 37997 - protein, 9 aa, Artificial Sequence
  Description of Artificial Sequence: Synthetic peptide
  [CTLA-4]_H3.4_L0.121  (Fab XENP20344, scFv XENP20381) vhCDR3
TGHLGPFDL

SEQ ID NO: 37998 - protein, 108 aa, Artificial Sequence; identical to SEQ ID NO: 2696
  Description of Artificial Sequence: Synthetic polypeptide
  VL of [CTLA-4]_H3.4_L0.121  (Fab XENP20344, scFv XENP20381)

SEQ ID NO: 37999 - protein, 12 aa, Artificial Sequence
  Description of Artificial Sequence: Synthetic peptide
  [CTLA-4]_H3.4_L0.121  (Fab XENP20344, scFv XENP20381) vlCDR1
RASQSVGSSYLA

SEQ ID NO: 38000 - protein, 7 aa, Artificial Sequence
  Description of Artificial Sequence: Synthetic peptide
  [CTLA-4]_H3.4_L0.121  (Fab XENP20344, scFv XENP20381) vlCDR2
GASSRAT

SEQ ID NO: 38001 - protein, 9 aa, Artificial Sequence
  Description of Artificial Sequence: Synthetic peptide
  [CTLA-4]_H3.4_L0.121  (Fab XENP20344, scFv XENP20381) vlCDR3
QQYGSSPWT

SEQ ID NO: 38002 - protein, 246 aa, Artificial Sequence; identical to SEQ ID NO: 2694
  Description of Artificial Sequence: Synthetic polypeptide
  scFV of [CTLA-4]_H3.4_L0.121  (Fab XENP20344, scFv XENP20381)

SEQ ID NO: 38003 - protein, 118 aa, Artificial Sequence; identical to SEQ ID NO: 2461
  Description of Artificial Sequence: Synthetic polypeptide
  VH of [CTLA-4]_H3.4_L0.122  (Fab XENP20345, scFv XENP20382)

SEQ ID NO: 38004 - protein, 5 aa, Artificial Sequence
  Description of Artificial Sequence: Synthetic peptide
  [CTLA-4]_H3.4_L0.122  (Fab XENP20345, scFv XENP20382) vhCDR1
SYTMH

SEQ ID NO: 38005 - protein, 17 aa, Artificial Sequence
  Description of Artificial Sequence: Synthetic peptide
  [CTLA-4]_H3.4_L0.122  (Fab XENP20345, scFv XENP20382) vhCDR2
FISYDGNHKYYADSVKG

SEQ ID NO: 38006 - protein, 9 aa, Artificial Sequence
  Description of Artificial Sequence: Synthetic peptide
  [CTLA-4]_H3.4_L0.122  (Fab XENP20345, scFv XENP20382) vhCDR3
TGHLGPFDL

SEQ ID NO: 38007 - protein, 108 aa, Artificial Sequence; identical to SEQ ID NO: 1481
  Description of Artificial Sequence: Synthetic polypeptide
  VL of [CTLA-4]_H3.4_L0.122  (Fab XENP20345, scFv XENP20382)

SEQ ID NO: 38008 - protein, 12 aa, Artificial Sequence
  Description of Artificial Sequence: Synthetic peptide
  [CTLA-4]_H3.4_L0.122  (Fab XENP20345, scFv XENP20382) vlCDR1
RASQSVGSSYLA

SEQ ID NO: 38009 - protein, 7 aa, Artificial Sequence
  Description of Artificial Sequence: Synthetic peptide
  [CTLA-4]_H3.4_L0.122  (Fab XENP20345, scFv XENP20382) vlCDR2
GAFSRAT

SEQ ID NO: 38010 - protein, 9 aa, Artificial Sequence
  Description of Artificial Sequence: Synthetic peptide
  [CTLA-4]_H3.4_L0.122  (Fab XENP20345, scFv XENP20382) vlCDR3
QQYGSSPWT

SEQ ID NO: 38011 - protein, 246 aa, Artificial Sequence; identical to SEQ ID NO: 2703
  Description of Artificial Sequence: Synthetic polypeptide
  scFV of [CTLA-4]_H3.4_L0.122  (Fab XENP20345, scFv XENP20382)

SEQ ID NO: 38012 - protein, 118 aa, Artificial Sequence; identical to SEQ ID NO: 2461
  Description of Artificial Sequence: Synthetic polypeptide
  VH of [CTLA-4]_H3.4_L0.123  (Fab XENP20346, scFv XENP20383)

SEQ ID NO: 38013 - protein, 5 aa, Artificial Sequence
  Description of Artificial Sequence: Synthetic peptide
  [CTLA-4]_H3.4_L0.123  (Fab XENP20346, scFv XENP20383) vhCDR1
SYTMH

SEQ ID NO: 38014 - protein, 17 aa, Artificial Sequence
  Description of Artificial Sequence: Synthetic peptide
  [CTLA-4]_H3.4_L0.123  (Fab XENP20346, scFv XENP20383) vhCDR2
FISYDGNHKYYADSVKG

SEQ ID NO: 38015 - protein, 9 aa, Artificial Sequence
  Description of Artificial Sequence: Synthetic peptide
  [CTLA-4]_H3.4_L0.123  (Fab XENP20346, scFv XENP20383) vhCDR3
TGHLGPFDL

SEQ ID NO: 38016 - protein, 108 aa, Artificial Sequence; identical to SEQ ID NO: 2714
  Description of Artificial Sequence: Synthetic polypeptide
  VL of [CTLA-4]_H3.4_L0.123  (Fab XENP20346, scFv XENP20383)

SEQ ID NO: 38017 - protein, 12 aa, Artificial Sequence
  Description of Artificial Sequence: Synthetic peptide
  [CTLA-4]_H3.4_L0.123  (Fab XENP20346, scFv XENP20383) vlCDR1
RASQSVSSSYLA

SEQ ID NO: 38018 - protein, 7 aa, Artificial Sequence
  Description of Artificial Sequence: Synthetic peptide
  [CTLA-4]_H3.4_L0.123  (Fab XENP20346, scFv XENP20383) vlCDR2
GAFSRAT

SEQ ID NO: 38019 - protein, 9 aa, Artificial Sequence
  Description of Artificial Sequence: Synthetic peptide
  [CTLA-4]_H3.4_L0.123  (Fab XENP20346, scFv XENP20383) vlCDR3
QQYGSSPWT

SEQ ID NO: 38020 - protein, 246 aa, Artificial Sequence; identical to SEQ ID NO: 2712
  Description of Artificial Sequence: Synthetic polypeptide
  scFV of [CTLA-4]_H3.4_L0.123  (Fab XENP20346, scFv XENP20383)

SEQ ID NO: 38021 - protein, 118 aa, Artificial Sequence; identical to SEQ ID NO: 2461
  Description of Artificial Sequence: Synthetic polypeptide
  VH of [CTLA-4]_H3.4_L0.124  (Fab XENP20347, scFv XENP20384)

SEQ ID NO: 38022 - protein, 5 aa, Artificial Sequence
  Description of Artificial Sequence: Synthetic peptide
  [CTLA-4]_H3.4_L0.124  (Fab XENP20347, scFv XENP20384) vhCDR1
SYTMH

SEQ ID NO: 38023 - protein, 17 aa, Artificial Sequence
  Description of Artificial Sequence: Synthetic peptide
  [CTLA-4]_H3.4_L0.124  (Fab XENP20347, scFv XENP20384) vhCDR2
FISYDGNHKYYADSVKG

SEQ ID NO: 38024 - protein, 9 aa, Artificial Sequence
  Description of Artificial Sequence: Synthetic peptide
  [CTLA-4]_H3.4_L0.124  (Fab XENP20347, scFv XENP20384) vhCDR3
TGHLGPFDL

SEQ ID NO: 38025 - protein, 108 aa, Artificial Sequence; identical to SEQ ID NO: 2723
  Description of Artificial Sequence: Synthetic polypeptide
  VL of [CTLA-4]_H3.4_L0.124  (Fab XENP20347, scFv XENP20384)

SEQ ID NO: 38026 - protein, 12 aa, Artificial Sequence
  Description of Artificial Sequence: Synthetic peptide
  [CTLA-4]_H3.4_L0.124  (Fab XENP20347, scFv XENP20384) vlCDR1
RASQSVGSSYLA

SEQ ID NO: 38027 - protein, 7 aa, Artificial Sequence
  Description of Artificial Sequence: Synthetic peptide
  [CTLA-4]_H3.4_L0.124  (Fab XENP20347, scFv XENP20384) vlCDR2
GASSRAT

SEQ ID NO: 38028 - protein, 9 aa, Artificial Sequence
  Description of Artificial Sequence: Synthetic peptide
  [CTLA-4]_H3.4_L0.124  (Fab XENP20347, scFv XENP20384) vlCDR3
QQYGSSPWT

SEQ ID NO: 38029 - protein, 246 aa, Artificial Sequence; identical to SEQ ID NO: 2721
  Description of Artificial Sequence: Synthetic polypeptide
  scFV of [CTLA-4]_H3.4_L0.124  (Fab XENP20347, scFv XENP20384)

SEQ ID NO: 38030 - protein, 118 aa, Artificial Sequence; identical to SEQ ID NO: 2461
  Description of Artificial Sequence: Synthetic polypeptide
  VH of [CTLA-4]_H3.4_L0.125  (Fab XENP20348, scFv XENP20385)

SEQ ID NO: 38031 - protein, 5 aa, Artificial Sequence
  Description of Artificial Sequence: Synthetic peptide
  [CTLA-4]_H3.4_L0.125  (Fab XENP20348, scFv XENP20385) vhCDR1
SYTMH

SEQ ID NO: 38032 - protein, 17 aa, Artificial Sequence
  Description of Artificial Sequence: Synthetic peptide
  [CTLA-4]_H3.4_L0.125  (Fab XENP20348, scFv XENP20385) vhCDR2
FISYDGNHKYYADSVKG

SEQ ID NO: 38033 - protein, 9 aa, Artificial Sequence
  Description of Artificial Sequence: Synthetic peptide
  [CTLA-4]_H3.4_L0.125  (Fab XENP20348, scFv XENP20385) vhCDR3
TGHLGPFDL

SEQ ID NO: 38034 - protein, 108 aa, Artificial Sequence; identical to SEQ ID NO: 1607
  Description of Artificial Sequence: Synthetic polypeptide
  VL of [CTLA-4]_H3.4_L0.125  (Fab XENP20348, scFv XENP20385)

SEQ ID NO: 38035 - protein, 12 aa, Artificial Sequence
  Description of Artificial Sequence: Synthetic peptide
  [CTLA-4]_H3.4_L0.125  (Fab XENP20348, scFv XENP20385) vlCDR1
RASQSVSSSYLA

SEQ ID NO: 38036 - protein, 7 aa, Artificial Sequence
  Description of Artificial Sequence: Synthetic peptide
  [CTLA-4]_H3.4_L0.125  (Fab XENP20348, scFv XENP20385) vlCDR2
GAFSRAT

SEQ ID NO: 38037 - protein, 9 aa, Artificial Sequence
  Description of Artificial Sequence: Synthetic peptide
  [CTLA-4]_H3.4_L0.125  (Fab XENP20348, scFv XENP20385) vlCDR3
QQYGSSPWT

SEQ ID NO: 38038 - protein, 246 aa, Artificial Sequence; identical to SEQ ID NO: 2730
  Description of Artificial Sequence: Synthetic polypeptide
  scFV of [CTLA-4]_H3.4_L0.125  (Fab XENP20348, scFv XENP20385)

SEQ ID NO: 38039 - protein, 118 aa, Artificial Sequence; identical to SEQ ID NO: 2461
  Description of Artificial Sequence: Synthetic polypeptide
  VH of [CTLA-4]_H3.4_L0.126  (Fab XENP20349, scFv XENP20386)

SEQ ID NO: 38040 - protein, 5 aa, Artificial Sequence
  Description of Artificial Sequence: Synthetic peptide
  [CTLA-4]_H3.4_L0.126  (Fab XENP20349, scFv XENP20386) vhCDR1
SYTMH

SEQ ID NO: 38041 - protein, 17 aa, Artificial Sequence
  Description of Artificial Sequence: Synthetic peptide
  [CTLA-4]_H3.4_L0.126  (Fab XENP20349, scFv XENP20386) vhCDR2
FISYDGNHKYYADSVKG

SEQ ID NO: 38042 - protein, 9 aa, Artificial Sequence
  Description of Artificial Sequence: Synthetic peptide
  [CTLA-4]_H3.4_L0.126  (Fab XENP20349, scFv XENP20386) vhCDR3
TGHLGPFDL

SEQ ID NO: 38043 - protein, 108 aa, Artificial Sequence; identical to SEQ ID NO: 2066
  Description of Artificial Sequence: Synthetic polypeptide
  VL of [CTLA-4]_H3.4_L0.126  (Fab XENP20349, scFv XENP20386)

SEQ ID NO: 38044 - protein, 12 aa, Artificial Sequence
  Description of Artificial Sequence: Synthetic peptide
  [CTLA-4]_H3.4_L0.126  (Fab XENP20349, scFv XENP20386) vlCDR1
RASQSVGSSYLA

SEQ ID NO: 38045 - protein, 7 aa, Artificial Sequence
  Description of Artificial Sequence: Synthetic peptide
  [CTLA-4]_H3.4_L0.126  (Fab XENP20349, scFv XENP20386) vlCDR2
GASSRAT

SEQ ID NO: 38046 - protein, 9 aa, Artificial Sequence
  Description of Artificial Sequence: Synthetic peptide
  [CTLA-4]_H3.4_L0.126  (Fab XENP20349, scFv XENP20386) vlCDR3
QQYGSSPWT

SEQ ID NO: 38047 - protein, 246 aa, Artificial Sequence; identical to SEQ ID NO: 2739
  Description of Artificial Sequence: Synthetic polypeptide
  scFV of [CTLA-4]_H3.4_L0.126  (Fab XENP20349, scFv XENP20386)

SEQ ID NO: 38048 - protein, 118 aa, Artificial Sequence; identical to SEQ ID NO: 2461
  Description of Artificial Sequence: Synthetic polypeptide
  VH of [CTLA-4]_H3.4_L0.127  (Fab XENP20350, scFv XENP20387)

SEQ ID NO: 38049 - protein, 5 aa, Artificial Sequence
  Description of Artificial Sequence: Synthetic peptide
  [CTLA-4]_H3.4_L0.127  (Fab XENP20350, scFv XENP20387) vhCDR1
SYTMH

SEQ ID NO: 38050 - protein, 17 aa, Artificial Sequence
  Description of Artificial Sequence: Synthetic peptide
  [CTLA-4]_H3.4_L0.127  (Fab XENP20350, scFv XENP20387) vhCDR2
FISYDGNHKYYADSVKG

SEQ ID NO: 38051 - protein, 9 aa, Artificial Sequence
  Description of Artificial Sequence: Synthetic peptide
  [CTLA-4]_H3.4_L0.127  (Fab XENP20350, scFv XENP20387) vhCDR3
TGHLGPFDL

SEQ ID NO: 38052 - protein, 108 aa, Artificial Sequence; identical to SEQ ID NO: 2750
  Description of Artificial Sequence: Synthetic polypeptide
  VL of [CTLA-4]_H3.4_L0.127  (Fab XENP20350, scFv XENP20387)

SEQ ID NO: 38053 - protein, 12 aa, Artificial Sequence
  Description of Artificial Sequence: Synthetic peptide
  [CTLA-4]_H3.4_L0.127  (Fab XENP20350, scFv XENP20387) vlCDR1
RASQSVSSSYLA

SEQ ID NO: 38054 - protein, 7 aa, Artificial Sequence
  Description of Artificial Sequence: Synthetic peptide
  [CTLA-4]_H3.4_L0.127  (Fab XENP20350, scFv XENP20387) vlCDR2
GASSRAT

SEQ ID NO: 38055 - protein, 9 aa, Artificial Sequence
  Description of Artificial Sequence: Synthetic peptide
  [CTLA-4]_H3.4_L0.127  (Fab XENP20350, scFv XENP20387) vlCDR3
QQYGSSPWT

SEQ ID NO: 38056 - protein, 246 aa, Artificial Sequence; identical to SEQ ID NO: 2748
  Description of Artificial Sequence: Synthetic polypeptide
  scFV of [CTLA-4]_H3.4_L0.127  (Fab XENP20350, scFv XENP20387)

SEQ ID NO: 38057 - protein, 118 aa, Artificial Sequence; identical to SEQ ID NO: 2461
  Description of Artificial Sequence: Synthetic polypeptide
  VH of [CTLA-4]_H3.4_L0.128  (Fab XENP20351, scFv XENP20388)

SEQ ID NO: 38058 - protein, 5 aa, Artificial Sequence
  Description of Artificial Sequence: Synthetic peptide
  [CTLA-4]_H3.4_L0.128  (Fab XENP20351, scFv XENP20388) vhCDR1
SYTMH

SEQ ID NO: 38059 - protein, 17 aa, Artificial Sequence
  Description of Artificial Sequence: Synthetic peptide
  [CTLA-4]_H3.4_L0.128  (Fab XENP20351, scFv XENP20388) vhCDR2
FISYDGNHKYYADSVKG

SEQ ID NO: 38060 - protein, 9 aa, Artificial Sequence
  Description of Artificial Sequence: Synthetic peptide
  [CTLA-4]_H3.4_L0.128  (Fab XENP20351, scFv XENP20388) vhCDR3
TGHLGPFDL

SEQ ID NO: 38061 - protein, 108 aa, Artificial Sequence; identical to SEQ ID NO: 2759
  Description of Artificial Sequence: Synthetic polypeptide
  VL of [CTLA-4]_H3.4_L0.128  (Fab XENP20351, scFv XENP20388)

SEQ ID NO: 38062 - protein, 12 aa, Artificial Sequence
  Description of Artificial Sequence: Synthetic peptide
  [CTLA-4]_H3.4_L0.128  (Fab XENP20351, scFv XENP20388) vlCDR1
RASQSVSSSYLA

SEQ ID NO: 38063 - protein, 7 aa, Artificial Sequence
  Description of Artificial Sequence: Synthetic peptide
  [CTLA-4]_H3.4_L0.128  (Fab XENP20351, scFv XENP20388) vlCDR2
GAFSRAT

SEQ ID NO: 38064 - protein, 9 aa, Artificial Sequence
  Description of Artificial Sequence: Synthetic peptide
  [CTLA-4]_H3.4_L0.128  (Fab XENP20351, scFv XENP20388) vlCDR3
QQYGSSPWT

SEQ ID NO: 38065 - protein, 246 aa, Artificial Sequence; identical to SEQ ID NO: 2757
  Description of Artificial Sequence: Synthetic polypeptide
  scFV of [CTLA-4]_H3.4_L0.128  (Fab XENP20351, scFv XENP20388)

SEQ ID NO: 38066 - protein, 118 aa, Artificial Sequence; identical to SEQ ID NO: 2461
  Description of Artificial Sequence: Synthetic polypeptide
  VL of [CTLA-4]_H3.4_l0.129  (Fab XENP20352, scFv XENP20389)

SEQ ID NO: 38067 - protein, 5 aa, Artificial Sequence
  Description of Artificial Sequence: Synthetic peptide
  [CTLA-4]_H3.4_l0.129  (Fab XENP20352, scFv XENP20389) vlCDR1
SYTMH

SEQ ID NO: 38068 - protein, 17 aa, Artificial Sequence
  Description of Artificial Sequence: Synthetic peptide
  [CTLA-4]_H3.4_l0.129  (Fab XENP20352, scFv XENP20389) vlCDR2
FISYDGNHKYYADSVKG

SEQ ID NO: 38069 - protein, 9 aa, Artificial Sequence
  Description of Artificial Sequence: Synthetic peptide
  [CTLA-4]_H3.4_l0.129  (Fab XENP20352, scFv XENP20389) vlCDR3
TGHLGPFDL

SEQ ID NO: 38070 - protein, 246 aa, Artificial Sequence; identical to SEQ ID NO: 2766
  Description of Artificial Sequence: Synthetic polypeptide
  scFV of [CTLA-4]_H3.4_l0.129  (Fab XENP20352, scFv XENP20389)

SEQ ID NO: 38071 - protein, 118 aa, Artificial Sequence; identical to SEQ ID NO: 2461
  Description of Artificial Sequence: Synthetic polypeptide
  VH of [CTLA-4]_H3.4_L0.130 (Fab XENP20353, scFv XENP20390)

SEQ ID NO: 38072 - protein, 5 aa, Artificial Sequence
  Description of Artificial Sequence: Synthetic peptide
  [CTLA-4]_H3.4_L0.130 (Fab XENP20353, scFv XENP20390) vhCDR1
SYTMH

SEQ ID NO: 38073 - protein, 17 aa, Artificial Sequence
  Description of Artificial Sequence: Synthetic peptide
  [CTLA-4]_H3.4_L0.130 (Fab XENP20353, scFv XENP20390) vhCDR2
FISYDGNHKYYADSVKG

SEQ ID NO: 38074 - protein, 9 aa, Artificial Sequence
  Description of Artificial Sequence: Synthetic peptide
  [CTLA-4]_H3.4_L0.130 (Fab XENP20353, scFv XENP20390) vhCDR3
TGHLGPFDL

SEQ ID NO: 38075 - protein, 108 aa, Artificial Sequence; identical to SEQ ID NO: 2777
  Description of Artificial Sequence: Synthetic polypeptide
  VL of [CTLA-4]_H3.4_L0.130 (Fab XENP20353, scFv XENP20390)

SEQ ID NO: 38076 - protein, 12 aa, Artificial Sequence
  Description of Artificial Sequence: Synthetic peptide
  [CTLA-4]_H3.4_L0.130 (Fab XENP20353, scFv XENP20390) vlCDR1
RASQSVSSSYLA

SEQ ID NO: 38077 - protein, 7 aa, Artificial Sequence
  Description of Artificial Sequence: Synthetic peptide
  [CTLA-4]_H3.4_L0.130 (Fab XENP20353, scFv XENP20390) vlCDR2
GASSRAT

SEQ ID NO: 38078 - protein, 9 aa, Artificial Sequence
  Description of Artificial Sequence: Synthetic peptide
  [CTLA-4]_H3.4_L0.130 (Fab XENP20353, scFv XENP20390) vlCDR3
QQYGSSPWT

SEQ ID NO: 38079 - protein, 246 aa, Artificial Sequence; identical to SEQ ID NO: 2775
  Description of Artificial Sequence: Synthetic polypeptide
  scFV of [CTLA-4]_H3.4_L0.130 (Fab XENP20353, scFv XENP20390)

SEQ ID NO: 38080 - protein, 118 aa, Artificial Sequence; identical to SEQ ID NO: 2461
  Description of Artificial Sequence: Synthetic polypeptide
  VH of [CTLA-4]_H3.4_L0.131 (Fab XENP20354, scFv XENP20391)

SEQ ID NO: 38081 - protein, 5 aa, Artificial Sequence
  Description of Artificial Sequence: Synthetic peptide
  [CTLA-4]_H3.4_L0.131 (Fab XENP20354, scFv XENP20391) vhCDR1
SYTMH

SEQ ID NO: 38082 - protein, 17 aa, Artificial Sequence
  Description of Artificial Sequence: Synthetic peptide
  [CTLA-4]_H3.4_L0.131 (Fab XENP20354, scFv XENP20391) vhCDR2
FISYDGNHKYYADSVKG

SEQ ID NO: 38083 - protein, 9 aa, Artificial Sequence
  Description of Artificial Sequence: Synthetic peptide
  [CTLA-4]_H3.4_L0.131 (Fab XENP20354, scFv XENP20391) vhCDR3
TGHLGPFDL

SEQ ID NO: 38084 - protein, 108 aa, Artificial Sequence; identical to SEQ ID NO: 2786
  Description of Artificial Sequence: Synthetic polypeptide
  VL of [CTLA-4]_H3.4_L0.131 (Fab XENP20354, scFv XENP20391)

SEQ ID NO: 38085 - protein, 12 aa, Artificial Sequence
  Description of Artificial Sequence: Synthetic peptide
  [CTLA-4]_H3.4_L0.131 (Fab XENP20354, scFv XENP20391) vlCDR1
RASQSVSSSYLA

SEQ ID NO: 38086 - protein, 7 aa, Artificial Sequence
  Description of Artificial Sequence: Synthetic peptide
  [CTLA-4]_H3.4_L0.131 (Fab XENP20354, scFv XENP20391) vlCDR2
GASSRAT

SEQ ID NO: 38087 - protein, 9 aa, Artificial Sequence
  Description of Artificial Sequence: Synthetic peptide
  [CTLA-4]_H3.4_L0.131 (Fab XENP20354, scFv XENP20391) vlCDR3
QQYGSSPWT

SEQ ID NO: 38088 - protein, 246 aa, Artificial Sequence; identical to SEQ ID NO: 2784
  Description of Artificial Sequence: Synthetic polypeptide
  scFV of [CTLA-4]_H3.4_L0.131 (Fab XENP20354, scFv XENP20391)

SEQ ID NO: 38089 - protein, 118 aa, Artificial Sequence; identical to SEQ ID NO: 2461
  Description of Artificial Sequence: Synthetic polypeptide
  VH of [CTLA-4]_H3.4_L0.132  (Fab XENP20355, scFv XENP20392)

SEQ ID NO: 38090 - protein, 5 aa, Artificial Sequence
  Description of Artificial Sequence: Synthetic peptide
  [CTLA-4]_H3.4_L0.132  (Fab XENP20355, scFv XENP20392) vhCDR1
SYTMH

SEQ ID NO: 38091 - protein, 17 aa, Artificial Sequence
  Description of Artificial Sequence: Synthetic peptide
  [CTLA-4]_H3.4_L0.132  (Fab XENP20355, scFv XENP20392) vhCDR2
FISYDGNHKYYADSVKG

SEQ ID NO: 38092 - protein, 9 aa, Artificial Sequence
  Description of Artificial Sequence: Synthetic peptide
  [CTLA-4]_H3.4_L0.132  (Fab XENP20355, scFv XENP20392) vhCDR3
TGHLGPFDL

SEQ ID NO: 38093 - protein, 108 aa, Artificial Sequence; identical to SEQ ID NO: 2795
  Description of Artificial Sequence: Synthetic polypeptide
  VL of [CTLA-4]_H3.4_L0.132  (Fab XENP20355, scFv XENP20392)

SEQ ID NO: 38094 - protein, 12 aa, Artificial Sequence
  Description of Artificial Sequence: Synthetic peptide
  [CTLA-4]_H3.4_L0.132  (Fab XENP20355, scFv XENP20392) vlCDR1
RASQSVSSSYLA

SEQ ID NO: 38095 - protein, 7 aa, Artificial Sequence
  Description of Artificial Sequence: Synthetic peptide
  [CTLA-4]_H3.4_L0.132  (Fab XENP20355, scFv XENP20392) vlCDR2
GASSRAT

SEQ ID NO: 38096 - protein, 9 aa, Artificial Sequence
  Description of Artificial Sequence: Synthetic peptide
  [CTLA-4]_H3.4_L0.132  (Fab XENP20355, scFv XENP20392) vlCDR3
QQYGSSPWT

SEQ ID NO: 38097 - protein, 246 aa, Artificial Sequence; identical to SEQ ID NO: 2793
  Description of Artificial Sequence: Synthetic polypeptide
  scFV of [CTLA-4]_H3.4_L0.132  (Fab XENP20355, scFv XENP20392)

SEQ ID NO: 38098 - protein, 118 aa, Artificial Sequence; identical to SEQ ID NO: 2470
  Description of Artificial Sequence: Synthetic polypeptide
  VH of [CTLA-4]_H3.5_L2.1  (Fab XENP20357, scFv XENP20394)

SEQ ID NO: 38099 - protein, 5 aa, Artificial Sequence
  Description of Artificial Sequence: Synthetic peptide
  [CTLA-4]_H3.5_L2.1  (Fab XENP20357, scFv XENP20394) vhCDR1
SYTMH

SEQ ID NO: 38100 - protein, 17 aa, Artificial Sequence
  Description of Artificial Sequence: Synthetic peptide
  [CTLA-4]_H3.5_L2.1  (Fab XENP20357, scFv XENP20394) vhCDR2
FISYDGNTKYYADSVKG

SEQ ID NO: 38101 - protein, 9 aa, Artificial Sequence
  Description of Artificial Sequence: Synthetic peptide
  [CTLA-4]_H3.5_L2.1  (Fab XENP20357, scFv XENP20394) vhCDR3
TGHLGPFDL

SEQ ID NO: 38102 - protein, 108 aa, Artificial Sequence; identical to SEQ ID NO: 2813
  Description of Artificial Sequence: Synthetic polypeptide
  VL of [CTLA-4]_H3.5_L2.1  (Fab XENP20357, scFv XENP20394)

SEQ ID NO: 38103 - protein, 12 aa, Artificial Sequence
  Description of Artificial Sequence: Synthetic peptide
  [CTLA-4]_H3.5_L2.1  (Fab XENP20357, scFv XENP20394) vlCDR1
RASQSVSSSYLA

SEQ ID NO: 38104 - protein, 7 aa, Artificial Sequence
  Description of Artificial Sequence: Synthetic peptide
  [CTLA-4]_H3.5_L2.1  (Fab XENP20357, scFv XENP20394) vlCDR2
GAFSRAT

SEQ ID NO: 38105 - protein, 9 aa, Artificial Sequence
  Description of Artificial Sequence: Synthetic peptide
  [CTLA-4]_H3.5_L2.1  (Fab XENP20357, scFv XENP20394) vlCDR3
QQYGSSPWT

SEQ ID NO: 38106 - protein, 246 aa, Artificial Sequence; identical to SEQ ID NO: 2811
  Description of Artificial Sequence: Synthetic polypeptide
  scFV of [CTLA-4]_H3.5_L2.1  (Fab XENP20357, scFv XENP20394)

SEQ ID NO: 38107 - protein, 118 aa, Artificial Sequence; identical to SEQ ID NO: 2470
  Description of Artificial Sequence: Synthetic polypeptide
  VH of [CTLA-4]_H3.5_L2.2  (Fab XENP20358, scFv XENP20395)

SEQ ID NO: 38108 - protein, 5 aa, Artificial Sequence
  Description of Artificial Sequence: Synthetic peptide
  [CTLA-4]_H3.5_L2.2  (Fab XENP20358, scFv XENP20395) vhCDR1
SYTMH

SEQ ID NO: 38109 - protein, 17 aa, Artificial Sequence
  Description of Artificial Sequence: Synthetic peptide
  [CTLA-4]_H3.5_L2.2  (Fab XENP20358, scFv XENP20395) vhCDR2
FISYDGNTKYYADSVKG

SEQ ID NO: 38110 - protein, 9 aa, Artificial Sequence
  Description of Artificial Sequence: Synthetic peptide
  [CTLA-4]_H3.5_L2.2  (Fab XENP20358, scFv XENP20395) vhCDR3
TGHLGPFDL

SEQ ID NO: 38111 - protein, 108 aa, Artificial Sequence; identical to SEQ ID NO: 2822
  Description of Artificial Sequence: Synthetic polypeptide
  VL of [CTLA-4]_H3.5_L2.2  (Fab XENP20358, scFv XENP20395)

SEQ ID NO: 38112 - protein, 12 aa, Artificial Sequence
  Description of Artificial Sequence: Synthetic peptide
  [CTLA-4]_H3.5_L2.2  (Fab XENP20358, scFv XENP20395) vlCDR1
RASQSVGSSYLA

SEQ ID NO: 38113 - protein, 7 aa, Artificial Sequence
  Description of Artificial Sequence: Synthetic peptide
  [CTLA-4]_H3.5_L2.2  (Fab XENP20358, scFv XENP20395) vlCDR2
GASSRAT

SEQ ID NO: 38114 - protein, 9 aa, Artificial Sequence
  Description of Artificial Sequence: Synthetic peptide
  [CTLA-4]_H3.5_L2.2  (Fab XENP20358, scFv XENP20395) vlCDR3
QQYGSSPWT

SEQ ID NO: 38115 - protein, 246 aa, Artificial Sequence; identical to SEQ ID NO: 2820
  Description of Artificial Sequence: Synthetic polypeptide
  scFV of [CTLA-4]_H3.5_L2.2  (Fab XENP20358, scFv XENP20395)

SEQ ID NO: 38116 - protein, 118 aa, Artificial Sequence; identical to SEQ ID NO: 2470
  Description of Artificial Sequence: Synthetic polypeptide
  VH of [CTLA-4]_H3.5_L2.3  (Fab XENP20359, scFv XENP20396)

SEQ ID NO: 38117 - protein, 5 aa, Artificial Sequence
  Description of Artificial Sequence: Synthetic peptide
  [CTLA-4]_H3.5_L2.3  (Fab XENP20359, scFv XENP20396) vhCDR1
SYTMH

SEQ ID NO: 38118 - protein, 17 aa, Artificial Sequence
  Description of Artificial Sequence: Synthetic peptide
  [CTLA-4]_H3.5_L2.3  (Fab XENP20359, scFv XENP20396) vhCDR2
FISYDGNTKYYADSVKG

SEQ ID NO: 38119 - protein, 9 aa, Artificial Sequence
  Description of Artificial Sequence: Synthetic peptide
  [CTLA-4]_H3.5_L2.3  (Fab XENP20359, scFv XENP20396) vhCDR3
TGHLGPFDL

SEQ ID NO: 38120 - protein, 108 aa, Artificial Sequence; identical to SEQ ID NO: 2831
  Description of Artificial Sequence: Synthetic polypeptide
  VL of [CTLA-4]_H3.5_L2.3  (Fab XENP20359, scFv XENP20396)

SEQ ID NO: 38121 - protein, 12 aa, Artificial Sequence
  Description of Artificial Sequence: Synthetic peptide
  [CTLA-4]_H3.5_L2.3  (Fab XENP20359, scFv XENP20396) vlCDR1
RASQSVSSSYLA

SEQ ID NO: 38122 - protein, 7 aa, Artificial Sequence
  Description of Artificial Sequence: Synthetic peptide
  [CTLA-4]_H3.5_L2.3  (Fab XENP20359, scFv XENP20396) vlCDR2
GASSRAT

SEQ ID NO: 38123 - protein, 9 aa, Artificial Sequence
  Description of Artificial Sequence: Synthetic peptide
  [CTLA-4]_H3.5_L2.3  (Fab XENP20359, scFv XENP20396) vlCDR3
QQYGSSPWT

SEQ ID NO: 38124 - protein, 246 aa, Artificial Sequence; identical to SEQ ID NO: 2829
  Description of Artificial Sequence: Synthetic polypeptide
  scFV of [CTLA-4]_H3.5_L2.3  (Fab XENP20359, scFv XENP20396)

SEQ ID NO: 38125 - protein, 118 aa, Artificial Sequence; identical to SEQ ID NO: 139
  Description of Artificial Sequence: Synthetic polypeptide
  VH of [CTLA-4]_H3_L0  (Fab XENP19546, scFv XENP19553)

SEQ ID NO: 38126 - protein, 5 aa, Artificial Sequence
  Description of Artificial Sequence: Synthetic peptide
  [CTLA-4]_H3_L0  (Fab XENP19546, scFv XENP19553) vhCDR1
SYTMH

SEQ ID NO: 38127 - protein, 17 aa, Artificial Sequence
  Description of Artificial Sequence: Synthetic peptide
  [CTLA-4]_H3_L0  (Fab XENP19546, scFv XENP19553) vhCDR2
FISYDGNNKYYADSVKG

SEQ ID NO: 38128 - protein, 9 aa, Artificial Sequence
  Description of Artificial Sequence: Synthetic peptide
  [CTLA-4]_H3_L0  (Fab XENP19546, scFv XENP19553) vhCDR3
TGWLGPFDY

SEQ ID NO: 38129 - protein, 108 aa, Artificial Sequence; identical to SEQ ID NO: 23
  Description of Artificial Sequence: Synthetic polypeptide
  VL of [CTLA-4]_H3_L0  (Fab XENP19546, scFv XENP19553)

SEQ ID NO: 38130 - protein, 12 aa, Artificial Sequence
  Description of Artificial Sequence: Synthetic peptide
  [CTLA-4]_H3_L0  (Fab XENP19546, scFv XENP19553) vlCDR1
RASQSVGSSYLA

SEQ ID NO: 38131 - protein, 7 aa, Artificial Sequence
  Description of Artificial Sequence: Synthetic peptide
  [CTLA-4]_H3_L0  (Fab XENP19546, scFv XENP19553) vlCDR2
GAFSRAT

SEQ ID NO: 38132 - protein, 9 aa, Artificial Sequence
  Description of Artificial Sequence: Synthetic peptide
  [CTLA-4]_H3_L0  (Fab XENP19546, scFv XENP19553) vlCDR3
QQYGSSPWT

SEQ ID NO: 38133 - protein, 246 aa, Artificial Sequence; identical to SEQ ID NO: 138
  Description of Artificial Sequence: Synthetic polypeptide
  scFV of [CTLA-4]_H3_L0  (Fab XENP19546, scFv XENP19553)

SEQ ID NO: 38134 - protein, 118 aa, Artificial Sequence; identical to SEQ ID NO: 139
  Description of Artificial Sequence: Synthetic polypeptide
  VH of [CTLA-4]_H3_L0.22  (Fab XENP20011)

SEQ ID NO: 38135 - protein, 5 aa, Artificial Sequence
  Description of Artificial Sequence: Synthetic peptide
  [CTLA-4]_H3_L0.22  (Fab XENP20011) vhCDR1
SYTMH

SEQ ID NO: 38136 - protein, 17 aa, Artificial Sequence
  Description of Artificial Sequence: Synthetic peptide
  [CTLA-4]_H3_L0.22  (Fab XENP20011) vhCDR2
FISYDGNNKYYADSVKG

SEQ ID NO: 38137 - protein, 9 aa, Artificial Sequence
  Description of Artificial Sequence: Synthetic peptide
  [CTLA-4]_H3_L0.22  (Fab XENP20011) vhCDR3
TGWLGPFDY

SEQ ID NO: 38138 - protein, 108 aa, Artificial Sequence; identical to SEQ ID NO: 1607
  Description of Artificial Sequence: Synthetic polypeptide
  VL of [CTLA-4]_H3_L0.22  (Fab XENP20011)

SEQ ID NO: 38139 - protein, 12 aa, Artificial Sequence
  Description of Artificial Sequence: Synthetic peptide
  [CTLA-4]_H3_L0.22  (Fab XENP20011) vlCDR1
RASQSVSSSYLA

SEQ ID NO: 38140 - protein, 7 aa, Artificial Sequence
  Description of Artificial Sequence: Synthetic peptide
  [CTLA-4]_H3_L0.22  (Fab XENP20011) vlCDR2
GAFSRAT

SEQ ID NO: 38141 - protein, 9 aa, Artificial Sequence
  Description of Artificial Sequence: Synthetic peptide
  [CTLA-4]_H3_L0.22  (Fab XENP20011) vlCDR3
QQYGSSPWT

SEQ ID NO: 38142 - protein, 246 aa, Artificial Sequence
  Description of Artificial Sequence: Synthetic polypeptide
  scFV of [CTLA-4]_H3_L0.22  (Fab XENP20011)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 38143 - protein, 118 aa, Artificial Sequence; identical to SEQ ID NO: 139
  Description of Artificial Sequence: Synthetic polypeptide
  VH of [CTLA-4]_H3_L0.44  (Fab XENP20052)

SEQ ID NO: 38144 - protein, 5 aa, Artificial Sequence
  Description of Artificial Sequence: Synthetic peptide
  [CTLA-4]_H3_L0.44  (Fab XENP20052) vhCDR1
SYTMH

SEQ ID NO: 38145 - protein, 17 aa, Artificial Sequence
  Description of Artificial Sequence: Synthetic peptide
  [CTLA-4]_H3_L0.44  (Fab XENP20052) vhCDR2
FISYDGNNKYYADSVKG

SEQ ID NO: 38146 - protein, 9 aa, Artificial Sequence
  Description of Artificial Sequence: Synthetic peptide
  [CTLA-4]_H3_L0.44  (Fab XENP20052) vhCDR3
TGWLGPFDY

SEQ ID NO: 38147 - protein, 108 aa, Artificial Sequence; identical to SEQ ID NO: 1805
  Description of Artificial Sequence: Synthetic polypeptide
  VL of [CTLA-4]_H3_L0.44  (Fab XENP20052)

SEQ ID NO: 38148 - protein, 12 aa, Artificial Sequence
  Description of Artificial Sequence: Synthetic peptide
  [CTLA-4]_H3_L0.44  (Fab XENP20052) vlCDR1
RASQSVGSSYLS

SEQ ID NO: 38149 - protein, 7 aa, Artificial Sequence
  Description of Artificial Sequence: Synthetic peptide
  [CTLA-4]_H3_L0.44  (Fab XENP20052) vlCDR2
GAFSRAT

SEQ ID NO: 38150 - protein, 9 aa, Artificial Sequence
  Description of Artificial Sequence: Synthetic peptide
  [CTLA-4]_H3_L0.44  (Fab XENP20052) vlCDR3
QQYGSSPWT

SEQ ID NO: 38151 - protein, 246 aa, Artificial Sequence
  Description of Artificial Sequence: Synthetic polypeptide
  scFV of [CTLA-4]_H3_L0.44  (Fab XENP20052)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK

SEQ ID NO: 38152 - protein, 118 aa, Artificial Sequence; identical to SEQ ID NO: 139
  Description of Artificial Sequence: Synthetic polypeptide
  VH of [CTLA-4]_H3_L0.67  (Fab XENP20018)

SEQ ID NO: 38153 - protein, 5 aa, Artificial Sequence
  Description of Artificial Sequence: Synthetic peptide
  [CTLA-4]_H3_L0.67  (Fab XENP20018) vhCDR1
SYTMH

SEQ ID NO: 38154 - protein, 17 aa, Artificial Sequence
  Description of Artificial Sequence: Synthetic peptide
  [CTLA-4]_H3_L0.67  (Fab XENP20018) vhCDR2
FISYDGNNKYYADSVKG

SEQ ID NO: 38155 - protein, 9 aa, Artificial Sequence
  Description of Artificial Sequence: Synthetic peptide
  [CTLA-4]_H3_L0.67  (Fab XENP20018) vhCDR3
TGWLGPFDY

SEQ ID NO: 38156 - protein, 108 aa, Artificial Sequence; identical to SEQ ID NO: 2012
  Description of Artificial Sequence: Synthetic polypeptide
  VL of [CTLA-4]_H3_L0.67  (Fab XENP20018)

SEQ ID NO: 38157 - protein, 12 aa, Artificial Sequence
  Description of Artificial Sequence: Synthetic peptide
  [CTLA-4]_H3_L0.67  (Fab XENP20018) vlCDR1
RASQSVGSSYLA

SEQ ID NO: 38158 - protein, 7 aa, Artificial Sequence
  Description of Artificial Sequence: Synthetic peptide
  [CTLA-4]_H3_L0.67  (Fab XENP20018) vlCDR2
DAFSRAT

SEQ ID NO: 38159 - protein, 9 aa, Artificial Sequence
  Description of Artificial Sequence: Synthetic peptide
  [CTLA-4]_H3_L0.67  (Fab XENP20018) vlCDR3
QQYGSSPWT

SEQ ID NO: 38160 - protein, 246 aa, Artificial Sequence
  Description of Artificial Sequence: Synthetic polypeptide
  scFV of [CTLA-4]_H3_L0.67  (Fab XENP20018)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK

SEQ ID NO: 38161 - protein, 118 aa, Artificial Sequence; identical to SEQ ID NO: 139
  Description of Artificial Sequence: Synthetic polypeptide
  VH of [CTLA-4]_H3_L0.74  (Fab XENP20020)

SEQ ID NO: 38162 - protein, 5 aa, Artificial Sequence
  Description of Artificial Sequence: Synthetic peptide
  [CTLA-4]_H3_L0.74  (Fab XENP20020) vhCDR1
SYTMH

SEQ ID NO: 38163 - protein, 17 aa, Artificial Sequence
  Description of Artificial Sequence: Synthetic peptide
  [CTLA-4]_H3_L0.74  (Fab XENP20020) vhCDR2
FISYDGNNKYYADSVKG

SEQ ID NO: 38164 - protein, 9 aa, Artificial Sequence
  Description of Artificial Sequence: Synthetic peptide
  [CTLA-4]_H3_L0.74  (Fab XENP20020) vhCDR3
TGWLGPFDY

SEQ ID NO: 38165 - protein, 108 aa, Artificial Sequence; identical to SEQ ID NO: 2075
  Description of Artificial Sequence: Synthetic polypeptide
  VL of [CTLA-4]_H3_L0.74  (Fab XENP20020)

SEQ ID NO: 38166 - protein, 12 aa, Artificial Sequence
  Description of Artificial Sequence: Synthetic peptide
  [CTLA-4]_H3_L0.74  (Fab XENP20020) vlCDR1
RASQSVGSSYLA

SEQ ID NO: 38167 - protein, 7 aa, Artificial Sequence
  Description of Artificial Sequence: Synthetic peptide
  [CTLA-4]_H3_L0.74  (Fab XENP20020) vlCDR2
GAYSRAT

SEQ ID NO: 38168 - protein, 9 aa, Artificial Sequence
  Description of Artificial Sequence: Synthetic peptide
  [CTLA-4]_H3_L0.74  (Fab XENP20020) vlCDR3
QQYGSSPWT

SEQ ID NO: 38169 - protein, 246 aa, Artificial Sequence
  Description of Artificial Sequence: Synthetic polypeptide
  scFV of [CTLA-4]_H3_L0.74  (Fab XENP20020)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK

SEQ ID NO: 38170 - protein, 121 aa, Artificial Sequence; identical to SEQ ID NO: 22485
  Description of Artificial Sequence: Synthetic polypeptide
  VH of XENP22594

SEQ ID NO: 38171 - protein, 5 aa, Artificial Sequence
  Description of Artificial Sequence: Synthetic peptide
  XENP22594 vhCDR1
DAWMS

SEQ ID NO: 38172 - protein, 19 aa, Artificial Sequence
  Description of Artificial Sequence: Synthetic peptide
  XENP22594 vhCDR2
EISTKANNHATYYAESVKG

SEQ ID NO: 38173 - protein, 10 aa, Artificial Sequence
  Description of Artificial Sequence: Synthetic peptide
  XENP22594 vhCDR3
LATWDWYFDV

SEQ ID NO: 38174 - protein, 111 aa, Artificial Sequence; identical to SEQ ID NO: 22600
  Description of Artificial Sequence: Synthetic polypeptide
  VL of XENP22594

SEQ ID NO: 38175 - protein, 15 aa, Artificial Sequence
  Description of Artificial Sequence: Synthetic peptide
  XENP22594 vlCDR1
RASQSVDYDGDSYMN

SEQ ID NO: 38176 - protein, 7 aa, Artificial Sequence
  Description of Artificial Sequence: Synthetic peptide
  XENP22594 vlCDR2
AASELES

SEQ ID NO: 38177 - protein, 9 aa, Artificial Sequence
  Description of Artificial Sequence: Synthetic peptide
  XENP22594 vlCDR3
QQSNEDPFT

SEQ ID NO: 38178 - protein, 118 aa, Artificial Sequence; identical to SEQ ID NO: 22085
  Description of Artificial Sequence: Synthetic polypeptide
  VH of XENP22656

SEQ ID NO: 38179 - protein, 5 aa, Artificial Sequence
  Description of Artificial Sequence: Synthetic peptide
  XENP22656 vhCDR1
DYFMH

SEQ ID NO: 38180 - protein, 17 aa, Artificial Sequence
  Description of Artificial Sequence: Synthetic peptide
  XENP22656 vhCDR2
WIDPELGDTEYAPKFQG

SEQ ID NO: 38181 - protein, 9 aa, Artificial Sequence
  Description of Artificial Sequence: Synthetic peptide
  XENP22656 vhCDR3
RGVYQALDY

SEQ ID NO: 38182 - protein, 107 aa, Artificial Sequence; identical to SEQ ID NO: 22280
  Description of Artificial Sequence: Synthetic polypeptide
  VL of XENP22656

SEQ ID NO: 38183 - protein, 11 aa, Artificial Sequence
  Description of Artificial Sequence: Synthetic peptide
  XENP22656 vlCDR1
QASQDIGNYLN

SEQ ID NO: 38184 - protein, 7 aa, Artificial Sequence
  Description of Artificial Sequence: Synthetic peptide
  XENP22656 vlCDR2
FTSYLHS

SEQ ID NO: 38185 - protein, 9 aa, Artificial Sequence
  Description of Artificial Sequence: Synthetic peptide
  XENP22656 vlCDR3
QQGNTLPYT

SEQ ID NO: 38186 - protein, 121 aa, Artificial Sequence; identical to SEQ ID NO: 22325
  Description of Artificial Sequence: Synthetic polypeptide
  VH of XENP21670

SEQ ID NO: 38187 - protein, 5 aa, Artificial Sequence
  Description of Artificial Sequence: Synthetic peptide
  XENP21670 vhCDR1
DAWMD

SEQ ID NO: 38188 - protein, 19 aa, Artificial Sequence
  Description of Artificial Sequence: Synthetic peptide
  XENP21670 vhCDR2
EISTKANNHATYYAESVKG

SEQ ID NO: 38189 - protein, 10 aa, Artificial Sequence
  Description of Artificial Sequence: Synthetic peptide
  XENP21670 vhCDR3
LATWDWYFDV

SEQ ID NO: 38190 - protein, 111 aa, Artificial Sequence; identical to SEQ ID NO: 22360
  Description of Artificial Sequence: Synthetic polypeptide
  VL of XENP21670

SEQ ID NO: 38191 - protein, 15 aa, Artificial Sequence
  Description of Artificial Sequence: Synthetic peptide
  XENP21670 vlCDR1
RASQSVDYDGDSYMN

SEQ ID NO: 38192 - protein, 7 aa, Artificial Sequence
  Description of Artificial Sequence: Synthetic peptide
  XENP21670 vlCDR2
AASELES

SEQ ID NO: 38193 - protein, 9 aa, Artificial Sequence
  Description of Artificial Sequence: Synthetic peptide
  XENP21670 vlCDR3
QQSNEDPFT

SEQ ID NO: 38194 - protein, 121 aa, Artificial Sequence; identical to SEQ ID NO: 17586
  Description of Artificial Sequence: Synthetic polypeptide
  VH of XENP20930

SEQ ID NO: 38195 - protein, 5 aa, Artificial Sequence
  Description of Artificial Sequence: Synthetic peptide
  XENP20930 vhCDR1
DAWMD

SEQ ID NO: 38196 - protein, 19 aa, Artificial Sequence
  Description of Artificial Sequence: Synthetic peptide
  XENP20930 vhCDR2
EIRTKANNHATYYAESVKG

SEQ ID NO: 38197 - protein, 10 aa, Artificial Sequence
  Description of Artificial Sequence: Synthetic peptide
  XENP20930 vhCDR3
LANWDWYFDV

SEQ ID NO: 38198 - protein, 111 aa, Artificial Sequence; identical to SEQ ID NO: 17591
  Description of Artificial Sequence: Synthetic polypeptide
  VL of XENP20930

SEQ ID NO: 38199 - protein, 15 aa, Artificial Sequence
  Description of Artificial Sequence: Synthetic peptide
  XENP20930 vlCDR1
KASQSVDYDGDSYMN

SEQ ID NO: 38200 - protein, 7 aa, Artificial Sequence
  Description of Artificial Sequence: Synthetic peptide
  XENP20930 vlCDR2
AASNLES

SEQ ID NO: 38201 - protein, 9 aa, Artificial Sequence
  Description of Artificial Sequence: Synthetic peptide
  XENP20930 vlCDR3
QQSNEDPFT

SEQ ID NO: 38202 - protein, 118 aa, Artificial Sequence; identical to SEQ ID NO: 22065
  Description of Artificial Sequence: Synthetic polypeptide
  VH of XENP21921

SEQ ID NO: 38203 - protein, 5 aa, Artificial Sequence
  Description of Artificial Sequence: Synthetic peptide
  XENP21921 vhCDR1
HYFMH

SEQ ID NO: 38204 - protein, 17 aa, Artificial Sequence
  Description of Artificial Sequence: Synthetic peptide
  XENP21921 vhCDR2
WIDPYLGDTEYAPKFQG

SEQ ID NO: 38205 - protein, 9 aa, Artificial Sequence
  Description of Artificial Sequence: Synthetic peptide
  XENP21921 vhCDR3
RGVYQALDY

SEQ ID NO: 38206 - protein, 107 aa, Artificial Sequence; identical to SEQ ID NO: 22080
  Description of Artificial Sequence: Synthetic polypeptide
  VL of XENP21921

SEQ ID NO: 38207 - protein, 11 aa, Artificial Sequence
  Description of Artificial Sequence: Synthetic peptide
  XENP21921 vlCDR1
QASQDIGNYLN

SEQ ID NO: 38208 - protein, 7 aa, Artificial Sequence
  Description of Artificial Sequence: Synthetic peptide
  XENP21921 vlCDR2
FTSYLHS

SEQ ID NO: 38209 - protein, 9 aa, Artificial Sequence
  Description of Artificial Sequence: Synthetic peptide
  XENP21921 vlCDR3
QQGNTLPYT

SEQ ID NO: 38210 - protein, 118 aa, Artificial Sequence; identical to SEQ ID NO: 17236
  Description of Artificial Sequence: Synthetic polypeptide
  VH of XENP20847

SEQ ID NO: 38211 - protein, 5 aa, Artificial Sequence
  Description of Artificial Sequence: Synthetic peptide
  XENP20847 vhCDR1
DYYMH

SEQ ID NO: 38212 - protein, 17 aa, Artificial Sequence
  Description of Artificial Sequence: Synthetic peptide
  XENP20847 vhCDR2
WIDPENGDTEYAPKFQG

SEQ ID NO: 38213 - protein, 9 aa, Artificial Sequence
  Description of Artificial Sequence: Synthetic peptide
  XENP20847 vhCDR3
RGVRQALDY

SEQ ID NO: 38214 - protein, 107 aa, Artificial Sequence; identical to SEQ ID NO: 17251
  Description of Artificial Sequence: Synthetic polypeptide
  VL of XENP20847

SEQ ID NO: 38215 - protein, 11 aa, Artificial Sequence
  Description of Artificial Sequence: Synthetic peptide
  XENP20847 vlCDR1
QASQDIGNYLN

SEQ ID NO: 38216 - protein, 7 aa, Artificial Sequence
  Description of Artificial Sequence: Synthetic peptide
  XENP20847 vlCDR2
YTSRLHS

SEQ ID NO: 38217 - protein, 9 aa, Artificial Sequence
  Description of Artificial Sequence: Synthetic peptide
  XENP20847 vlCDR3
QQGNTLPYT

SEQ ID NO: 38218 - protein, 118 aa, Artificial Sequence; identical to SEQ ID NO: 17236
  Description of Artificial Sequence: Synthetic polypeptide
  VH of XENP21372

SEQ ID NO: 38219 - protein, 5 aa, Artificial Sequence
  Description of Artificial Sequence: Synthetic peptide
  XENP21372 vhCDR1
DYYMH

SEQ ID NO: 38220 - protein, 17 aa, Artificial Sequence
  Description of Artificial Sequence: Synthetic peptide
  XENP21372 vhCDR2
WIDPENGDTEYAPKFQG

SEQ ID NO: 38221 - protein, 9 aa, Artificial Sequence
  Description of Artificial Sequence: Synthetic peptide
  XENP21372 vhCDR3
RGVRQALDY

SEQ ID NO: 38222 - protein, 107 aa, Artificial Sequence; identical to SEQ ID NO: 22180
  Description of Artificial Sequence: Synthetic polypeptide
  VL of XENP21372

SEQ ID NO: 38223 - protein, 11 aa, Artificial Sequence
  Description of Artificial Sequence: Synthetic peptide
  XENP21372 vlCDR1
QASQDIGNHLN

SEQ ID NO: 38224 - protein, 7 aa, Artificial Sequence
  Description of Artificial Sequence: Synthetic peptide
  XENP21372 vlCDR2
YTSRLHS

SEQ ID NO: 38225 - protein, 9 aa, Artificial Sequence
  Description of Artificial Sequence: Synthetic peptide
  XENP21372 vlCDR3
QQGNTLPYT

SEQ ID NO: 38226 - protein, 118 aa, Artificial Sequence; identical to SEQ ID NO: 17236
  Description of Artificial Sequence: Synthetic polypeptide
  VH of XENP21394

SEQ ID NO: 38227 - protein, 5 aa, Artificial Sequence
  Description of Artificial Sequence: Synthetic peptide
  XENP21394 vhCDR1
DYYMH

SEQ ID NO: 38228 - protein, 17 aa, Artificial Sequence
  Description of Artificial Sequence: Synthetic peptide
  XENP21394 vhCDR2
WIDPENGDTEYAPKFQG

SEQ ID NO: 38229 - protein, 9 aa, Artificial Sequence
  Description of Artificial Sequence: Synthetic peptide
  XENP21394 vhCDR3
RGVRQALDY

SEQ ID NO: 38230 - protein, 107 aa, Artificial Sequence; identical to SEQ ID NO: 22040
  Description of Artificial Sequence: Synthetic polypeptide
  VL of XENP21394

SEQ ID NO: 38231 - protein, 11 aa, Artificial Sequence
  Description of Artificial Sequence: Synthetic peptide
  XENP21394 vlCDR1
QASQDIGNYLN

SEQ ID NO: 38232 - protein, 7 aa, Artificial Sequence
  Description of Artificial Sequence: Synthetic peptide
  XENP21394 vlCDR2
YTSHLHS

SEQ ID NO: 38233 - protein, 9 aa, Artificial Sequence
  Description of Artificial Sequence: Synthetic peptide
  XENP21394 vlCDR3
QQGNTLPYT

SEQ ID NO: 38234 - protein, 118 aa, Artificial Sequence; identical to SEQ ID NO: 17236
  Description of Artificial Sequence: Synthetic polypeptide
  VH of XENP21401

SEQ ID NO: 38235 - protein, 5 aa, Artificial Sequence
  Description of Artificial Sequence: Synthetic peptide
  XENP21401 vhCDR1
DYYMH

SEQ ID NO: 38236 - protein, 17 aa, Artificial Sequence
  Description of Artificial Sequence: Synthetic peptide
  XENP21401 vhCDR2
WIDPENGDTEYAPKFQG

SEQ ID NO: 38237 - protein, 9 aa, Artificial Sequence
  Description of Artificial Sequence: Synthetic peptide
  XENP21401 vhCDR3
RGVRQALDY

SEQ ID NO: 38238 - protein, 107 aa, Artificial Sequence; identical to SEQ ID NO: 22060
  Description of Artificial Sequence: Synthetic polypeptide
  VL of XENP21401

SEQ ID NO: 38239 - protein, 11 aa, Artificial Sequence
  Description of Artificial Sequence: Synthetic peptide
  XENP21401 vlCDR1
QASQDIGNYLN

SEQ ID NO: 38240 - protein, 7 aa, Artificial Sequence
  Description of Artificial Sequence: Synthetic peptide
  XENP21401 vlCDR2
YTSYLHS

SEQ ID NO: 38241 - protein, 9 aa, Artificial Sequence
  Description of Artificial Sequence: Synthetic peptide
  XENP21401 vlCDR3
QQGNTLPYT

SEQ ID NO: 38242 - protein, 118 aa, Artificial Sequence; identical to SEQ ID NO: 17236
  Description of Artificial Sequence: Synthetic polypeptide
  VH of XENP20847

SEQ ID NO: 38243 - protein, 5 aa, Artificial Sequence
  Description of Artificial Sequence: Synthetic peptide
  XENP20847 vhCDR1
DYYMH

SEQ ID NO: 38244 - protein, 17 aa, Artificial Sequence
  Description of Artificial Sequence: Synthetic peptide
  XENP20847 vhCDR2
WIDPENGDTEYAPKFQG

SEQ ID NO: 38245 - protein, 9 aa, Artificial Sequence
  Description of Artificial Sequence: Synthetic peptide
  XENP20847 vhCDR3
RGVRQALDY

SEQ ID NO: 38246 - protein, 107 aa, Artificial Sequence; identical to SEQ ID NO: 17251
  Description of Artificial Sequence: Synthetic polypeptide
  VL of XENP20847

SEQ ID NO: 38247 - protein, 11 aa, Artificial Sequence
  Description of Artificial Sequence: Synthetic peptide
  XENP20847 vlCDR1
QASQDIGNYLN

SEQ ID NO: 38248 - protein, 7 aa, Artificial Sequence
  Description of Artificial Sequence: Synthetic peptide
  XENP20847 vlCDR2
YTSRLHS

SEQ ID NO: 38249 - protein, 9 aa, Artificial Sequence
  Description of Artificial Sequence: Synthetic peptide
  XENP20847 vlCDR3
QQGNTLPYT

SEQ ID NO: 38250 - protein, 121 aa, Artificial Sequence; identical to SEQ ID NO: 22325
  Description of Artificial Sequence: Synthetic polypeptide
  VH of XENP21670

SEQ ID NO: 38251 - protein, 5 aa, Artificial Sequence
  Description of Artificial Sequence: Synthetic peptide
  XENP21670 vhCDR1
DAWMD

SEQ ID NO: 38252 - protein, 19 aa, Artificial Sequence
  Description of Artificial Sequence: Synthetic peptide
  XENP21670 vhCDR2
EISTKANNHATYYAESVKG

SEQ ID NO: 38253 - protein, 10 aa, Artificial Sequence
  Description of Artificial Sequence: Synthetic peptide
  XENP21670 vhCDR3
LATWDWYFDV

SEQ ID NO: 38254 - protein, 111 aa, Artificial Sequence; identical to SEQ ID NO: 22360
  Description of Artificial Sequence: Synthetic polypeptide
  VL of XENP21670

SEQ ID NO: 38255 - protein, 15 aa, Artificial Sequence
  Description of Artificial Sequence: Synthetic peptide
  XENP21670 vlCDR1
RASQSVDYDGDSYMN

SEQ ID NO: 38256 - protein, 7 aa, Artificial Sequence
  Description of Artificial Sequence: Synthetic peptide
  XENP21670 vlCDR2
AASELES

SEQ ID NO: 38257 - protein, 9 aa, Artificial Sequence
  Description of Artificial Sequence: Synthetic peptide
  XENP21670 vlCDR3
QQSNEDPFT

SEQ ID NO: 38258 - protein, 121 aa, Artificial Sequence; identical to SEQ ID NO: 22425
  Description of Artificial Sequence: Synthetic polypeptide
  VH of XENP21892

SEQ ID NO: 38259 - protein, 5 aa, Artificial Sequence
  Description of Artificial Sequence: Synthetic peptide
  XENP21892 vhCDR1
DAWMD

SEQ ID NO: 38260 - protein, 19 aa, Artificial Sequence
  Description of Artificial Sequence: Synthetic peptide
  XENP21892 vhCDR2
EISTKAYNHATYYAESVKG

SEQ ID NO: 38261 - protein, 10 aa, Artificial Sequence
  Description of Artificial Sequence: Synthetic peptide
  XENP21892 vhCDR3
LATWDWYFDV

SEQ ID NO: 38262 - protein, 111 aa, Artificial Sequence; identical to SEQ ID NO: 17601
  Description of Artificial Sequence: Synthetic polypeptide
  VL of XENP21892

SEQ ID NO: 38263 - protein, 15 aa, Artificial Sequence
  Description of Artificial Sequence: Synthetic peptide
  XENP21892 vlCDR1
RASQSVDYDGDSYMN

SEQ ID NO: 38264 - protein, 7 aa, Artificial Sequence
  Description of Artificial Sequence: Synthetic peptide
  XENP21892 vlCDR2
AASNLES

SEQ ID NO: 38265 - protein, 9 aa, Artificial Sequence
  Description of Artificial Sequence: Synthetic peptide
  XENP21892 vlCDR3
QQSNEDPFT

SEQ ID NO: 38266 - protein, 121 aa, Artificial Sequence; identical to SEQ ID NO: 22425
  Description of Artificial Sequence: Synthetic polypeptide
  VH of XENP21893

SEQ ID NO: 38267 - protein, 5 aa, Artificial Sequence
  Description of Artificial Sequence: Synthetic peptide
  XENP21893 vhCDR1
DAWMD

SEQ ID NO: 38268 - protein, 19 aa, Artificial Sequence
  Description of Artificial Sequence: Synthetic peptide
  XENP21893 vhCDR2
EISTKAYNHATYYAESVKG

SEQ ID NO: 38269 - protein, 10 aa, Artificial Sequence
  Description of Artificial Sequence: Synthetic peptide
  XENP21893 vhCDR3
LATWDWYFDV

SEQ ID NO: 38270 - protein, 111 aa, Artificial Sequence; identical to SEQ ID NO: 22360
  Description of Artificial Sequence: Synthetic polypeptide
  VL of XENP21893

SEQ ID NO: 38271 - protein, 15 aa, Artificial Sequence
  Description of Artificial Sequence: Synthetic peptide
  XENP21893 vlCDR1
RASQSVDYDGDSYMN

SEQ ID NO: 38272 - protein, 7 aa, Artificial Sequence
  Description of Artificial Sequence: Synthetic peptide
  XENP21893 vlCDR2
AASELES

SEQ ID NO: 38273 - protein, 9 aa, Artificial Sequence
  Description of Artificial Sequence: Synthetic peptide
  XENP21893 vlCDR3
QQSNEDPFT

SEQ ID NO: 38274 - protein, 121 aa, Artificial Sequence; identical to SEQ ID NO: 22425
  Description of Artificial Sequence: Synthetic polypeptide
  VH of XENP21894

SEQ ID NO: 38275 - protein, 5 aa, Artificial Sequence
  Description of Artificial Sequence: Synthetic peptide
  XENP21894 vhCDR1
DAWMD

SEQ ID NO: 38276 - protein, 19 aa, Artificial Sequence
  Description of Artificial Sequence: Synthetic peptide
  XENP21894 vhCDR2
EISTKAYNHATYYAESVKG

SEQ ID NO: 38277 - protein, 10 aa, Artificial Sequence
  Description of Artificial Sequence: Synthetic peptide
  XENP21894 vhCDR3
LATWDWYFDV

SEQ ID NO: 38278 - protein, 111 aa, Artificial Sequence; identical to SEQ ID NO: 22420
  Description of Artificial Sequence: Synthetic polypeptide
  VL of XENP21894

SEQ ID NO: 38279 - protein, 15 aa, Artificial Sequence
  Description of Artificial Sequence: Synthetic peptide
  XENP21894 vlCDR1
RASQSVDHDGDSYMN

SEQ ID NO: 38280 - protein, 7 aa, Artificial Sequence
  Description of Artificial Sequence: Synthetic peptide
  XENP21894 vlCDR2
AASELES

SEQ ID NO: 38281 - protein, 9 aa, Artificial Sequence
  Description of Artificial Sequence: Synthetic peptide
  XENP21894 vlCDR3
QQSNEDPFT

SEQ ID NO: 38282 - protein, 118 aa, Artificial Sequence; identical to SEQ ID NO: 20936
  Description of Artificial Sequence: Synthetic polypeptide
  VH of XENP20269

SEQ ID NO: 38283 - protein, 5 aa, Artificial Sequence
  Description of Artificial Sequence: Synthetic peptide
  XENP20269 vhCDR1
GYGVN

SEQ ID NO: 38284 - protein, 16 aa, Artificial Sequence
  Description of Artificial Sequence: Synthetic peptide
  XENP20269 vhCDR2
MIWIDGSTDYNSALKS

SEQ ID NO: 38285 - protein, 10 aa, Artificial Sequence
  Description of Artificial Sequence: Synthetic peptide
  XENP20269 vhCDR3
DRPDGRAMDY

SEQ ID NO: 38286 - protein, 106 aa, Artificial Sequence; identical to SEQ ID NO: 20941
  Description of Artificial Sequence: Synthetic polypeptide
  VL of XENP20269

SEQ ID NO: 38287 - protein, 11 aa, Artificial Sequence
  Description of Artificial Sequence: Synthetic peptide
  XENP20269 vlCDR1
KASQSVSNDVA

SEQ ID NO: 38288 - protein, 7 aa, Artificial Sequence
  Description of Artificial Sequence: Synthetic peptide
  XENP20269 vlCDR2
YASNRYT

SEQ ID NO: 38289 - protein, 8 aa, Artificial Sequence
  Description of Artificial Sequence: Synthetic peptide
  XENP20269 vlCDR3
QQDYSSPT

SEQ ID NO: 38290 - protein, 118 aa, Artificial Sequence; identical to SEQ ID NO: 21205
  Description of Artificial Sequence: Synthetic polypeptide
  VH of XENP20872

SEQ ID NO: 38291 - protein, 5 aa, Artificial Sequence
  Description of Artificial Sequence: Synthetic peptide
  XENP20872 vhCDR1
GYGVN

SEQ ID NO: 38292 - protein, 16 aa, Artificial Sequence
  Description of Artificial Sequence: Synthetic peptide
  XENP20872 vhCDR2
MIWIDGSTDYNSKFQG

SEQ ID NO: 38293 - protein, 10 aa, Artificial Sequence
  Description of Artificial Sequence: Synthetic peptide
  XENP20872 vhCDR3
DRPDGRAMDY

SEQ ID NO: 38294 - protein, 106 aa, Artificial Sequence; identical to SEQ ID NO: 21051
  Description of Artificial Sequence: Synthetic polypeptide
  VL of XENP20872

SEQ ID NO: 38295 - protein, 11 aa, Artificial Sequence
  Description of Artificial Sequence: Synthetic peptide
  XENP20872 vlCDR1
KASQSVSNDVA

SEQ ID NO: 38296 - protein, 7 aa, Artificial Sequence
  Description of Artificial Sequence: Synthetic peptide
  XENP20872 vlCDR2
YASNRYT

SEQ ID NO: 38297 - protein, 8 aa, Artificial Sequence
  Description of Artificial Sequence: Synthetic peptide
  XENP20872 vlCDR3
QQDYSSPT

SEQ ID NO: 38298 - protein, 118 aa, Artificial Sequence; identical to SEQ ID NO: 21305
  Description of Artificial Sequence: Synthetic polypeptide
  VH of XENP020882

SEQ ID NO: 38299 - protein, 5 aa, Artificial Sequence
  Description of Artificial Sequence: Synthetic peptide
  XENP020882 vhCDR1
GYGVN

SEQ ID NO: 38300 - protein, 16 aa, Artificial Sequence
  Description of Artificial Sequence: Synthetic peptide
  XENP020882 vhCDR2
MIWIDGSTDYNSKFQG

SEQ ID NO: 38301 - protein, 10 aa, Artificial Sequence
  Description of Artificial Sequence: Synthetic peptide
  XENP020882 vhCDR3
DRPDGRAMDY

SEQ ID NO: 38302 - protein, 106 aa, Artificial Sequence; identical to SEQ ID NO: 21051
  Description of Artificial Sequence: Synthetic polypeptide
  VL of XENP020882

SEQ ID NO: 38303 - protein, 11 aa, Artificial Sequence
  Description of Artificial Sequence: Synthetic peptide
  XENP020882 vlCDR1
KASQSVSNDVA

SEQ ID NO: 38304 - protein, 7 aa, Artificial Sequence
  Description of Artificial Sequence: Synthetic peptide
  XENP020882 vlCDR2
YASNRYT

SEQ ID NO: 38305 - protein, 8 aa, Artificial Sequence
  Description of Artificial Sequence: Synthetic peptide
  XENP020882 vlCDR3
QQDYSSPT

SEQ ID NO: 38306 - protein, 113 aa, Artificial Sequence; identical to SEQ ID NO: 36628
  Description of Artificial Sequence: Synthetic polypeptide
  VH of XENP21503

SEQ ID NO: 38307 - protein, 5 aa, Artificial Sequence
  Description of Artificial Sequence: Synthetic peptide
  XENP21503 vhCDR1
SFDMS

SEQ ID NO: 38308 - protein, 17 aa, Artificial Sequence
  Description of Artificial Sequence: Synthetic peptide
  XENP21503 vhCDR2
YISSDGASTFYPDTMKG

SEQ ID NO: 38309 - protein, 4 aa, Artificial Sequence
  Description of Artificial Sequence: Synthetic peptide
  XENP21503 vhCDR3
LGAY

SEQ ID NO: 38310 - protein, 112 aa, Artificial Sequence; identical to SEQ ID NO: 36703
  Description of Artificial Sequence: Synthetic polypeptide
  VL of XENP21503

SEQ ID NO: 38311 - protein, 16 aa, Artificial Sequence
  Description of Artificial Sequence: Synthetic peptide
  XENP21503 vlCDR1
KSSQSLLDSDGKTYLN

SEQ ID NO: 38312 - protein, 6 aa, Artificial Sequence
  Description of Artificial Sequence: Synthetic peptide
  XENP21503 vlCDR2
VSKLDS

SEQ ID NO: 38313 - protein, 9 aa, Artificial Sequence
  Description of Artificial Sequence: Synthetic peptide
  XENP21503 vlCDR3
WQGTHFPYT

SEQ ID NO: 38314 - protein, 113 aa, Artificial Sequence; identical to SEQ ID NO: 36628
  Description of Artificial Sequence: Synthetic polypeptide
  VH of XENP21492

SEQ ID NO: 38315 - protein, 5 aa, Artificial Sequence
  Description of Artificial Sequence: Synthetic peptide
  XENP21492 vhCDR1
SFDMS

SEQ ID NO: 38316 - protein, 17 aa, Artificial Sequence
  Description of Artificial Sequence: Synthetic peptide
  XENP21492 vhCDR2
YISSDGASTFYPDTMKG

SEQ ID NO: 38317 - protein, 4 aa, Artificial Sequence
  Description of Artificial Sequence: Synthetic peptide
  XENP21492 vhCDR3
LGAY

SEQ ID NO: 38318 - protein, 111 aa, Artificial Sequence; identical to SEQ ID NO: 36633
  Description of Artificial Sequence: Synthetic polypeptide
  VL of XENP21492

SEQ ID NO: 38319 - protein, 14 aa, Artificial Sequence
  Description of Artificial Sequence: Synthetic peptide
  XENP21492 vlCDR1
RASESVEYYGTSLQ

SEQ ID NO: 38320 - protein, 7 aa, Artificial Sequence
  Description of Artificial Sequence: Synthetic peptide
  XENP21492 vlCDR2
AASNVES

SEQ ID NO: 38321 - protein, 9 aa, Artificial Sequence
  Description of Artificial Sequence: Synthetic peptide
  XENP21492 vlCDR3
QQSRKVPWT

SEQ ID NO: 38322 - protein, 117 aa, Artificial Sequence; identical to SEQ ID NO: 36368
  Description of Artificial Sequence: Synthetic polypeptide
  VH of XENP21189

SEQ ID NO: 38323 - protein, 5 aa, Artificial Sequence
  Description of Artificial Sequence: Synthetic peptide
  XENP21189 vhCDR1
GYGVN

SEQ ID NO: 38324 - protein, 16 aa, Artificial Sequence
  Description of Artificial Sequence: Synthetic peptide
  XENP21189 vhCDR2
MIWGDGSTDYNSALKS

SEQ ID NO: 38325 - protein, 9 aa, Artificial Sequence
  Description of Artificial Sequence: Synthetic peptide
  XENP21189 vhCDR3
SYYTSDEDY

SEQ ID NO: 38326 - protein, 112 aa, Artificial Sequence; identical to SEQ ID NO: 36513
  Description of Artificial Sequence: Synthetic polypeptide
  VL of XENP21189

SEQ ID NO: 38327 - protein, 17 aa, Artificial Sequence
  Description of Artificial Sequence: Synthetic peptide
  XENP21189 vlCDR1
KSSQSLLNSRTRKNYLA

SEQ ID NO: 38328 - protein, 7 aa, Artificial Sequence
  Description of Artificial Sequence: Synthetic peptide
  XENP21189 vlCDR2
WASTRES

SEQ ID NO: 38329 - protein, 8 aa, Artificial Sequence
  Description of Artificial Sequence: Synthetic peptide
  XENP21189 vlCDR3
KQSYSLRT

SEQ ID NO: 38330 - protein, 117 aa, Artificial Sequence; identical to SEQ ID NO: 36638
  Description of Artificial Sequence: Synthetic polypeptide
  VH of XENP21493

SEQ ID NO: 38331 - protein, 5 aa, Artificial Sequence
  Description of Artificial Sequence: Synthetic peptide
  XENP21493 vhCDR1
GYGVN

SEQ ID NO: 38332 - protein, 16 aa, Artificial Sequence
  Description of Artificial Sequence: Synthetic peptide
  XENP21493 vhCDR2
MIWGDGSTDYNSALKS

SEQ ID NO: 38333 - protein, 9 aa, Artificial Sequence
  Description of Artificial Sequence: Synthetic peptide
  XENP21493 vhCDR3
SYYTSDEDY

SEQ ID NO: 38334 - protein, 107 aa, Artificial Sequence; identical to SEQ ID NO: 36643
  Description of Artificial Sequence: Synthetic polypeptide
  VL of XENP21493

SEQ ID NO: 38335 - protein, 11 aa, Artificial Sequence
  Description of Artificial Sequence: Synthetic peptide
  XENP21493 vlCDR1
KASQNVGSNVA

SEQ ID NO: 38336 - protein, 7 aa, Artificial Sequence
  Description of Artificial Sequence: Synthetic peptide
  XENP21493 vlCDR2
SASFRYS

SEQ ID NO: 38337 - protein, 9 aa, Artificial Sequence
  Description of Artificial Sequence: Synthetic peptide
  XENP21493 vlCDR3
QQYNSYPYT

SEQ ID NO: 38338 - protein, 117 aa, Artificial Sequence; identical to SEQ ID NO: 36648
  Description of Artificial Sequence: Synthetic polypeptide
  VH of XENP21494

SEQ ID NO: 38339 - protein, 5 aa, Artificial Sequence
  Description of Artificial Sequence: Synthetic peptide
  XENP21494 vhCDR1
SYGVH

SEQ ID NO: 38340 - protein, 16 aa, Artificial Sequence
  Description of Artificial Sequence: Synthetic peptide
  XENP21494 vhCDR2
VIWSGGSTEYNAAFIS

SEQ ID NO: 38341 - protein, 9 aa, Artificial Sequence
  Description of Artificial Sequence: Synthetic peptide
  XENP21494 vhCDR3
GGLLSPFDY

SEQ ID NO: 38342 - protein, 111 aa, Artificial Sequence; identical to SEQ ID NO: 36633
  Description of Artificial Sequence: Synthetic polypeptide
  VL of XENP21494

SEQ ID NO: 38343 - protein, 15 aa, Artificial Sequence
  Description of Artificial Sequence: Synthetic peptide
  XENP21494 vlCDR1
RASESVEYYGTSLMQ

SEQ ID NO: 38344 - protein, 7 aa, Artificial Sequence
  Description of Artificial Sequence: Synthetic peptide
  XENP21494 vlCDR2
AASNVES

SEQ ID NO: 38345 - protein, 9 aa, Artificial Sequence
  Description of Artificial Sequence: Synthetic peptide
  XENP21494 vlCDR3
QQSRKVPWT

SEQ ID NO: 38346 - protein, 123 aa, Artificial Sequence; identical to SEQ ID NO: 36658
  Description of Artificial Sequence: Synthetic polypeptide
  VH of XENP21495

SEQ ID NO: 38347 - protein, 5 aa, Artificial Sequence
  Description of Artificial Sequence: Synthetic peptide
  XENP21495 vhCDR1
RYWMS

SEQ ID NO: 38348 - protein, 17 aa, Artificial Sequence
  Description of Artificial Sequence: Synthetic peptide
  XENP21495 vhCDR2
EINPDSSTINYTPSLKD

SEQ ID NO: 38349 - protein, 14 aa, Artificial Sequence
  Description of Artificial Sequence: Synthetic peptide
  XENP21495 vhCDR3
PNGYYVGTIFPFAY

SEQ ID NO: 38350 - protein, 110 aa, Artificial Sequence
  Description of Artificial Sequence: Synthetic polypeptide
  VL of XENP21495
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 38351 - protein, 14 aa, Artificial Sequence
  Description of Artificial Sequence: Synthetic peptide
  XENP21495 vlCDR1
RSSTGAVTTSNYAN

SEQ ID NO: 38352 - protein, 7 aa, Artificial Sequence
  Description of Artificial Sequence: Synthetic peptide
  XENP21495 vlCDR2
GTNNRAP

SEQ ID NO: 38353 - protein, 9 aa, Artificial Sequence
  Description of Artificial Sequence: Synthetic peptide
  XENP21495 vlCDR3
ALWYSNHWV

SEQ ID NO: 38354 - protein, 118 aa, Artificial Sequence; identical to SEQ ID NO: 20836
  Description of Artificial Sequence: Synthetic polypeptide
  VH of XENP21496

SEQ ID NO: 38355 - protein, 5 aa, Artificial Sequence
  Description of Artificial Sequence: Synthetic peptide
  XENP21496 vhCDR1
SYAVN

SEQ ID NO: 38356 - protein, 16 aa, Artificial Sequence
  Description of Artificial Sequence: Synthetic peptide
  XENP21496 vhCDR2
VIWSGGSTDYNAAFIS

SEQ ID NO: 38357 - protein, 10 aa, Artificial Sequence
  Description of Artificial Sequence: Synthetic peptide
  XENP21496 vhCDR3
LYYRYDGFDY

SEQ ID NO: 38358 - protein, 107 aa, Artificial Sequence; identical to SEQ ID NO: 20841
  Description of Artificial Sequence: Synthetic polypeptide
  VL of XENP21496

SEQ ID NO: 38359 - protein, 11 aa, Artificial Sequence
  Description of Artificial Sequence: Synthetic peptide
  XENP21496 vlCDR1
KASQNVGTHVA

SEQ ID NO: 38360 - protein, 7 aa, Artificial Sequence
  Description of Artificial Sequence: Synthetic peptide
  XENP21496 vlCDR2
SASYRYS

SEQ ID NO: 38361 - protein, 9 aa, Artificial Sequence
  Description of Artificial Sequence: Synthetic peptide
  XENP21496 vlCDR3
QQYNSYPLT

SEQ ID NO: 38362 - protein, 118 aa, Artificial Sequence; identical to SEQ ID NO: 20846
  Description of Artificial Sequence: Synthetic polypeptide
  VH of XENP21501

SEQ ID NO: 38363 - protein, 5 aa, Artificial Sequence
  Description of Artificial Sequence: Synthetic peptide
  XENP21501 vhCDR1
SYAVN

SEQ ID NO: 38364 - protein, 16 aa, Artificial Sequence
  Description of Artificial Sequence: Synthetic peptide
  XENP21501 vhCDR2
VIWSGGSTDYNAAFIS

SEQ ID NO: 38365 - protein, 10 aa, Artificial Sequence
  Description of Artificial Sequence: Synthetic peptide
  XENP21501 vhCDR3
LYYRYDGFDY

SEQ ID NO: 38366 - protein, 107 aa, Artificial Sequence; identical to SEQ ID NO: 20841
  Description of Artificial Sequence: Synthetic polypeptide
  VL of XENP21501

SEQ ID NO: 38367 - protein, 11 aa, Artificial Sequence
  Description of Artificial Sequence: Synthetic peptide
  XENP21501 vlCDR1
KASQNVGTHVA

SEQ ID NO: 38368 - protein, 7 aa, Artificial Sequence
  Description of Artificial Sequence: Synthetic peptide
  XENP21501 vlCDR2
SASYRYS

SEQ ID NO: 38369 - protein, 9 aa, Artificial Sequence
  Description of Artificial Sequence: Synthetic peptide
  XENP21501 vlCDR3
QQYNSYPLT

SEQ ID NO: 38370 - protein, 117 aa, Artificial Sequence; identical to SEQ ID NO: 36688
  Description of Artificial Sequence: Synthetic polypeptide
  VH of XENP21502

SEQ ID NO: 38371 - protein, 5 aa, Artificial Sequence
  Description of Artificial Sequence: Synthetic peptide
  XENP21502 vhCDR1
RYAMS

SEQ ID NO: 38372 - protein, 16 aa, Artificial Sequence
  Description of Artificial Sequence: Synthetic peptide
  XENP21502 vhCDR2
SISSGGSTYYPDSVQG

SEQ ID NO: 38373 - protein, 9 aa, Artificial Sequence
  Description of Artificial Sequence: Synthetic peptide
  XENP21502 vhCDR3
GDYEGYFDY

SEQ ID NO: 38374 - protein, 113 aa, Artificial Sequence; identical to SEQ ID NO: 36693
  Description of Artificial Sequence: Synthetic polypeptide
  VL of XENP21502

SEQ ID NO: 38375 - protein, 17 aa, Artificial Sequence
  Description of Artificial Sequence: Synthetic peptide
  XENP21502 vlCDR1
KSSQSLLNSINQKNYLA

SEQ ID NO: 38376 - protein, 7 aa, Artificial Sequence
  Description of Artificial Sequence: Synthetic peptide
  XENP21502 vlCDR2
FASTRES

SEQ ID NO: 38377 - protein, 9 aa, Artificial Sequence
  Description of Artificial Sequence: Synthetic peptide
  XENP21502 vlCDR3
QQHYSTPLT

SEQ ID NO: 38378 - protein, 447 aa, Artificial Sequence; identical to SEQ ID NO: 23356
  Description of Artificial Sequence: Synthetic polypeptide
  XENP019738 ipilimumab_H3L0-1G6_L1.210_H1.288 Fab-Fc Heavy Chain

SEQ ID NO: 38379 - protein, 118 aa, Artificial Sequence; identical to SEQ ID NO: 139
  Description of Artificial Sequence: Synthetic polypeptide
  VH of XENP019738

SEQ ID NO: 38380 - protein, 5 aa, Artificial Sequence
  Description of Artificial Sequence: Synthetic peptide
  XENP019738 vhCDR1
SYTMH

SEQ ID NO: 38381 - protein, 17 aa, Artificial Sequence
  Description of Artificial Sequence: Synthetic peptide
  XENP019738 vhCDR2
FISYDGNNKYYADSVKG

SEQ ID NO: 38382 - protein, 9 aa, Artificial Sequence
  Description of Artificial Sequence: Synthetic peptide
  XENP019738 vhCDR3
TGWLGPFDY

SEQ ID NO: 38383 - protein, 480 aa, Artificial Sequence; identical to SEQ ID NO: 23381
  Description of Artificial Sequence: Synthetic polypeptide
  XENP019738 ipilimumab_H3L0-1G6_L1.210_H1.288 scFv-Fc Heavy Chain

SEQ ID NO: 38384 - protein, 107 aa, Artificial Sequence; identical to SEQ ID NO: 11359
  Description of Artificial Sequence: Synthetic polypeptide
  VH of XENP019738

SEQ ID NO: 38385 - protein, 122 aa, Artificial Sequence; identical to SEQ ID NO: 11358
  Description of Artificial Sequence: Synthetic polypeptide
  VL of XENP019738

SEQ ID NO: 38386 - protein, 231 aa, Artificial Sequence; identical to SEQ ID NO: 21532
  Description of Artificial Sequence: Synthetic polypeptide
  Fc chain of XENP019738

SEQ ID NO: 38387 - protein, 11 aa, Artificial Sequence
  Description of Artificial Sequence: Synthetic peptide
  XENP019738 vhCDR1
RASQSVGNDVA

SEQ ID NO: 38388 - protein, 7 aa, Artificial Sequence
  Description of Artificial Sequence: Synthetic peptide
  XENP019738 vhCDR2
YASHRYT

SEQ ID NO: 38389 - protein, 9 aa, Artificial Sequence
  Description of Artificial Sequence: Synthetic peptide
  XENP019738 vhCDR3
QQDFSSPRT

SEQ ID NO: 38390 - protein, 5 aa, Artificial Sequence
  Description of Artificial Sequence: Synthetic peptide
  XENP019738 vlCDR1
NYWMN

SEQ ID NO: 38391 - protein, 19 aa, Artificial Sequence
  Description of Artificial Sequence: Synthetic peptide
  XENP019738 vlCDR2
EIRLYSNNYATHYAESVKG

SEQ ID NO: 38392 - protein, 11 aa, Artificial Sequence
  Description of Artificial Sequence: Synthetic peptide
  XENP019738 vlCDR3
YYGNYGGYFDV

SEQ ID NO: 38393 - protein, 215 aa, Artificial Sequence; identical to SEQ ID NO: 2924
  Description of Artificial Sequence: Synthetic polypeptide
  XENP019738 ipilimumab_H3L0-1G6_L1.210_H1.288 Light Chain

SEQ ID NO: 38394 - protein, 108 aa, Artificial Sequence; identical to SEQ ID NO: 23
  Description of Artificial Sequence: Synthetic polypeptide
  VL of XENP019738

SEQ ID NO: 38395 - protein, 12 aa, Artificial Sequence
  Description of Artificial Sequence: Synthetic peptide
  XENP019738 vlCDR1
RASQSVGSSYLA

SEQ ID NO: 38396 - protein, 7 aa, Artificial Sequence
  Description of Artificial Sequence: Synthetic peptide
  XENP019738 vlCDR2
GAFSRAT

SEQ ID NO: 38397 - protein, 9 aa, Artificial Sequence
  Description of Artificial Sequence: Synthetic peptide
  XENP019738 vlCDR3
QQYGSSPWT

SEQ ID NO: 38398 - protein, 447 aa, Artificial Sequence; identical to SEQ ID NO: 23356
  Description of Artificial Sequence: Synthetic polypeptide
  XENP019739 ipilimumab_H3L0-1G6_H1.279_L1.194 Fab-Fc Heavy Chain

SEQ ID NO: 38399 - protein, 118 aa, Artificial Sequence; identical to SEQ ID NO: 139
  Description of Artificial Sequence: Synthetic polypeptide
  VH of XENP019739

SEQ ID NO: 38400 - protein, 5 aa, Artificial Sequence
  Description of Artificial Sequence: Synthetic peptide
  XENP019739 vhCDR1
SYTMH

SEQ ID NO: 38401 - protein, 17 aa, Artificial Sequence
  Description of Artificial Sequence: Synthetic peptide
  XENP019739 vhCDR2
FISYDGNNKYYADSVKG

SEQ ID NO: 38402 - protein, 9 aa, Artificial Sequence
  Description of Artificial Sequence: Synthetic peptide
  XENP019739 vhCDR3
TGWLGPFDY

SEQ ID NO: 38403 - protein, 480 aa, Artificial Sequence; identical to SEQ ID NO: 23401
  Description of Artificial Sequence: Synthetic polypeptide
  XENP019739 ipilimumab_H3L0-1G6_H1.279_L1.194 scFv-Fc Heavy Chain

SEQ ID NO: 38404 - protein, 122 aa, Artificial Sequence; identical to SEQ ID NO: 10908
  Description of Artificial Sequence: Synthetic polypeptide
  VH of XENP019739

SEQ ID NO: 38405 - protein, 107 aa, Artificial Sequence; identical to SEQ ID NO: 10999
  Description of Artificial Sequence: Synthetic polypeptide
  VL of XENP019739

SEQ ID NO: 38406 - protein, 231 aa, Artificial Sequence; identical to SEQ ID NO: 21532
  Description of Artificial Sequence: Synthetic polypeptide
  Fc chain of XENP019739

SEQ ID NO: 38407 - protein, 5 aa, Artificial Sequence
  Description of Artificial Sequence: Synthetic peptide
  XENP019739 vhCDR1
NYWMN

SEQ ID NO: 38408 - protein, 19 aa, Artificial Sequence
  Description of Artificial Sequence: Synthetic peptide
  XENP019739 vhCDR2
EIRLYSNNYATHYAESVKG

SEQ ID NO: 38409 - protein, 11 aa, Artificial Sequence
  Description of Artificial Sequence: Synthetic peptide
  XENP019739 vhCDR3
YYGNYGGYFDV

SEQ ID NO: 38410 - protein, 11 aa, Artificial Sequence
  Description of Artificial Sequence: Synthetic peptide
  XENP019739 vlCDR1
RASQSVGNDVA

SEQ ID NO: 38411 - protein, 7 aa, Artificial Sequence
  Description of Artificial Sequence: Synthetic peptide
  XENP019739 vlCDR2
YASHRYT

SEQ ID NO: 38412 - protein, 9 aa, Artificial Sequence
  Description of Artificial Sequence: Synthetic peptide
  XENP019739 vlCDR3
QQDFSSPRT

SEQ ID NO: 38413 - protein, 215 aa, Artificial Sequence; identical to SEQ ID NO: 2924
  Description of Artificial Sequence: Synthetic polypeptide
  XENP019739 ipilimumab_H3L0-1G6_H1.279_L1.194 Light Chain

SEQ ID NO: 38414 - protein, 108 aa, Artificial Sequence; identical to SEQ ID NO: 23
  Description of Artificial Sequence: Synthetic polypeptide
  VL of XENP019739

SEQ ID NO: 38415 - protein, 12 aa, Artificial Sequence
  Description of Artificial Sequence: Synthetic peptide
  XENP019739 vlCDR1
RASQSVGSSYLA

SEQ ID NO: 38416 - protein, 7 aa, Artificial Sequence
  Description of Artificial Sequence: Synthetic peptide
  XENP019739 vlCDR2
GAFSRAT

SEQ ID NO: 38417 - protein, 9 aa, Artificial Sequence
  Description of Artificial Sequence: Synthetic peptide
  XENP019739 vlCDR3
QQYGSSPWT

SEQ ID NO: 38418 - protein, 447 aa, Artificial Sequence; identical to SEQ ID NO: 23356
  Description of Artificial Sequence: Synthetic polypeptide
  XENP019741 ipilimumab_H3L0-1G6_L1.194_H1.279 Fab-Fc Heavy Chain

SEQ ID NO: 38419 - protein, 118 aa, Artificial Sequence; identical to SEQ ID NO: 139
  Description of Artificial Sequence: Synthetic polypeptide
  VH of XENP019741

SEQ ID NO: 38420 - protein, 5 aa, Artificial Sequence
  Description of Artificial Sequence: Synthetic peptide
  XENP019741 vhCDR1
SYTMH

SEQ ID NO: 38421 - protein, 17 aa, Artificial Sequence
  Description of Artificial Sequence: Synthetic peptide
  XENP019741 vhCDR2
FISYDGNNKYYADSVKG

SEQ ID NO: 38422 - protein, 9 aa, Artificial Sequence
  Description of Artificial Sequence: Synthetic peptide
  XENP019741 vhCDR3
TGWLGPFDY

SEQ ID NO: 38423 - protein, 480 aa, Artificial Sequence; identical to SEQ ID NO: 23221
  Description of Artificial Sequence: Synthetic polypeptide
  XENP019741 ipilimumab_H3L0-1G6_L1.194_H1.279 scFv-Fc Heavy Chain

SEQ ID NO: 38424 - protein, 107 aa, Artificial Sequence; identical to SEQ ID NO: 10999
  Description of Artificial Sequence: Synthetic polypeptide
  VH of XENP019741

SEQ ID NO: 38425 - protein, 122 aa, Artificial Sequence; identical to SEQ ID NO: 10908
  Description of Artificial Sequence: Synthetic polypeptide
  VL of XENP019741

SEQ ID NO: 38426 - protein, 231 aa, Artificial Sequence; identical to SEQ ID NO: 21532
  Description of Artificial Sequence: Synthetic polypeptide
  Fc chain of XENP019741

SEQ ID NO: 38427 - protein, 11 aa, Artificial Sequence
  Description of Artificial Sequence: Synthetic peptide
  XENP019741 vhCDR1
RASQSVGNDVA

SEQ ID NO: 38428 - protein, 7 aa, Artificial Sequence
  Description of Artificial Sequence: Synthetic peptide
  XENP019741 vhCDR2
YASHRYT

SEQ ID NO: 38429 - protein, 9 aa, Artificial Sequence
  Description of Artificial Sequence: Synthetic peptide
  XENP019741 vhCDR3
QQDFSSPRT

SEQ ID NO: 38430 - protein, 5 aa, Artificial Sequence
  Description of Artificial Sequence: Synthetic peptide
  XENP019741 vlCDR1
NYWMN

SEQ ID NO: 38431 - protein, 19 aa, Artificial Sequence
  Description of Artificial Sequence: Synthetic peptide
  XENP019741 vlCDR2
EIRLYSNNYATHYAESVKG

SEQ ID NO: 38432 - protein, 11 aa, Artificial Sequence
  Description of Artificial Sequence: Synthetic peptide
  XENP019741 vlCDR3
YYGNYGGYFDV

SEQ ID NO: 38433 - protein, 215 aa, Artificial Sequence; identical to SEQ ID NO: 2924
  Description of Artificial Sequence: Synthetic polypeptide
  XENP019741 ipilimumab_H3L0-1G6_L1.194_H1.279 Light Chain

SEQ ID NO: 38434 - protein, 108 aa, Artificial Sequence; identical to SEQ ID NO: 23
  Description of Artificial Sequence: Synthetic polypeptide
  VL of XENP019741

SEQ ID NO: 38435 - protein, 12 aa, Artificial Sequence
  Description of Artificial Sequence: Synthetic peptide
  XENP019741 vlCDR1
RASQSVGSSYLA

SEQ ID NO: 38436 - protein, 7 aa, Artificial Sequence
  Description of Artificial Sequence: Synthetic peptide
  XENP019741 vlCDR2
GAFSRAT

SEQ ID NO: 38437 - protein, 9 aa, Artificial Sequence
  Description of Artificial Sequence: Synthetic peptide
  XENP019741 vlCDR3
QQYGSSPWT

SEQ ID NO: 38438 - protein, 447 aa, Artificial Sequence; identical to SEQ ID NO: 23356
  Description of Artificial Sequence: Synthetic polypeptide
  XENP020053 ipilimumab_H3L0.22-1G6_L1.194_H1.279 Fab-Fc Heavy Chain

SEQ ID NO: 38439 - protein, 118 aa, Artificial Sequence; identical to SEQ ID NO: 139
  Description of Artificial Sequence: Synthetic polypeptide
  VH of XENP020053

SEQ ID NO: 38440 - protein, 5 aa, Artificial Sequence
  Description of Artificial Sequence: Synthetic peptide
  XENP020053 vhCDR1
SYTMH

SEQ ID NO: 38441 - protein, 17 aa, Artificial Sequence
  Description of Artificial Sequence: Synthetic peptide
  XENP020053 vhCDR2
FISYDGNNKYYADSVKG

SEQ ID NO: 38442 - protein, 9 aa, Artificial Sequence
  Description of Artificial Sequence: Synthetic peptide
  XENP020053 vhCDR3
TGWLGPFDY

SEQ ID NO: 38443 - protein, 480 aa, Artificial Sequence; identical to SEQ ID NO: 23221
  Description of Artificial Sequence: Synthetic polypeptide
  XENP020053 ipilimumab_H3L0.22-1G6_L1.194_H1.279 scFv-Fc Heavy Chain

SEQ ID NO: 38444 - protein, 107 aa, Artificial Sequence; identical to SEQ ID NO: 10999
  Description of Artificial Sequence: Synthetic polypeptide
  VH of XENP020053

SEQ ID NO: 38445 - protein, 122 aa, Artificial Sequence; identical to SEQ ID NO: 10908
  Description of Artificial Sequence: Synthetic polypeptide
  VL of XENP020053

SEQ ID NO: 38446 - protein, 231 aa, Artificial Sequence; identical to SEQ ID NO: 21532
  Description of Artificial Sequence: Synthetic polypeptide
  Fc chain of XENP020053

SEQ ID NO: 38447 - protein, 11 aa, Artificial Sequence
  Description of Artificial Sequence: Synthetic peptide
  XENP020053 vhCDR1
RASQSVGNDVA

SEQ ID NO: 38448 - protein, 7 aa, Artificial Sequence
  Description of Artificial Sequence: Synthetic peptide
  XENP020053 vhCDR2
YASHRYT

SEQ ID NO: 38449 - protein, 9 aa, Artificial Sequence
  Description of Artificial Sequence: Synthetic peptide
  XENP020053 vhCDR3
QQDFSSPRT

SEQ ID NO: 38450 - protein, 5 aa, Artificial Sequence
  Description of Artificial Sequence: Synthetic peptide
  XENP020053 vlCDR1
NYWMN

SEQ ID NO: 38451 - protein, 19 aa, Artificial Sequence
  Description of Artificial Sequence: Synthetic peptide
  XENP020053 vlCDR2
EIRLYSNNYATHYAESVKG

SEQ ID NO: 38452 - protein, 11 aa, Artificial Sequence
  Description of Artificial Sequence: Synthetic peptide
  XENP020053 vlCDR3
YYGNYGGYFDV

SEQ ID NO: 38453 - protein, 215 aa, Artificial Sequence; identical to SEQ ID NO: 4504
  Description of Artificial Sequence: Synthetic polypeptide
  XENP020053 ipilimumab_H3L0.22-1G6_L1.194_H1.279 Light Chain

SEQ ID NO: 38454 - protein, 108 aa, Artificial Sequence; identical to SEQ ID NO: 1607
  Description of Artificial Sequence: Synthetic polypeptide
  VL of XENP020053

SEQ ID NO: 38455 - protein, 12 aa, Artificial Sequence
  Description of Artificial Sequence: Synthetic peptide
  XENP020053 vlCDR1
RASQSVSSSYLA

SEQ ID NO: 38456 - protein, 7 aa, Artificial Sequence
  Description of Artificial Sequence: Synthetic peptide
  XENP020053 vlCDR2
GAFSRAT

SEQ ID NO: 38457 - protein, 9 aa, Artificial Sequence
  Description of Artificial Sequence: Synthetic peptide
  XENP020053 vlCDR3
QQYGSSPWT

SEQ ID NO: 38458 - protein, 447 aa, Artificial Sequence; identical to SEQ ID NO: 23356
  Description of Artificial Sequence: Synthetic polypeptide
  XENP020066 ipilimumab_H3_L0.22-1G6_H1.279_L1.194 Fab-Fc Heavy Chain

SEQ ID NO: 38459 - protein, 118 aa, Artificial Sequence; identical to SEQ ID NO: 139
  Description of Artificial Sequence: Synthetic polypeptide
  VH of XENP020066

SEQ ID NO: 38460 - protein, 5 aa, Artificial Sequence
  Description of Artificial Sequence: Synthetic peptide
  XENP020066 vhCDR1
SYTMH

SEQ ID NO: 38461 - protein, 17 aa, Artificial Sequence
  Description of Artificial Sequence: Synthetic peptide
  XENP020066 vhCDR2
FISYDGNNKYYADSVKG

SEQ ID NO: 38462 - protein, 9 aa, Artificial Sequence
  Description of Artificial Sequence: Synthetic peptide
  XENP020066 vhCDR3
TGWLGPFDY

SEQ ID NO: 38463 - protein, 480 aa, Artificial Sequence; identical to SEQ ID NO: 23401
  Description of Artificial Sequence: Synthetic polypeptide
  XENP020066 ipilimumab_H3_L0.22-1G6_H1.279_L1.194 scFv-Fc Heavy Chain

SEQ ID NO: 38464 - protein, 122 aa, Artificial Sequence; identical to SEQ ID NO: 10908
  Description of Artificial Sequence: Synthetic polypeptide
  VH of XENP020066

SEQ ID NO: 38465 - protein, 107 aa, Artificial Sequence; identical to SEQ ID NO: 10999
  Description of Artificial Sequence: Synthetic polypeptide
  VL of XENP020066

SEQ ID NO: 38466 - protein, 231 aa, Artificial Sequence; identical to SEQ ID NO: 21532
  Description of Artificial Sequence: Synthetic polypeptide
  Fc chain of XENP020066

SEQ ID NO: 38467 - protein, 5 aa, Artificial Sequence
  Description of Artificial Sequence: Synthetic peptide
  XENP020066 vhCDR1
NYWMN

SEQ ID NO: 38468 - protein, 19 aa, Artificial Sequence
  Description of Artificial Sequence: Synthetic peptide
  XENP020066 vhCDR2
EIRLYSNNYATHYAESVKG

SEQ ID NO: 38469 - protein, 11 aa, Artificial Sequence
  Description of Artificial Sequence: Synthetic peptide
  XENP020066 vhCDR3
YYGNYGGYFDV

SEQ ID NO: 38470 - protein, 11 aa, Artificial Sequence
  Description of Artificial Sequence: Synthetic peptide
  XENP020066 vlCDR1
RASQSVGNDVA

SEQ ID NO: 38471 - protein, 7 aa, Artificial Sequence
  Description of Artificial Sequence: Synthetic peptide
  XENP020066 vlCDR2
YASHRYT

SEQ ID NO: 38472 - protein, 9 aa, Artificial Sequence
  Description of Artificial Sequence: Synthetic peptide
  XENP020066 vlCDR3
QQDFSSPRT

SEQ ID NO: 38473 - protein, 215 aa, Artificial Sequence; identical to SEQ ID NO: 4504
  Description of Artificial Sequence: Synthetic polypeptide
  XENP020066 ipilimumab_H3_L0.22-1G6_H1.279_L1.194 Light Chain

SEQ ID NO: 38474 - protein, 108 aa, Artificial Sequence; identical to SEQ ID NO: 1607
  Description of Artificial Sequence: Synthetic polypeptide
  VL of XENP020066

SEQ ID NO: 38475 - protein, 12 aa, Artificial Sequence
  Description of Artificial Sequence: Synthetic peptide
  XENP020066 vlCDR1
RASQSVSSSYLA

SEQ ID NO: 38476 - protein, 7 aa, Artificial Sequence
  Description of Artificial Sequence: Synthetic peptide
  XENP020066 vlCDR2
GAFSRAT

SEQ ID NO: 38477 - protein, 9 aa, Artificial Sequence
  Description of Artificial Sequence: Synthetic peptide
  XENP020066 vlCDR3
QQYGSSPWT

SEQ ID NO: 38478 - protein, 447 aa, Artificial Sequence; identical to SEQ ID NO: 23356
  Description of Artificial Sequence: Synthetic polypeptide
  XENP020130 ipilimumab_H3_L0.22-1G6_L1.210_H1.288 Fab-Fc Heavy Chain

SEQ ID NO: 38479 - protein, 118 aa, Artificial Sequence; identical to SEQ ID NO: 139
  Description of Artificial Sequence: Synthetic polypeptide
  VH of XENP020130

SEQ ID NO: 38480 - protein, 5 aa, Artificial Sequence
  Description of Artificial Sequence: Synthetic peptide
  XENP020130 vhCDR1
SYTMH

SEQ ID NO: 38481 - protein, 17 aa, Artificial Sequence
  Description of Artificial Sequence: Synthetic peptide
  XENP020130 vhCDR2
FISYDGNNKYYADSVKG

SEQ ID NO: 38482 - protein, 9 aa, Artificial Sequence
  Description of Artificial Sequence: Synthetic peptide
  XENP020130 vhCDR3
TGWLGPFDY

SEQ ID NO: 38483 - protein, 480 aa, Artificial Sequence; identical to SEQ ID NO: 23381
  Description of Artificial Sequence: Synthetic polypeptide
  XENP020130 ipilimumab_H3_L0.22-1G6_L1.210_H1.288 scFv-Fc Heavy Chain

SEQ ID NO: 38484 - protein, 107 aa, Artificial Sequence; identical to SEQ ID NO: 11359
  Description of Artificial Sequence: Synthetic polypeptide
  VH of XENP020130

SEQ ID NO: 38485 - protein, 122 aa, Artificial Sequence; identical to SEQ ID NO: 11358
  Description of Artificial Sequence: Synthetic polypeptide
  VL of XENP020130

SEQ ID NO: 38486 - protein, 231 aa, Artificial Sequence; identical to SEQ ID NO: 21532
  Description of Artificial Sequence: Synthetic polypeptide
  Fc chain of XENP020130

SEQ ID NO: 38487 - protein, 11 aa, Artificial Sequence
  Description of Artificial Sequence: Synthetic peptide
  XENP020130 vhCDR1
RASQSVGNDVA

SEQ ID NO: 38488 - protein, 7 aa, Artificial Sequence
  Description of Artificial Sequence: Synthetic peptide
  XENP020130 vhCDR2
YASHRYT

SEQ ID NO: 38489 - protein, 9 aa, Artificial Sequence
  Description of Artificial Sequence: Synthetic peptide
  XENP020130 vhCDR3
QQDFSSPRT

SEQ ID NO: 38490 - protein, 5 aa, Artificial Sequence
  Description of Artificial Sequence: Synthetic peptide
  XENP020130 vlCDR1
NYWMN

SEQ ID NO: 38491 - protein, 19 aa, Artificial Sequence
  Description of Artificial Sequence: Synthetic peptide
  XENP020130 vlCDR2
EIRLYSNNYATHYAESVKG

SEQ ID NO: 38492 - protein, 11 aa, Artificial Sequence
  Description of Artificial Sequence: Synthetic peptide
  XENP020130 vlCDR3
YYGNYGGYFDV

SEQ ID NO: 38493 - protein, 215 aa, Artificial Sequence; identical to SEQ ID NO: 4504
  Description of Artificial Sequence: Synthetic polypeptide
  XENP020130 ipilimumab_H3_L0.22-1G6_L1.210_H1.288 Light Chain

SEQ ID NO: 38494 - protein, 108 aa, Artificial Sequence; identical to SEQ ID NO: 1607
  Description of Artificial Sequence: Synthetic polypeptide
  VL of XENP020130

SEQ ID NO: 38495 - protein, 12 aa, Artificial Sequence
  Description of Artificial Sequence: Synthetic peptide
  XENP020130 vlCDR1
RASQSVSSSYLA

SEQ ID NO: 38496 - protein, 7 aa, Artificial Sequence
  Description of Artificial Sequence: Synthetic peptide
  XENP020130 vlCDR2
GAFSRAT

SEQ ID NO: 38497 - protein, 9 aa, Artificial Sequence
  Description of Artificial Sequence: Synthetic peptide
  XENP020130 vlCDR3
QQYGSSPWT

SEQ ID NO: 38498 - protein, 447 aa, Artificial Sequence; identical to SEQ ID NO: 23356
  Description of Artificial Sequence: Synthetic polypeptide
  XENP020146 ipilimumab_H3_L0.22-1G6_H1.280_L1.224 Fab-Fc Heavy Chain

SEQ ID NO: 38499 - protein, 118 aa, Artificial Sequence; identical to SEQ ID NO: 139
  Description of Artificial Sequence: Synthetic polypeptide
  VH of XENP020146

SEQ ID NO: 38500 - protein, 5 aa, Artificial Sequence
  Description of Artificial Sequence: Synthetic peptide
  XENP020146 vhCDR1
SYTMH

SEQ ID NO: 38501 - protein, 17 aa, Artificial Sequence
  Description of Artificial Sequence: Synthetic peptide
  XENP020146 vhCDR2
FISYDGNNKYYADSVKG

SEQ ID NO: 38502 - protein, 9 aa, Artificial Sequence
  Description of Artificial Sequence: Synthetic peptide
  XENP020146 vhCDR3
TGWLGPFDY

SEQ ID NO: 38503 - protein, 480 aa, Artificial Sequence; identical to SEQ ID NO: 22809
  Description of Artificial Sequence: Synthetic polypeptide
  XENP020146 ipilimumab_H3_L0.22-1G6_H1.280_L1.224 scFv-Fc Heavy Chain

SEQ ID NO: 38504 - protein, 122 aa, Artificial Sequence; identical to SEQ ID NO: 10917
  Description of Artificial Sequence: Synthetic polypeptide
  VH of XENP020146

SEQ ID NO: 38505 - protein, 107 aa, Artificial Sequence; identical to SEQ ID NO: 22811
  Description of Artificial Sequence: Synthetic polypeptide
  VL of XENP020146

SEQ ID NO: 38506 - protein, 231 aa, Artificial Sequence; identical to SEQ ID NO: 21532
  Description of Artificial Sequence: Synthetic polypeptide
  Fc chain of XENP020146

SEQ ID NO: 38507 - protein, 5 aa, Artificial Sequence
  Description of Artificial Sequence: Synthetic peptide
  XENP020146 vhCDR1
NYWMN

SEQ ID NO: 38508 - protein, 19 aa, Artificial Sequence
  Description of Artificial Sequence: Synthetic peptide
  XENP020146 vhCDR2
EIRLYSNNYATHYAESVKG

SEQ ID NO: 38509 - protein, 11 aa, Artificial Sequence
  Description of Artificial Sequence: Synthetic peptide
  XENP020146 vhCDR3
YYGNYGGYFDV

SEQ ID NO: 38510 - protein, 11 aa, Artificial Sequence
  Description of Artificial Sequence: Synthetic peptide
  XENP020146 vlCDR1
RASQSVGNDVA

SEQ ID NO: 38511 - protein, 7 aa, Artificial Sequence
  Description of Artificial Sequence: Synthetic peptide
  XENP020146 vlCDR2
YASHRYT

SEQ ID NO: 38512 - protein, 9 aa, Artificial Sequence
  Description of Artificial Sequence: Synthetic peptide
  XENP020146 vlCDR3
QQDWSSPRT

SEQ ID NO: 38513 - protein, 215 aa, Artificial Sequence; identical to SEQ ID NO: 4504
  Description of Artificial Sequence: Synthetic polypeptide
  XENP020146 ipilimumab_H3_L0.22-1G6_H1.280_L1.224 Light Chain

SEQ ID NO: 38514 - protein, 108 aa, Artificial Sequence; identical to SEQ ID NO: 1607
  Description of Artificial Sequence: Synthetic polypeptide
  VL of XENP020146

SEQ ID NO: 38515 - protein, 12 aa, Artificial Sequence
  Description of Artificial Sequence: Synthetic peptide
  XENP020146 vlCDR1
RASQSVSSSYLA

SEQ ID NO: 38516 - protein, 7 aa, Artificial Sequence
  Description of Artificial Sequence: Synthetic peptide
  XENP020146 vlCDR2
GAFSRAT

SEQ ID NO: 38517 - protein, 9 aa, Artificial Sequence
  Description of Artificial Sequence: Synthetic peptide
  XENP020146 vlCDR3
QQYGSSPWT

SEQ ID NO: 38518 - protein, 447 aa, Artificial Sequence; identical to SEQ ID NO: 23556
  Description of Artificial Sequence: Synthetic polypeptide
  XENP020717 ipilimumab_H3_L0.22-1G6_L1.194_H1.279 M428L/N434S Fab-Fc Heavy Chain

SEQ ID NO: 38519 - protein, 118 aa, Artificial Sequence; identical to SEQ ID NO: 139
  Description of Artificial Sequence: Synthetic polypeptide
  VH of XENP020717

SEQ ID NO: 38520 - protein, 5 aa, Artificial Sequence
  Description of Artificial Sequence: Synthetic peptide
  XENP020717 vhCDR1
SYTMH

SEQ ID NO: 38521 - protein, 17 aa, Artificial Sequence
  Description of Artificial Sequence: Synthetic peptide
  XENP020717 vhCDR2
FISYDGNNKYYADSVKG

SEQ ID NO: 38522 - protein, 9 aa, Artificial Sequence
  Description of Artificial Sequence: Synthetic peptide
  XENP020717 vhCDR3
TGWLGPFDY

SEQ ID NO: 38523 - protein, 480 aa, Artificial Sequence; identical to SEQ ID NO: 23581
  Description of Artificial Sequence: Synthetic polypeptide
  XENP020717 ipilimumab_H3_L0.22-1G6_L1.194_H1.279 M428L/N434S scFv-Fc Heavy Chain

SEQ ID NO: 38524 - protein, 107 aa, Artificial Sequence; identical to SEQ ID NO: 10999
  Description of Artificial Sequence: Synthetic polypeptide
  VH of XENP020717

SEQ ID NO: 38525 - protein, 122 aa, Artificial Sequence; identical to SEQ ID NO: 10908
  Description of Artificial Sequence: Synthetic polypeptide
  VL of XENP020717

SEQ ID NO: 38526 - protein, 231 aa, Artificial Sequence; identical to SEQ ID NO: 21572
  Description of Artificial Sequence: Synthetic polypeptide
  Fc chain of XENP020717

SEQ ID NO: 38527 - protein, 11 aa, Artificial Sequence
  Description of Artificial Sequence: Synthetic peptide
  XENP020717 vhCDR1
RASQSVGNDVA

SEQ ID NO: 38528 - protein, 7 aa, Artificial Sequence
  Description of Artificial Sequence: Synthetic peptide
  XENP020717 vhCDR2
YASHRYT

SEQ ID NO: 38529 - protein, 9 aa, Artificial Sequence
  Description of Artificial Sequence: Synthetic peptide
  XENP020717 vhCDR3
QQDFSSPRT

SEQ ID NO: 38530 - protein, 5 aa, Artificial Sequence
  Description of Artificial Sequence: Synthetic peptide
  XENP020717 vlCDR1
NYWMN

SEQ ID NO: 38531 - protein, 19 aa, Artificial Sequence
  Description of Artificial Sequence: Synthetic peptide
  XENP020717 vlCDR2
EIRLYSNNYATHYAESVKG

SEQ ID NO: 38532 - protein, 11 aa, Artificial Sequence
  Description of Artificial Sequence: Synthetic peptide
  XENP020717 vlCDR3
YYGNYGGYFDV

SEQ ID NO: 38533 - protein, 215 aa, Artificial Sequence; identical to SEQ ID NO: 4504
  Description of Artificial Sequence: Synthetic polypeptide
  XENP020717 ipilimumab_H3_L0.22-1G6_L1.194_H1.279 M428L/N434S Light Chain

SEQ ID NO: 38534 - protein, 108 aa, Artificial Sequence; identical to SEQ ID NO: 1607
  Description of Artificial Sequence: Synthetic polypeptide
  VL of XENP020717

SEQ ID NO: 38535 - protein, 12 aa, Artificial Sequence
  Description of Artificial Sequence: Synthetic peptide
  XENP020717 vlCDR1
RASQSVSSSYLA

SEQ ID NO: 38536 - protein, 7 aa, Artificial Sequence
  Description of Artificial Sequence: Synthetic peptide
  XENP020717 vlCDR2
GAFSRAT

SEQ ID NO: 38537 - protein, 9 aa, Artificial Sequence
  Description of Artificial Sequence: Synthetic peptide
  XENP020717 vlCDR3
QQYGSSPWT

SEQ ID NO: 38538 - protein, 449 aa, Artificial Sequence; identical to SEQ ID NO: 36247
  Description of Artificial Sequence: Synthetic polypeptide
  XENP022836 2E9_H1L1_Fab-[CTLA-4]_H3.23_L0.129_scFv HC-Fab

SEQ ID NO: 38539 - protein, 120 aa, Artificial Sequence; identical to SEQ ID NO: 11412
  Description of Artificial Sequence: Synthetic polypeptide
  VH of XENP022836

SEQ ID NO: 38540 - protein, 5 aa, Artificial Sequence
  Description of Artificial Sequence: Synthetic peptide
  XENP022836 vhCDR1
NYWLG

SEQ ID NO: 38541 - protein, 17 aa, Artificial Sequence
  Description of Artificial Sequence: Synthetic peptide
  XENP022836 vhCDR2
NFYPGSSNTYYNEKFQG

SEQ ID NO: 38542 - protein, 11 aa, Artificial Sequence
  Description of Artificial Sequence: Synthetic peptide
  XENP022836 vhCDR3
HYGTNYRYFDV

SEQ ID NO: 38543 - protein, 477 aa, Artificial Sequence; identical to SEQ ID NO: 21669
  Description of Artificial Sequence: Synthetic polypeptide
  XENP022836 2E9_H1L1_Fab-[CTLA-4]_H3.23_L0.129_scFv HC-scFV

SEQ ID NO: 38544 - protein, 118 aa, Artificial Sequence; identical to SEQ ID NO: 2632
  Description of Artificial Sequence: Synthetic polypeptide
  VH of XENP022836

SEQ ID NO: 38545 - protein, 108 aa, Artificial Sequence; identical to SEQ ID NO: 2768
  Description of Artificial Sequence: Synthetic polypeptide
  VL of XENP022836

SEQ ID NO: 38546 - protein, 231 aa, Artificial Sequence; identical to SEQ ID NO: 21532
  Description of Artificial Sequence: Synthetic polypeptide
  Fc chain of XENP022836

SEQ ID NO: 38547 - protein, 5 aa, Artificial Sequence
  Description of Artificial Sequence: Synthetic peptide
  XENP022836 vhCDR1
SYTMH

SEQ ID NO: 38548 - protein, 17 aa, Artificial Sequence
  Description of Artificial Sequence: Synthetic peptide
  XENP022836 vhCDR2
FISYDGNYKYYADSVKG

SEQ ID NO: 38549 - protein, 9 aa, Artificial Sequence
  Description of Artificial Sequence: Synthetic peptide
  XENP022836 vhCDR3
GGHLGPFDL

SEQ ID NO: 38550 - protein, 12 aa, Artificial Sequence
  Description of Artificial Sequence: Synthetic peptide
  XENP022836 vlCDR1
RASQSVGSSYLA

SEQ ID NO: 38551 - protein, 7 aa, Artificial Sequence
  Description of Artificial Sequence: Synthetic peptide
  XENP022836 vlCDR2
GASSRAT

SEQ ID NO: 38552 - protein, 9 aa, Artificial Sequence
  Description of Artificial Sequence: Synthetic peptide
  XENP022836 vlCDR3
QQYGSSPWT

SEQ ID NO: 38553 - protein, 214 aa, Artificial Sequence; identical to SEQ ID NO: 17080
  Description of Artificial Sequence: Synthetic polypeptide
  XENP022836 2E9_H1L1_Fab-[CTLA-4]_H3.23_L0.129_scFv Light Chain

SEQ ID NO: 38554 - protein, 107 aa, Artificial Sequence; identical to SEQ ID NO: 11413
  Description of Artificial Sequence: Synthetic polypeptide
  VL of XENP022836

SEQ ID NO: 38555 - protein, 11 aa, Artificial Sequence
  Description of Artificial Sequence: Synthetic peptide
  XENP022836 vlCDR1
RASQSVSNDVA

SEQ ID NO: 38556 - protein, 7 aa, Artificial Sequence
  Description of Artificial Sequence: Synthetic peptide
  XENP022836 vlCDR2
YASNRYT

SEQ ID NO: 38557 - protein, 9 aa, Artificial Sequence
  Description of Artificial Sequence: Synthetic peptide
  XENP022836 vlCDR3
QQDYSSPYT

SEQ ID NO: 38558 - protein, 447 aa, Artificial Sequence; identical to SEQ ID NO: 17235
  Description of Artificial Sequence: Synthetic polypeptide
  XENP020206 2A11_H1L2-1G6_L1.194_H1.279 Fab-Fc Heavy Chain

SEQ ID NO: 38559 - protein, 118 aa, Artificial Sequence; identical to SEQ ID NO: 17236
  Description of Artificial Sequence: Synthetic polypeptide
  VH of XENP020206

SEQ ID NO: 38560 - protein, 5 aa, Artificial Sequence
  Description of Artificial Sequence: Synthetic peptide
  XENP020206 vhCDR1
DYYMH

SEQ ID NO: 38561 - protein, 17 aa, Artificial Sequence
  Description of Artificial Sequence: Synthetic peptide
  XENP020206 vhCDR2
WIDPENGDTEYAPKFQG

SEQ ID NO: 38562 - protein, 9 aa, Artificial Sequence
  Description of Artificial Sequence: Synthetic peptide
  XENP020206 vhCDR3
RGVRQALDY

SEQ ID NO: 38563 - protein, 480 aa, Artificial Sequence; identical to SEQ ID NO: 23221
  Description of Artificial Sequence: Synthetic polypeptide
  XENP020206 2A11_H1L2-1G6_L1.194_H1.279 scFv-Fc Heavy Chain

SEQ ID NO: 38564 - protein, 107 aa, Artificial Sequence; identical to SEQ ID NO: 10999
  Description of Artificial Sequence: Synthetic polypeptide
  VH of XENP020206

SEQ ID NO: 38565 - protein, 122 aa, Artificial Sequence; identical to SEQ ID NO: 10908
  Description of Artificial Sequence: Synthetic polypeptide
  VL of XENP020206

SEQ ID NO: 38566 - protein, 231 aa, Artificial Sequence; identical to SEQ ID NO: 21532
  Description of Artificial Sequence: Synthetic polypeptide
  Fc chain of XENP020206

SEQ ID NO: 38567 - protein, 11 aa, Artificial Sequence
  Description of Artificial Sequence: Synthetic peptide
  XENP020206 vhCDR1
RASQSVGNDVA

SEQ ID NO: 38568 - protein, 7 aa, Artificial Sequence
  Description of Artificial Sequence: Synthetic peptide
  XENP020206 vhCDR2
YASHRYT

SEQ ID NO: 38569 - protein, 9 aa, Artificial Sequence
  Description of Artificial Sequence: Synthetic peptide
  XENP020206 vhCDR3
QQDFSSPRT

SEQ ID NO: 38570 - protein, 5 aa, Artificial Sequence
  Description of Artificial Sequence: Synthetic peptide
  XENP020206 vlCDR1
NYWMN

SEQ ID NO: 38571 - protein, 19 aa, Artificial Sequence
  Description of Artificial Sequence: Synthetic peptide
  XENP020206 vlCDR2
EIRLYSNNYATHYAESVKG

SEQ ID NO: 38572 - protein, 11 aa, Artificial Sequence
  Description of Artificial Sequence: Synthetic peptide
  XENP020206 vlCDR3
YYGNYGGYFDV

SEQ ID NO: 38573 - protein, 214 aa, Artificial Sequence; identical to SEQ ID NO: 17250
  Description of Artificial Sequence: Synthetic polypeptide
  XENP020206 2A11_H1L2-1G6_L1.194_H1.279 Light Chain

SEQ ID NO: 38574 - protein, 107 aa, Artificial Sequence; identical to SEQ ID NO: 17251
  Description of Artificial Sequence: Synthetic polypeptide
  VL of XENP020206

SEQ ID NO: 38575 - protein, 11 aa, Artificial Sequence
  Description of Artificial Sequence: Synthetic peptide
  XENP020206 vlCDR1
QASQDIGNYLN

SEQ ID NO: 38576 - protein, 7 aa, Artificial Sequence
  Description of Artificial Sequence: Synthetic peptide
  XENP020206 vlCDR2
YTSRLHS

SEQ ID NO: 38577 - protein, 9 aa, Artificial Sequence
  Description of Artificial Sequence: Synthetic peptide
  XENP020206 vlCDR3
QQGNTLPYT

SEQ ID NO: 38578 - protein, 447 aa, Artificial Sequence; identical to SEQ ID NO: 17235
  Description of Artificial Sequence: Synthetic polypeptide
  XENP021582 2A11_H1_L2.91_Fab-1G6_L1.194_H1.279 Fab-Fc Heavy Chain

SEQ ID NO: 38579 - protein, 118 aa, Artificial Sequence; identical to SEQ ID NO: 17236
  Description of Artificial Sequence: Synthetic polypeptide
  VH of XENP021582

SEQ ID NO: 38580 - protein, 5 aa, Artificial Sequence
  Description of Artificial Sequence: Synthetic peptide
  XENP021582 vhCDR1
DYYMH

SEQ ID NO: 38581 - protein, 17 aa, Artificial Sequence
  Description of Artificial Sequence: Synthetic peptide
  XENP021582 vhCDR2
WIDPENGDTEYAPKFQG

SEQ ID NO: 38582 - protein, 9 aa, Artificial Sequence
  Description of Artificial Sequence: Synthetic peptide
  XENP021582 vhCDR3
RGVRQALDY

SEQ ID NO: 38583 - protein, 480 aa, Artificial Sequence; identical to SEQ ID NO: 23221
  Description of Artificial Sequence: Synthetic polypeptide
  XENP021582 2A11_H1_L2.91_Fab-1G6_L1.194_H1.279 scFv-Fc Heavy Chain

SEQ ID NO: 38584 - protein, 107 aa, Artificial Sequence; identical to SEQ ID NO: 10999
  Description of Artificial Sequence: Synthetic polypeptide
  VH of XENP021582

SEQ ID NO: 38585 - protein, 122 aa, Artificial Sequence; identical to SEQ ID NO: 10908
  Description of Artificial Sequence: Synthetic polypeptide
  VL of XENP021582

SEQ ID NO: 38586 - protein, 231 aa, Artificial Sequence; identical to SEQ ID NO: 21532
  Description of Artificial Sequence: Synthetic polypeptide
  Fc chain of XENP021582

SEQ ID NO: 38587 - protein, 11 aa, Artificial Sequence
  Description of Artificial Sequence: Synthetic peptide
  XENP021582 vhCDR1
RASQSVGNDVA

SEQ ID NO: 38588 - protein, 7 aa, Artificial Sequence
  Description of Artificial Sequence: Synthetic peptide
  XENP021582 vhCDR2
YASHRYT

SEQ ID NO: 38589 - protein, 9 aa, Artificial Sequence
  Description of Artificial Sequence: Synthetic peptide
  XENP021582 vhCDR3
QQDFSSPRT

SEQ ID NO: 38590 - protein, 5 aa, Artificial Sequence
  Description of Artificial Sequence: Synthetic peptide
  XENP021582 vlCDR1
NYWMN

SEQ ID NO: 38591 - protein, 19 aa, Artificial Sequence
  Description of Artificial Sequence: Synthetic peptide
  XENP021582 vlCDR2
EIRLYSNNYATHYAESVKG

SEQ ID NO: 38592 - protein, 11 aa, Artificial Sequence
  Description of Artificial Sequence: Synthetic peptide
  XENP021582 vlCDR3
YYGNYGGYFDV

SEQ ID NO: 38593 - protein, 214 aa, Artificial Sequence; identical to SEQ ID NO: 24470
  Description of Artificial Sequence: Synthetic polypeptide
  XENP021582 2A11_H1_L2.91_Fab-1G6_L1.194_H1.279 Light Chain

SEQ ID NO: 38594 - protein, 107 aa, Artificial Sequence; identical to SEQ ID NO: 24471
  Description of Artificial Sequence: Synthetic polypeptide
  VL of XENP021582

SEQ ID NO: 38595 - protein, 11 aa, Artificial Sequence
  Description of Artificial Sequence: Synthetic peptide
  XENP021582 vlCDR1
QASQDIGNYLN

SEQ ID NO: 38596 - protein, 7 aa, Artificial Sequence
  Description of Artificial Sequence: Synthetic peptide
  XENP021582 vlCDR2
YTSRLHS

SEQ ID NO: 38597 - protein, 9 aa, Artificial Sequence
  Description of Artificial Sequence: Synthetic peptide
  XENP021582 vlCDR3
QQGNTLPYT

SEQ ID NO: 38598 - protein, 447 aa, Artificial Sequence; identical to SEQ ID NO: 17235
  Description of Artificial Sequence: Synthetic polypeptide
  XENP021584 2A11_H1_L2.93_Fab-1G6_L1.194_H1.279 Fab-Fc Heavy Chain

SEQ ID NO: 38599 - protein, 118 aa, Artificial Sequence; identical to SEQ ID NO: 17236
  Description of Artificial Sequence: Synthetic polypeptide
  VH of XENP021584

SEQ ID NO: 38600 - protein, 5 aa, Artificial Sequence
  Description of Artificial Sequence: Synthetic peptide
  XENP021584 vhCDR1
DYYMH

SEQ ID NO: 38601 - protein, 17 aa, Artificial Sequence
  Description of Artificial Sequence: Synthetic peptide
  XENP021584 vhCDR2
WIDPENGDTEYAPKFQG

SEQ ID NO: 38602 - protein, 9 aa, Artificial Sequence
  Description of Artificial Sequence: Synthetic peptide
  XENP021584 vhCDR3
RGVRQALDY

SEQ ID NO: 38603 - protein, 480 aa, Artificial Sequence; identical to SEQ ID NO: 23221
  Description of Artificial Sequence: Synthetic polypeptide
  XENP021584 2A11_H1_L2.93_Fab-1G6_L1.194_H1.279 scFv-Fc Heavy Chain

SEQ ID NO: 38604 - protein, 107 aa, Artificial Sequence; identical to SEQ ID NO: 10999
  Description of Artificial Sequence: Synthetic polypeptide
  VH of XENP021584

SEQ ID NO: 38605 - protein, 122 aa, Artificial Sequence; identical to SEQ ID NO: 10908
  Description of Artificial Sequence: Synthetic polypeptide
  VL of XENP021584

SEQ ID NO: 38606 - protein, 231 aa, Artificial Sequence; identical to SEQ ID NO: 21532
  Description of Artificial Sequence: Synthetic polypeptide
  Fc chain of XENP021584

SEQ ID NO: 38607 - protein, 11 aa, Artificial Sequence
  Description of Artificial Sequence: Synthetic peptide
  XENP021584 vhCDR1
RASQSVGNDVA

SEQ ID NO: 38608 - protein, 7 aa, Artificial Sequence
  Description of Artificial Sequence: Synthetic peptide
  XENP021584 vhCDR2
YASHRYT

SEQ ID NO: 38609 - protein, 9 aa, Artificial Sequence
  Description of Artificial Sequence: Synthetic peptide
  XENP021584 vhCDR3
QQDFSSPRT

SEQ ID NO: 38610 - protein, 5 aa, Artificial Sequence
  Description of Artificial Sequence: Synthetic peptide
  XENP021584 vlCDR1
NYWMN

SEQ ID NO: 38611 - protein, 19 aa, Artificial Sequence
  Description of Artificial Sequence: Synthetic peptide
  XENP021584 vlCDR2
EIRLYSNNYATHYAESVKG

SEQ ID NO: 38612 - protein, 11 aa, Artificial Sequence
  Description of Artificial Sequence: Synthetic peptide
  XENP021584 vlCDR3
YYGNYGGYFDV

SEQ ID NO: 38613 - protein, 214 aa, Artificial Sequence; identical to SEQ ID NO: 24510
  Description of Artificial Sequence: Synthetic polypeptide
  XENP021584 2A11_H1_L2.93_Fab-1G6_L1.194_H1.279 Light Chain

SEQ ID NO: 38614 - protein, 107 aa, Artificial Sequence; identical to SEQ ID NO: 24511
  Description of Artificial Sequence: Synthetic polypeptide
  VL of XENP021584

SEQ ID NO: 38615 - protein, 11 aa, Artificial Sequence
  Description of Artificial Sequence: Synthetic peptide
  XENP021584 vlCDR1
QASQDIGNYLN

SEQ ID NO: 38616 - protein, 7 aa, Artificial Sequence
  Description of Artificial Sequence: Synthetic peptide
  XENP021584 vlCDR2
YTSRLHS

SEQ ID NO: 38617 - protein, 9 aa, Artificial Sequence
  Description of Artificial Sequence: Synthetic peptide
  XENP021584 vlCDR3
QQGNTLPYT

SEQ ID NO: 38618 - protein, 447 aa, Artificial Sequence; identical to SEQ ID NO: 17235
  Description of Artificial Sequence: Synthetic polypeptide
  XENP021588 2A11_H1_L2.97_Fab-1G6_L1.194_H1.279 Fab-Fc Heavy Chain

SEQ ID NO: 38619 - protein, 118 aa, Artificial Sequence; identical to SEQ ID NO: 17236
  Description of Artificial Sequence: Synthetic polypeptide
  VH of XENP021588

SEQ ID NO: 38620 - protein, 5 aa, Artificial Sequence
  Description of Artificial Sequence: Synthetic peptide
  XENP021588 vhCDR1
DYYMH

SEQ ID NO: 38621 - protein, 17 aa, Artificial Sequence
  Description of Artificial Sequence: Synthetic peptide
  XENP021588 vhCDR2
WIDPENGDTEYAPKFQG

SEQ ID NO: 38622 - protein, 9 aa, Artificial Sequence
  Description of Artificial Sequence: Synthetic peptide
  XENP021588 vhCDR3
RGVRQALDY

SEQ ID NO: 38623 - protein, 480 aa, Artificial Sequence; identical to SEQ ID NO: 23221
  Description of Artificial Sequence: Synthetic polypeptide
  XENP021588 2A11_H1_L2.97_Fab-1G6_L1.194_H1.279 scFv-Fc Heavy Chain

SEQ ID NO: 38624 - protein, 107 aa, Artificial Sequence; identical to SEQ ID NO: 10999
  Description of Artificial Sequence: Synthetic polypeptide
  VH of XENP021588

SEQ ID NO: 38625 - protein, 122 aa, Artificial Sequence; identical to SEQ ID NO: 10908
  Description of Artificial Sequence: Synthetic polypeptide
  VL of XENP021588

SEQ ID NO: 38626 - protein, 231 aa, Artificial Sequence; identical to SEQ ID NO: 21532
  Description of Artificial Sequence: Synthetic polypeptide
  Fc chain of XENP021588

SEQ ID NO: 38627 - protein, 11 aa, Artificial Sequence
  Description of Artificial Sequence: Synthetic peptide
  XENP021588 vhCDR1
RASQSVGNDVA

SEQ ID NO: 38628 - protein, 7 aa, Artificial Sequence
  Description of Artificial Sequence: Synthetic peptide
  XENP021588 vhCDR2
YASHRYT

SEQ ID NO: 38629 - protein, 9 aa, Artificial Sequence
  Description of Artificial Sequence: Synthetic peptide
  XENP021588 vhCDR3
QQDFSSPRT

SEQ ID NO: 38630 - protein, 5 aa, Artificial Sequence
  Description of Artificial Sequence: Synthetic peptide
  XENP021588 vlCDR1
NYWMN

SEQ ID NO: 38631 - protein, 19 aa, Artificial Sequence
  Description of Artificial Sequence: Synthetic peptide
  XENP021588 vlCDR2
EIRLYSNNYATHYAESVKG

SEQ ID NO: 38632 - protein, 11 aa, Artificial Sequence
  Description of Artificial Sequence: Synthetic peptide
  XENP021588 vlCDR3
YYGNYGGYFDV

SEQ ID NO: 38633 - protein, 214 aa, Artificial Sequence; identical to SEQ ID NO: 24590
  Description of Artificial Sequence: Synthetic polypeptide
  XENP021588 2A11_H1_L2.97_Fab-1G6_L1.194_H1.279 Light Chain

SEQ ID NO: 38634 - protein, 107 aa, Artificial Sequence; identical to SEQ ID NO: 24591
  Description of Artificial Sequence: Synthetic polypeptide
  VL of XENP021588

SEQ ID NO: 38635 - protein, 11 aa, Artificial Sequence
  Description of Artificial Sequence: Synthetic peptide
  XENP021588 vlCDR1
QASQDIGNYLN

SEQ ID NO: 38636 - protein, 7 aa, Artificial Sequence
  Description of Artificial Sequence: Synthetic peptide
  XENP021588 vlCDR2
YTSRLHS

SEQ ID NO: 38637 - protein, 9 aa, Artificial Sequence
  Description of Artificial Sequence: Synthetic peptide
  XENP021588 vlCDR3
QQGNTLPYT

SEQ ID NO: 38638 - protein, 447 aa, Artificial Sequence; identical to SEQ ID NO: 17235
  Description of Artificial Sequence: Synthetic polypeptide
  XENP022123 2A11_H1_L2.122_Fab-1G6_L1.194_H1.279 Fab-Fc Heavy Chain

SEQ ID NO: 38639 - protein, 118 aa, Artificial Sequence; identical to SEQ ID NO: 17236
  Description of Artificial Sequence: Synthetic polypeptide
  VH of XENP022123

SEQ ID NO: 38640 - protein, 5 aa, Artificial Sequence
  Description of Artificial Sequence: Synthetic peptide
  XENP022123 vhCDR1
DYYMH

SEQ ID NO: 38641 - protein, 17 aa, Artificial Sequence
  Description of Artificial Sequence: Synthetic peptide
  XENP022123 vhCDR2
WIDPENGDTEYAPKFQG

SEQ ID NO: 38642 - protein, 9 aa, Artificial Sequence
  Description of Artificial Sequence: Synthetic peptide
  XENP022123 vhCDR3
RGVRQALDY

SEQ ID NO: 38643 - protein, 480 aa, Artificial Sequence; identical to SEQ ID NO: 23221
  Description of Artificial Sequence: Synthetic polypeptide
  XENP022123 2A11_H1_L2.122_Fab-1G6_L1.194_H1.279 scFv-Fc Heavy Chain

SEQ ID NO: 38644 - protein, 107 aa, Artificial Sequence; identical to SEQ ID NO: 10999
  Description of Artificial Sequence: Synthetic polypeptide
  VH of XENP022123

SEQ ID NO: 38645 - protein, 122 aa, Artificial Sequence; identical to SEQ ID NO: 10908
  Description of Artificial Sequence: Synthetic polypeptide
  VL of XENP022123

SEQ ID NO: 38646 - protein, 231 aa, Artificial Sequence; identical to SEQ ID NO: 21532
  Description of Artificial Sequence: Synthetic polypeptide
  Fc chain of XENP022123

SEQ ID NO: 38647 - protein, 11 aa, Artificial Sequence
  Description of Artificial Sequence: Synthetic peptide
  XENP022123 vhCDR1
RASQSVGNDVA

SEQ ID NO: 38648 - protein, 7 aa, Artificial Sequence
  Description of Artificial Sequence: Synthetic peptide
  XENP022123 vhCDR2
YASHRYT

SEQ ID NO: 38649 - protein, 9 aa, Artificial Sequence
  Description of Artificial Sequence: Synthetic peptide
  XENP022123 vhCDR3
QQDFSSPRT

SEQ ID NO: 38650 - protein, 5 aa, Artificial Sequence
  Description of Artificial Sequence: Synthetic peptide
  XENP022123 vlCDR1
NYWMN

SEQ ID NO: 38651 - protein, 19 aa, Artificial Sequence
  Description of Artificial Sequence: Synthetic peptide
  XENP022123 vlCDR2
EIRLYSNNYATHYAESVKG

SEQ ID NO: 38652 - protein, 11 aa, Artificial Sequence
  Description of Artificial Sequence: Synthetic peptide
  XENP022123 vlCDR3
YYGNYGGYFDV

SEQ ID NO: 38653 - protein, 214 aa, Artificial Sequence; identical to SEQ ID NO: 24690
  Description of Artificial Sequence: Synthetic polypeptide
  XENP022123 2A11_H1_L2.122_Fab-1G6_L1.194_H1.279 Light Chain

SEQ ID NO: 38654 - protein, 107 aa, Artificial Sequence; identical to SEQ ID NO: 24691
  Description of Artificial Sequence: Synthetic polypeptide
  VL of XENP022123

SEQ ID NO: 38655 - protein, 11 aa, Artificial Sequence
  Description of Artificial Sequence: Synthetic peptide
  XENP022123 vlCDR1
QASQDIGNYLN

SEQ ID NO: 38656 - protein, 7 aa, Artificial Sequence
  Description of Artificial Sequence: Synthetic peptide
  XENP022123 vlCDR2
YTSRLHS

SEQ ID NO: 38657 - protein, 9 aa, Artificial Sequence
  Description of Artificial Sequence: Synthetic peptide
  XENP022123 vlCDR3
QQGNTLPYT

SEQ ID NO: 38658 - protein, 447 aa, Artificial Sequence; identical to SEQ ID NO: 17235
  Description of Artificial Sequence: Synthetic polypeptide
  XENP022124 2A11_H1_L2.123_Fab-1G6_L1.194_H1.279 Fab-Fc Heavy Chain

SEQ ID NO: 38659 - protein, 118 aa, Artificial Sequence; identical to SEQ ID NO: 17236
  Description of Artificial Sequence: Synthetic polypeptide
  VH of XENP022124

SEQ ID NO: 38660 - protein, 5 aa, Artificial Sequence
  Description of Artificial Sequence: Synthetic peptide
  XENP022124 vhCDR1
DYYMH

SEQ ID NO: 38661 - protein, 17 aa, Artificial Sequence
  Description of Artificial Sequence: Synthetic peptide
  XENP022124 vhCDR2
WIDPENGDTEYAPKFQG

SEQ ID NO: 38662 - protein, 9 aa, Artificial Sequence
  Description of Artificial Sequence: Synthetic peptide
  XENP022124 vhCDR3
RGVRQALDY

SEQ ID NO: 38663 - protein, 480 aa, Artificial Sequence; identical to SEQ ID NO: 23221
  Description of Artificial Sequence: Synthetic polypeptide
  XENP022124 2A11_H1_L2.123_Fab-1G6_L1.194_H1.279 scFv-Fc Heavy Chain

SEQ ID NO: 38664 - protein, 107 aa, Artificial Sequence; identical to SEQ ID NO: 10999
  Description of Artificial Sequence: Synthetic polypeptide
  VH of XENP022124

SEQ ID NO: 38665 - protein, 122 aa, Artificial Sequence; identical to SEQ ID NO: 10908
  Description of Artificial Sequence: Synthetic polypeptide
  VL of XENP022124

SEQ ID NO: 38666 - protein, 231 aa, Artificial Sequence; identical to SEQ ID NO: 21532
  Description of Artificial Sequence: Synthetic polypeptide
  Fc chain of XENP022124

SEQ ID NO: 38667 - protein, 11 aa, Artificial Sequence
  Description of Artificial Sequence: Synthetic peptide
  XENP022124 vhCDR1
RASQSVGNDVA

SEQ ID NO: 38668 - protein, 7 aa, Artificial Sequence
  Description of Artificial Sequence: Synthetic peptide
  XENP022124 vhCDR2
YASHRYT

SEQ ID NO: 38669 - protein, 9 aa, Artificial Sequence
  Description of Artificial Sequence: Synthetic peptide
  XENP022124 vhCDR3
QQDFSSPRT

SEQ ID NO: 38670 - protein, 5 aa, Artificial Sequence
  Description of Artificial Sequence: Synthetic peptide
  XENP022124 vlCDR1
NYWMN

SEQ ID NO: 38671 - protein, 19 aa, Artificial Sequence
  Description of Artificial Sequence: Synthetic peptide
  XENP022124 vlCDR2
EIRLYSNNYATHYAESVKG

SEQ ID NO: 38672 - protein, 11 aa, Artificial Sequence
  Description of Artificial Sequence: Synthetic peptide
  XENP022124 vlCDR3
YYGNYGGYFDV

SEQ ID NO: 38673 - protein, 214 aa, Artificial Sequence; identical to SEQ ID NO: 24710
  Description of Artificial Sequence: Synthetic polypeptide
  XENP022124 2A11_H1_L2.123_Fab-1G6_L1.194_H1.279 Light Chain

SEQ ID NO: 38674 - protein, 107 aa, Artificial Sequence; identical to SEQ ID NO: 24711
  Description of Artificial Sequence: Synthetic polypeptide
  VL of XENP022124

SEQ ID NO: 38675 - protein, 11 aa, Artificial Sequence
  Description of Artificial Sequence: Synthetic peptide
  XENP022124 vlCDR1
QASQDIGNYLN

SEQ ID NO: 38676 - protein, 7 aa, Artificial Sequence
  Description of Artificial Sequence: Synthetic peptide
  XENP022124 vlCDR2
YTSRLHS

SEQ ID NO: 38677 - protein, 9 aa, Artificial Sequence
  Description of Artificial Sequence: Synthetic peptide
  XENP022124 vlCDR3
QQGNTLPYT

SEQ ID NO: 38678 - protein, 447 aa, Artificial Sequence; identical to SEQ ID NO: 17235
  Description of Artificial Sequence: Synthetic polypeptide
  XENP022125 2A11_H1_L2.124_Fab-1G6_L1.194_H1.279 Fab-Fc Heavy Chain

SEQ ID NO: 38679 - protein, 118 aa, Artificial Sequence; identical to SEQ ID NO: 17236
  Description of Artificial Sequence: Synthetic polypeptide
  VH of XENP022125

SEQ ID NO: 38680 - protein, 5 aa, Artificial Sequence
  Description of Artificial Sequence: Synthetic peptide
  XENP022125 vhCDR1
DYYMH

SEQ ID NO: 38681 - protein, 17 aa, Artificial Sequence
  Description of Artificial Sequence: Synthetic peptide
  XENP022125 vhCDR2
WIDPENGDTEYAPKFQG

SEQ ID NO: 38682 - protein, 9 aa, Artificial Sequence
  Description of Artificial Sequence: Synthetic peptide
  XENP022125 vhCDR3
RGVRQALDY

SEQ ID NO: 38683 - protein, 480 aa, Artificial Sequence; identical to SEQ ID NO: 23221
  Description of Artificial Sequence: Synthetic polypeptide
  XENP022125 2A11_H1_L2.124_Fab-1G6_L1.194_H1.279 scFv-Fc Heavy Chain

SEQ ID NO: 38684 - protein, 107 aa, Artificial Sequence; identical to SEQ ID NO: 10999
  Description of Artificial Sequence: Synthetic polypeptide
  VH of XENP022125

SEQ ID NO: 38685 - protein, 122 aa, Artificial Sequence; identical to SEQ ID NO: 10908
  Description of Artificial Sequence: Synthetic polypeptide
  VL of XENP022125

SEQ ID NO: 38686 - protein, 231 aa, Artificial Sequence; identical to SEQ ID NO: 21532
  Description of Artificial Sequence: Synthetic polypeptide
  Fc chain of XENP022125

SEQ ID NO: 38687 - protein, 11 aa, Artificial Sequence
  Description of Artificial Sequence: Synthetic peptide
  XENP022125 vhCDR1
RASQSVGNDVA

SEQ ID NO: 38688 - protein, 7 aa, Artificial Sequence
  Description of Artificial Sequence: Synthetic peptide
  XENP022125 vhCDR2
YASHRYT

SEQ ID NO: 38689 - protein, 9 aa, Artificial Sequence
  Description of Artificial Sequence: Synthetic peptide
  XENP022125 vhCDR3
QQDFSSPRT

SEQ ID NO: 38690 - protein, 5 aa, Artificial Sequence
  Description of Artificial Sequence: Synthetic peptide
  XENP022125 vlCDR1
NYWMN

SEQ ID NO: 38691 - protein, 19 aa, Artificial Sequence
  Description of Artificial Sequence: Synthetic peptide
  XENP022125 vlCDR2
EIRLYSNNYATHYAESVKG

SEQ ID NO: 38692 - protein, 11 aa, Artificial Sequence
  Description of Artificial Sequence: Synthetic peptide
  XENP022125 vlCDR3
YYGNYGGYFDV

SEQ ID NO: 38693 - protein, 214 aa, Artificial Sequence; identical to SEQ ID NO: 24730
  Description of Artificial Sequence: Synthetic polypeptide
  XENP022125 2A11_H1_L2.124_Fab-1G6_L1.194_H1.279 Light Chain

SEQ ID NO: 38694 - protein, 107 aa, Artificial Sequence; identical to SEQ ID NO: 24731
  Description of Artificial Sequence: Synthetic polypeptide
  VL of XENP022125

SEQ ID NO: 38695 - protein, 11 aa, Artificial Sequence
  Description of Artificial Sequence: Synthetic peptide
  XENP022125 vlCDR1
QASQDIGNYLN

SEQ ID NO: 38696 - protein, 7 aa, Artificial Sequence
  Description of Artificial Sequence: Synthetic peptide
  XENP022125 vlCDR2
YTSRLHS

SEQ ID NO: 38697 - protein, 9 aa, Artificial Sequence
  Description of Artificial Sequence: Synthetic peptide
  XENP022125 vlCDR3
QQGNTLPYT

SEQ ID NO: 38698 - protein, 450 aa, Artificial Sequence; identical to SEQ ID NO: 22484
  Description of Artificial Sequence: Synthetic polypeptide
  XENP022604 7G8_H3.30_L1.34-1G6_L1.194_H1.279 Fab-Fc Heavy Chain

SEQ ID NO: 38699 - protein, 121 aa, Artificial Sequence; identical to SEQ ID NO: 22485
  Description of Artificial Sequence: Synthetic polypeptide
  VH of XENP022604

SEQ ID NO: 38700 - protein, 5 aa, Artificial Sequence
  Description of Artificial Sequence: Synthetic peptide
  XENP022604 vhCDR1
DAWMS

SEQ ID NO: 38701 - protein, 19 aa, Artificial Sequence
  Description of Artificial Sequence: Synthetic peptide
  XENP022604 vhCDR2
EISTKANNHATYYAESVKG

SEQ ID NO: 38702 - protein, 10 aa, Artificial Sequence
  Description of Artificial Sequence: Synthetic peptide
  XENP022604 vhCDR3
LATWDWYFDV

SEQ ID NO: 38703 - protein, 480 aa, Artificial Sequence; identical to SEQ ID NO: 23221
  Description of Artificial Sequence: Synthetic polypeptide
  XENP022604 7G8_H3.30_L1.34-1G6_L1.194_H1.279 scFv-Fc Heavy Chain

SEQ ID NO: 38704 - protein, 107 aa, Artificial Sequence; identical to SEQ ID NO: 10999
  Description of Artificial Sequence: Synthetic polypeptide
  VH of XENP022604

SEQ ID NO: 38705 - protein, 122 aa, Artificial Sequence; identical to SEQ ID NO: 10908
  Description of Artificial Sequence: Synthetic polypeptide
  VL of XENP022604

SEQ ID NO: 38706 - protein, 231 aa, Artificial Sequence; identical to SEQ ID NO: 21532
  Description of Artificial Sequence: Synthetic polypeptide
  Fc chain of XENP022604

SEQ ID NO: 38707 - protein, 11 aa, Artificial Sequence
  Description of Artificial Sequence: Synthetic peptide
  XENP022604 vhCDR1
RASQSVGNDVA

SEQ ID NO: 38708 - protein, 7 aa, Artificial Sequence
  Description of Artificial Sequence: Synthetic peptide
  XENP022604 vhCDR2
YASHRYT

SEQ ID NO: 38709 - protein, 9 aa, Artificial Sequence
  Description of Artificial Sequence: Synthetic peptide
  XENP022604 vhCDR3
QQDFSSPRT

SEQ ID NO: 38710 - protein, 5 aa, Artificial Sequence
  Description of Artificial Sequence: Synthetic peptide
  XENP022604 vlCDR1
NYWMN

SEQ ID NO: 38711 - protein, 19 aa, Artificial Sequence
  Description of Artificial Sequence: Synthetic peptide
  XENP022604 vlCDR2
EIRLYSNNYATHYAESVKG

SEQ ID NO: 38712 - protein, 11 aa, Artificial Sequence
  Description of Artificial Sequence: Synthetic peptide
  XENP022604 vlCDR3
YYGNYGGYFDV

SEQ ID NO: 38713 - protein, 218 aa, Artificial Sequence; identical to SEQ ID NO: 22599
  Description of Artificial Sequence: Synthetic polypeptide
  XENP022604 7G8_H3.30_L1.34-1G6_L1.194_H1.279 Light Chain

SEQ ID NO: 38714 - protein, 111 aa, Artificial Sequence; identical to SEQ ID NO: 22600
  Description of Artificial Sequence: Synthetic polypeptide
  VL of XENP022604

SEQ ID NO: 38715 - protein, 15 aa, Artificial Sequence
  Description of Artificial Sequence: Synthetic peptide
  XENP022604 vlCDR1
RASQSVDYDGDSYMN

SEQ ID NO: 38716 - protein, 7 aa, Artificial Sequence
  Description of Artificial Sequence: Synthetic peptide
  XENP022604 vlCDR2
AASELES

SEQ ID NO: 38717 - protein, 9 aa, Artificial Sequence
  Description of Artificial Sequence: Synthetic peptide
  XENP022604 vlCDR3
QQSNEDPFT

SEQ ID NO: 38718 - protein, 447 aa, Artificial Sequence; identical to SEQ ID NO: 22084
  Description of Artificial Sequence: Synthetic polypeptide
  XENP022672 2A11_H1.144_L2.142_Fab-1G6_L1.194_H1.279 Fab-Fc Heavy Chain

SEQ ID NO: 38719 - protein, 118 aa, Artificial Sequence; identical to SEQ ID NO: 22085
  Description of Artificial Sequence: Synthetic polypeptide
  VH of XENP022672

SEQ ID NO: 38720 - protein, 5 aa, Artificial Sequence
  Description of Artificial Sequence: Synthetic peptide
  XENP022672 vhCDR1
DYFMH

SEQ ID NO: 38721 - protein, 17 aa, Artificial Sequence
  Description of Artificial Sequence: Synthetic peptide
  XENP022672 vhCDR2
WIDPELGDTEYAPKFQG

SEQ ID NO: 38722 - protein, 9 aa, Artificial Sequence
  Description of Artificial Sequence: Synthetic peptide
  XENP022672 vhCDR3
RGVYQALDY

SEQ ID NO: 38723 - protein, 480 aa, Artificial Sequence; identical to SEQ ID NO: 23221
  Description of Artificial Sequence: Synthetic polypeptide
  XENP022672 2A11_H1.144_L2.142_Fab-1G6_L1.194_H1.279 scFv-Fc Heavy Chain

SEQ ID NO: 38724 - protein, 107 aa, Artificial Sequence; identical to SEQ ID NO: 10999
  Description of Artificial Sequence: Synthetic polypeptide
  VH of XENP022672

SEQ ID NO: 38725 - protein, 122 aa, Artificial Sequence; identical to SEQ ID NO: 10908
  Description of Artificial Sequence: Synthetic polypeptide
  VL of XENP022672

SEQ ID NO: 38726 - protein, 231 aa, Artificial Sequence; identical to SEQ ID NO: 21532
  Description of Artificial Sequence: Synthetic polypeptide
  Fc chain of XENP022672

SEQ ID NO: 38727 - protein, 11 aa, Artificial Sequence
  Description of Artificial Sequence: Synthetic peptide
  XENP022672 vhCDR1
RASQSVGNDVA

SEQ ID NO: 38728 - protein, 7 aa, Artificial Sequence
  Description of Artificial Sequence: Synthetic peptide
  XENP022672 vhCDR2
YASHRYT

SEQ ID NO: 38729 - protein, 9 aa, Artificial Sequence
  Description of Artificial Sequence: Synthetic peptide
  XENP022672 vhCDR3
QQDFSSPRT

SEQ ID NO: 38730 - protein, 5 aa, Artificial Sequence
  Description of Artificial Sequence: Synthetic peptide
  XENP022672 vlCDR1
NYWMN

SEQ ID NO: 38731 - protein, 19 aa, Artificial Sequence
  Description of Artificial Sequence: Synthetic peptide
  XENP022672 vlCDR2
EIRLYSNNYATHYAESVKG

SEQ ID NO: 38732 - protein, 11 aa, Artificial Sequence
  Description of Artificial Sequence: Synthetic peptide
  XENP022672 vlCDR3
YYGNYGGYFDV

SEQ ID NO: 38733 - protein, 214 aa, Artificial Sequence; identical to SEQ ID NO: 22279
  Description of Artificial Sequence: Synthetic polypeptide
  XENP022672 2A11_H1.144_L2.142_Fab-1G6_L1.194_H1.279 Light Chain

SEQ ID NO: 38734 - protein, 107 aa, Artificial Sequence; identical to SEQ ID NO: 22280
  Description of Artificial Sequence: Synthetic polypeptide
  VL of XENP022672

SEQ ID NO: 38735 - protein, 11 aa, Artificial Sequence
  Description of Artificial Sequence: Synthetic peptide
  XENP022672 vlCDR1
QASQDIGNYLN

SEQ ID NO: 38736 - protein, 7 aa, Artificial Sequence
  Description of Artificial Sequence: Synthetic peptide
  XENP022672 vlCDR2
FTSYLHS

SEQ ID NO: 38737 - protein, 9 aa, Artificial Sequence
  Description of Artificial Sequence: Synthetic peptide
  XENP022672 vlCDR3
QQGNTLPYT

SEQ ID NO: 38738 - protein, 450 aa, Artificial Sequence; identical to SEQ ID NO: 35607
  Description of Artificial Sequence: Synthetic polypeptide
  XENP022847 7G8_H3.30_L1.34_Fab-1G6_L1.194_H1.279_scFv M428L/N434S Fab-Fc Heavy Chain

SEQ ID NO: 38739 - protein, 121 aa, Artificial Sequence; identical to SEQ ID NO: 22485
  Description of Artificial Sequence: Synthetic polypeptide
  VH of XENP022847

SEQ ID NO: 38740 - protein, 5 aa, Artificial Sequence
  Description of Artificial Sequence: Synthetic peptide
  XENP022847 vhCDR1
DAWMS

SEQ ID NO: 38741 - protein, 19 aa, Artificial Sequence
  Description of Artificial Sequence: Synthetic peptide
  XENP022847 vhCDR2
EISTKANNHATYYAESVKG

SEQ ID NO: 38742 - protein, 10 aa, Artificial Sequence
  Description of Artificial Sequence: Synthetic peptide
  XENP022847 vhCDR3
LATWDWYFDV

SEQ ID NO: 38743 - protein, 480 aa, Artificial Sequence; identical to SEQ ID NO: 23581
  Description of Artificial Sequence: Synthetic polypeptide
  XENP022847 7G8_H3.30_L1.34_Fab-1G6_L1.194_H1.279_scFv M428L/N434S scFv-Fc Heavy Chain

SEQ ID NO: 38744 - protein, 107 aa, Artificial Sequence; identical to SEQ ID NO: 10999
  Description of Artificial Sequence: Synthetic polypeptide
  VH of XENP022847

SEQ ID NO: 38745 - protein, 122 aa, Artificial Sequence; identical to SEQ ID NO: 10908
  Description of Artificial Sequence: Synthetic polypeptide
  VL of XENP022847

SEQ ID NO: 38746 - protein, 231 aa, Artificial Sequence; identical to SEQ ID NO: 21572
  Description of Artificial Sequence: Synthetic polypeptide
  Fc chain of XENP022847

SEQ ID NO: 38747 - protein, 11 aa, Artificial Sequence
  Description of Artificial Sequence: Synthetic peptide
  XENP022847 vhCDR1
RASQSVGNDVA

SEQ ID NO: 38748 - protein, 7 aa, Artificial Sequence
  Description of Artificial Sequence: Synthetic peptide
  XENP022847 vhCDR2
YASHRYT

SEQ ID NO: 38749 - protein, 9 aa, Artificial Sequence
  Description of Artificial Sequence: Synthetic peptide
  XENP022847 vhCDR3
QQDFSSPRT

SEQ ID NO: 38750 - protein, 5 aa, Artificial Sequence
  Description of Artificial Sequence: Synthetic peptide
  XENP022847 vlCDR1
NYWMN

SEQ ID NO: 38751 - protein, 19 aa, Artificial Sequence
  Description of Artificial Sequence: Synthetic peptide
  XENP022847 vlCDR2
EIRLYSNNYATHYAESVKG

SEQ ID NO: 38752 - protein, 11 aa, Artificial Sequence
  Description of Artificial Sequence: Synthetic peptide
  XENP022847 vlCDR3
YYGNYGGYFDV

SEQ ID NO: 38753 - protein, 218 aa, Artificial Sequence; identical to SEQ ID NO: 22599
  Description of Artificial Sequence: Synthetic polypeptide
  XENP022847 7G8_H3.30_L1.34_Fab-1G6_L1.194_H1.279_scFv M428L/N434S Light Chain

SEQ ID NO: 38754 - protein, 111 aa, Artificial Sequence; identical to SEQ ID NO: 22600
  Description of Artificial Sequence: Synthetic polypeptide
  VL of XENP022847

SEQ ID NO: 38755 - protein, 15 aa, Artificial Sequence
  Description of Artificial Sequence: Synthetic peptide
  XENP022847 vlCDR1
RASQSVDYDGDSYMN

SEQ ID NO: 38756 - protein, 7 aa, Artificial Sequence
  Description of Artificial Sequence: Synthetic peptide
  XENP022847 vlCDR2
AASELES

SEQ ID NO: 38757 - protein, 9 aa, Artificial Sequence
  Description of Artificial Sequence: Synthetic peptide
  XENP022847 vlCDR3
QQSNEDPFT

SEQ ID NO: 38758 - protein, 447 aa, Artificial Sequence; identical to SEQ ID NO: 35647
  Description of Artificial Sequence: Synthetic polypeptide
  XENP022849 2A11_H1.144_L2.142_Fab-1G6_L1.194_H1.279_scFv M428L/N434S Fab-Fc Heavy Chain

SEQ ID NO: 38759 - protein, 118 aa, Artificial Sequence; identical to SEQ ID NO: 22085
  Description of Artificial Sequence: Synthetic polypeptide
  VH of XENP022849

SEQ ID NO: 38760 - protein, 5 aa, Artificial Sequence
  Description of Artificial Sequence: Synthetic peptide
  XENP022849 vhCDR1
DYFMH

SEQ ID NO: 38761 - protein, 17 aa, Artificial Sequence
  Description of Artificial Sequence: Synthetic peptide
  XENP022849 vhCDR2
WIDPELGDTEYAPKFQG

SEQ ID NO: 38762 - protein, 9 aa, Artificial Sequence
  Description of Artificial Sequence: Synthetic peptide
  XENP022849 vhCDR3
RGVYQALDY

SEQ ID NO: 38763 - protein, 480 aa, Artificial Sequence; identical to SEQ ID NO: 23581
  Description of Artificial Sequence: Synthetic polypeptide
  XENP022849 2A11_H1.144_L2.142_Fab-1G6_L1.194_H1.279_scFv M428L/N434S scFv-Fc Heavy Chain

SEQ ID NO: 38764 - protein, 107 aa, Artificial Sequence; identical to SEQ ID NO: 10999
  Description of Artificial Sequence: Synthetic polypeptide
  VH of XENP022849

SEQ ID NO: 38765 - protein, 122 aa, Artificial Sequence; identical to SEQ ID NO: 10908
  Description of Artificial Sequence: Synthetic polypeptide
  VL of XENP022849

SEQ ID NO: 38766 - protein, 231 aa, Artificial Sequence; identical to SEQ ID NO: 21572
  Description of Artificial Sequence: Synthetic polypeptide
  Fc chain of XENP022849

SEQ ID NO: 38767 - protein, 11 aa, Artificial Sequence
  Description of Artificial Sequence: Synthetic peptide
  XENP022849 vhCDR1
RASQSVGNDVA

SEQ ID NO: 38768 - protein, 7 aa, Artificial Sequence
  Description of Artificial Sequence: Synthetic peptide
  XENP022849 vhCDR2
YASHRYT

SEQ ID NO: 38769 - protein, 9 aa, Artificial Sequence
  Description of Artificial Sequence: Synthetic peptide
  XENP022849 vhCDR3
QQDFSSPRT

SEQ ID NO: 38770 - protein, 5 aa, Artificial Sequence
  Description of Artificial Sequence: Synthetic peptide
  XENP022849 vlCDR1
NYWMN

SEQ ID NO: 38771 - protein, 19 aa, Artificial Sequence
  Description of Artificial Sequence: Synthetic peptide
  XENP022849 vlCDR2
EIRLYSNNYATHYAESVKG

SEQ ID NO: 38772 - protein, 11 aa, Artificial Sequence
  Description of Artificial Sequence: Synthetic peptide
  XENP022849 vlCDR3
YYGNYGGYFDV

SEQ ID NO: 38773 - protein, 214 aa, Artificial Sequence; identical to SEQ ID NO: 22279
  Description of Artificial Sequence: Synthetic polypeptide
  XENP022849 2A11_H1.144_L2.142_Fab-1G6_L1.194_H1.279_scFv M428L/N434S Light Chain

SEQ ID NO: 38774 - protein, 107 aa, Artificial Sequence; identical to SEQ ID NO: 22280
  Description of Artificial Sequence: Synthetic polypeptide
  VL of XENP022849

SEQ ID NO: 38775 - protein, 11 aa, Artificial Sequence
  Description of Artificial Sequence: Synthetic peptide
  XENP022849 vlCDR1
QASQDIGNYLN

SEQ ID NO: 38776 - protein, 7 aa, Artificial Sequence
  Description of Artificial Sequence: Synthetic peptide
  XENP022849 vlCDR2
FTSYLHS

SEQ ID NO: 38777 - protein, 9 aa, Artificial Sequence
  Description of Artificial Sequence: Synthetic peptide
  XENP022849 vlCDR3
QQGNTLPYT

SEQ ID NO: 38778 - protein, 447 aa, Artificial Sequence; identical to SEQ ID NO: 22844
  Description of Artificial Sequence: Synthetic polypeptide
  XENP020895 9C6_H0L0-1G6_L1.194_H1.279 Fab-Fc Heavy Chain

SEQ ID NO: 38779 - protein, 118 aa, Artificial Sequence; identical to SEQ ID NO: 20936
  Description of Artificial Sequence: Synthetic polypeptide
  VH of XENP020895

SEQ ID NO: 38780 - protein, 5 aa, Artificial Sequence
  Description of Artificial Sequence: Synthetic peptide
  XENP020895 vhCDR1
GYGVN

SEQ ID NO: 38781 - protein, 16 aa, Artificial Sequence
  Description of Artificial Sequence: Synthetic peptide
  XENP020895 vhCDR2
MIWIDGSTDYNSALKS

SEQ ID NO: 38782 - protein, 10 aa, Artificial Sequence
  Description of Artificial Sequence: Synthetic peptide
  XENP020895 vhCDR3
DRPDGRAMDY

SEQ ID NO: 38783 - protein, 480 aa, Artificial Sequence; identical to SEQ ID NO: 23221
  Description of Artificial Sequence: Synthetic polypeptide
  XENP020895 9C6_H0L0-1G6_L1.194_H1.279 scFv-Fc Heavy Chain

SEQ ID NO: 38784 - protein, 107 aa, Artificial Sequence; identical to SEQ ID NO: 10999
  Description of Artificial Sequence: Synthetic polypeptide
  VH of XENP020895

SEQ ID NO: 38785 - protein, 122 aa, Artificial Sequence; identical to SEQ ID NO: 10908
  Description of Artificial Sequence: Synthetic polypeptide
  VL of XENP020895

SEQ ID NO: 38786 - protein, 231 aa, Artificial Sequence; identical to SEQ ID NO: 21532
  Description of Artificial Sequence: Synthetic polypeptide
  Fc chain of XENP020895

SEQ ID NO: 38787 - protein, 11 aa, Artificial Sequence
  Description of Artificial Sequence: Synthetic peptide
  XENP020895 vhCDR1
RASQSVGNDVA

SEQ ID NO: 38788 - protein, 7 aa, Artificial Sequence
  Description of Artificial Sequence: Synthetic peptide
  XENP020895 vhCDR2
YASHRYT

SEQ ID NO: 38789 - protein, 9 aa, Artificial Sequence
  Description of Artificial Sequence: Synthetic peptide
  XENP020895 vhCDR3
QQDFSSPRT

SEQ ID NO: 38790 - protein, 5 aa, Artificial Sequence
  Description of Artificial Sequence: Synthetic peptide
  XENP020895 vlCDR1
NYWMN

SEQ ID NO: 38791 - protein, 19 aa, Artificial Sequence
  Description of Artificial Sequence: Synthetic peptide
  XENP020895 vlCDR2
EIRLYSNNYATHYAESVKG

SEQ ID NO: 38792 - protein, 11 aa, Artificial Sequence
  Description of Artificial Sequence: Synthetic peptide
  XENP020895 vlCDR3
YYGNYGGYFDV

SEQ ID NO: 38793 - protein, 213 aa, Artificial Sequence; identical to SEQ ID NO: 20940
  Description of Artificial Sequence: Synthetic polypeptide
  XENP020895 9C6_H0L0-1G6_L1.194_H1.279 Light Chain

SEQ ID NO: 38794 - protein, 106 aa, Artificial Sequence; identical to SEQ ID NO: 20941
  Description of Artificial Sequence: Synthetic polypeptide
  VL of XENP020895

SEQ ID NO: 38795 - protein, 11 aa, Artificial Sequence
  Description of Artificial Sequence: Synthetic peptide
  XENP020895 vlCDR1
KASQSVSNDVA

SEQ ID NO: 38796 - protein, 7 aa, Artificial Sequence
  Description of Artificial Sequence: Synthetic peptide
  XENP020895 vlCDR2
YASNRYT

SEQ ID NO: 38797 - protein, 8 aa, Artificial Sequence
  Description of Artificial Sequence: Synthetic peptide
  XENP020895 vlCDR3
QQDYSSPT

SEQ ID NO: 38798 - protein, 447 aa, Artificial Sequence; identical to SEQ ID NO: 23236
  Description of Artificial Sequence: Synthetic polypeptide
  XENP021220 9C6_H1.1_L1-1G6_L1.194_H1.279 Fab-Fc Heavy Chain

SEQ ID NO: 38799 - protein, 118 aa, Artificial Sequence; identical to SEQ ID NO: 21205
  Description of Artificial Sequence: Synthetic polypeptide
  VH of XENP021220

SEQ ID NO: 38800 - protein, 5 aa, Artificial Sequence
  Description of Artificial Sequence: Synthetic peptide
  XENP021220 vhCDR1
GYGVN

SEQ ID NO: 38801 - protein, 16 aa, Artificial Sequence
  Description of Artificial Sequence: Synthetic peptide
  XENP021220 vhCDR2
MIWIDGSTDYNSKFQG

SEQ ID NO: 38802 - protein, 10 aa, Artificial Sequence
  Description of Artificial Sequence: Synthetic peptide
  XENP021220 vhCDR3
DRPDGRAMDY

SEQ ID NO: 38803 - protein, 480 aa, Artificial Sequence; identical to SEQ ID NO: 23221
  Description of Artificial Sequence: Synthetic polypeptide
  XENP021220 9C6_H1.1_L1-1G6_L1.194_H1.279 scFv-Fc Heavy Chain

SEQ ID NO: 38804 - protein, 107 aa, Artificial Sequence; identical to SEQ ID NO: 10999
  Description of Artificial Sequence: Synthetic polypeptide
  VH of XENP021220

SEQ ID NO: 38805 - protein, 122 aa, Artificial Sequence; identical to SEQ ID NO: 10908
  Description of Artificial Sequence: Synthetic polypeptide
  VL of XENP021220

SEQ ID NO: 38806 - protein, 231 aa, Artificial Sequence; identical to SEQ ID NO: 21532
  Description of Artificial Sequence: Synthetic polypeptide
  Fc chain of XENP021220

SEQ ID NO: 38807 - protein, 11 aa, Artificial Sequence
  Description of Artificial Sequence: Synthetic peptide
  XENP021220 vhCDR1
RASQSVGNDVA

SEQ ID NO: 38808 - protein, 7 aa, Artificial Sequence
  Description of Artificial Sequence: Synthetic peptide
  XENP021220 vhCDR2
YASHRYT

SEQ ID NO: 38809 - protein, 9 aa, Artificial Sequence
  Description of Artificial Sequence: Synthetic peptide
  XENP021220 vhCDR3
QQDFSSPRT

SEQ ID NO: 38810 - protein, 5 aa, Artificial Sequence
  Description of Artificial Sequence: Synthetic peptide
  XENP021220 vlCDR1
NYWMN

SEQ ID NO: 38811 - protein, 19 aa, Artificial Sequence
  Description of Artificial Sequence: Synthetic peptide
  XENP021220 vlCDR2
EIRLYSNNYATHYAESVKG

SEQ ID NO: 38812 - protein, 11 aa, Artificial Sequence
  Description of Artificial Sequence: Synthetic peptide
  XENP021220 vlCDR3
YYGNYGGYFDV

SEQ ID NO: 38813 - protein, 213 aa, Artificial Sequence; identical to SEQ ID NO: 21050
  Description of Artificial Sequence: Synthetic polypeptide
  XENP021220 9C6_H1.1_L1-1G6_L1.194_H1.279 Light Chain

SEQ ID NO: 38814 - protein, 106 aa, Artificial Sequence; identical to SEQ ID NO: 21051
  Description of Artificial Sequence: Synthetic polypeptide
  VL of XENP021220

SEQ ID NO: 38815 - protein, 11 aa, Artificial Sequence
  Description of Artificial Sequence: Synthetic peptide
  XENP021220 vlCDR1
KASQSVSNDVA

SEQ ID NO: 38816 - protein, 7 aa, Artificial Sequence
  Description of Artificial Sequence: Synthetic peptide
  XENP021220 vlCDR2
YASNRYT

SEQ ID NO: 38817 - protein, 8 aa, Artificial Sequence
  Description of Artificial Sequence: Synthetic peptide
  XENP021220 vlCDR3
QQDYSSPT

SEQ ID NO: 38818 - protein, 447 aa, Artificial Sequence; identical to SEQ ID NO: 23256
  Description of Artificial Sequence: Synthetic polypeptide
  XENP021221 9C6_H1.11_L1-1G6_L1.194_H1.279 Fab-Fc Heavy Chain

SEQ ID NO: 38819 - protein, 118 aa, Artificial Sequence; identical to SEQ ID NO: 21305
  Description of Artificial Sequence: Synthetic polypeptide
  VH of XENP021221

SEQ ID NO: 38820 - protein, 5 aa, Artificial Sequence
  Description of Artificial Sequence: Synthetic peptide
  XENP021221 vhCDR1
GYGVN

SEQ ID NO: 38821 - protein, 16 aa, Artificial Sequence
  Description of Artificial Sequence: Synthetic peptide
  XENP021221 vhCDR2
MIWIDGSTDYNSKFQG

SEQ ID NO: 38822 - protein, 10 aa, Artificial Sequence
  Description of Artificial Sequence: Synthetic peptide
  XENP021221 vhCDR3
DRPDGRAMDY

SEQ ID NO: 38823 - protein, 480 aa, Artificial Sequence; identical to SEQ ID NO: 23221
  Description of Artificial Sequence: Synthetic polypeptide
  XENP021221 9C6_H1.11_L1-1G6_L1.194_H1.279 scFv-Fc Heavy Chain

SEQ ID NO: 38824 - protein, 107 aa, Artificial Sequence; identical to SEQ ID NO: 10999
  Description of Artificial Sequence: Synthetic polypeptide
  VH of XENP021221

SEQ ID NO: 38825 - protein, 122 aa, Artificial Sequence; identical to SEQ ID NO: 10908
  Description of Artificial Sequence: Synthetic polypeptide
  VL of XENP021221

SEQ ID NO: 38826 - protein, 231 aa, Artificial Sequence; identical to SEQ ID NO: 21532
  Description of Artificial Sequence: Synthetic polypeptide
  Fc chain of XENP021221

SEQ ID NO: 38827 - protein, 11 aa, Artificial Sequence
  Description of Artificial Sequence: Synthetic peptide
  XENP021221 vhCDR1
RASQSVGNDVA

SEQ ID NO: 38828 - protein, 7 aa, Artificial Sequence
  Description of Artificial Sequence: Synthetic peptide
  XENP021221 vhCDR2
YASHRYT

SEQ ID NO: 38829 - protein, 9 aa, Artificial Sequence
  Description of Artificial Sequence: Synthetic peptide
  XENP021221 vhCDR3
QQDFSSPRT

SEQ ID NO: 38830 - protein, 5 aa, Artificial Sequence
  Description of Artificial Sequence: Synthetic peptide
  XENP021221 vlCDR1
NYWMN

SEQ ID NO: 38831 - protein, 19 aa, Artificial Sequence
  Description of Artificial Sequence: Synthetic peptide
  XENP021221 vlCDR2
EIRLYSNNYATHYAESVKG

SEQ ID NO: 38832 - protein, 11 aa, Artificial Sequence
  Description of Artificial Sequence: Synthetic peptide
  XENP021221 vlCDR3
YYGNYGGYFDV

SEQ ID NO: 38833 - protein, 213 aa, Artificial Sequence; identical to SEQ ID NO: 21050
  Description of Artificial Sequence: Synthetic polypeptide
  XENP021221 9C6_H1.11_L1-1G6_L1.194_H1.279 Light Chain

SEQ ID NO: 38834 - protein, 106 aa, Artificial Sequence; identical to SEQ ID NO: 21051
  Description of Artificial Sequence: Synthetic polypeptide
  VL of XENP021221

SEQ ID NO: 38835 - protein, 11 aa, Artificial Sequence
  Description of Artificial Sequence: Synthetic peptide
  XENP021221 vlCDR1
KASQSVSNDVA

SEQ ID NO: 38836 - protein, 7 aa, Artificial Sequence
  Description of Artificial Sequence: Synthetic peptide
  XENP021221 vlCDR2
YASNRYT

SEQ ID NO: 38837 - protein, 8 aa, Artificial Sequence
  Description of Artificial Sequence: Synthetic peptide
  XENP021221 vlCDR3
QQDYSSPT

SEQ ID NO: 38838 - protein, 447 aa, Artificial Sequence; identical to SEQ ID NO: 36147
  Description of Artificial Sequence: Synthetic polypeptide
  XENP022858 9C6_H1.1_L1_Fab-1G6_L1.194_H1.279_scFv M428L/N434S Fab-Fc Heavy Chain

SEQ ID NO: 38839 - protein, 118 aa, Artificial Sequence; identical to SEQ ID NO: 21205
  Description of Artificial Sequence: Synthetic polypeptide
  VH of XENP022858

SEQ ID NO: 38840 - protein, 5 aa, Artificial Sequence
  Description of Artificial Sequence: Synthetic peptide
  XENP022858 vhCDR1
GYGVN

SEQ ID NO: 38841 - protein, 16 aa, Artificial Sequence
  Description of Artificial Sequence: Synthetic peptide
  XENP022858 vhCDR2
MIWIDGSTDYNSKFQG

SEQ ID NO: 38842 - protein, 10 aa, Artificial Sequence
  Description of Artificial Sequence: Synthetic peptide
  XENP022858 vhCDR3
DRPDGRAMDY

SEQ ID NO: 38843 - protein, 480 aa, Artificial Sequence; identical to SEQ ID NO: 23581
  Description of Artificial Sequence: Synthetic polypeptide
  XENP022858 9C6_H1.1_L1_Fab-1G6_L1.194_H1.279_scFv M428L/N434S scFv-Fc Heavy Chain

SEQ ID NO: 38844 - protein, 107 aa, Artificial Sequence; identical to SEQ ID NO: 10999
  Description of Artificial Sequence: Synthetic polypeptide
  VH of XENP022858

SEQ ID NO: 38845 - protein, 122 aa, Artificial Sequence; identical to SEQ ID NO: 10908
  Description of Artificial Sequence: Synthetic polypeptide
  VL of XENP022858

SEQ ID NO: 38846 - protein, 231 aa, Artificial Sequence; identical to SEQ ID NO: 21572
  Description of Artificial Sequence: Synthetic polypeptide
  Fc chain of XENP022858

SEQ ID NO: 38847 - protein, 11 aa, Artificial Sequence
  Description of Artificial Sequence: Synthetic peptide
  XENP022858 vhCDR1
RASQSVGNDVA

SEQ ID NO: 38848 - protein, 7 aa, Artificial Sequence
  Description of Artificial Sequence: Synthetic peptide
  XENP022858 vhCDR2
YASHRYT

SEQ ID NO: 38849 - protein, 9 aa, Artificial Sequence
  Description of Artificial Sequence: Synthetic peptide
  XENP022858 vhCDR3
QQDFSSPRT

SEQ ID NO: 38850 - protein, 5 aa, Artificial Sequence
  Description of Artificial Sequence: Synthetic peptide
  XENP022858 vlCDR1
NYWMN

SEQ ID NO: 38851 - protein, 19 aa, Artificial Sequence
  Description of Artificial Sequence: Synthetic peptide
  XENP022858 vlCDR2
EIRLYSNNYATHYAESVKG

SEQ ID NO: 38852 - protein, 11 aa, Artificial Sequence
  Description of Artificial Sequence: Synthetic peptide
  XENP022858 vlCDR3
YYGNYGGYFDV

SEQ ID NO: 38853 - protein, 213 aa, Artificial Sequence; identical to SEQ ID NO: 21050
  Description of Artificial Sequence: Synthetic polypeptide
  XENP022858 9C6_H1.1_L1_Fab-1G6_L1.194_H1.279_scFv M428L/N434S Light Chain

SEQ ID NO: 38854 - protein, 106 aa, Artificial Sequence; identical to SEQ ID NO: 21051
  Description of Artificial Sequence: Synthetic polypeptide
  VL of XENP022858

SEQ ID NO: 38855 - protein, 11 aa, Artificial Sequence
  Description of Artificial Sequence: Synthetic peptide
  XENP022858 vlCDR1
KASQSVSNDVA

SEQ ID NO: 38856 - protein, 7 aa, Artificial Sequence
  Description of Artificial Sequence: Synthetic peptide
  XENP022858 vlCDR2
YASNRYT

SEQ ID NO: 38857 - protein, 8 aa, Artificial Sequence
  Description of Artificial Sequence: Synthetic peptide
  XENP022858 vlCDR3
QQDYSSPT

SEQ ID NO: 38858 - protein, 447 aa, Artificial Sequence; identical to SEQ ID NO: 17235
  Description of Artificial Sequence: Synthetic polypeptide
  XENP020153 2A11_H1L2-[CTLA-4]_H3.4_L0.12 Fab-Fc Heavy Chain

SEQ ID NO: 38859 - protein, 118 aa, Artificial Sequence; identical to SEQ ID NO: 17236
  Description of Artificial Sequence: Synthetic polypeptide
  VH of XENP020153

SEQ ID NO: 38860 - protein, 5 aa, Artificial Sequence
  Description of Artificial Sequence: Synthetic peptide
  XENP020153 vhCDR1
DYYMH

SEQ ID NO: 38861 - protein, 17 aa, Artificial Sequence
  Description of Artificial Sequence: Synthetic peptide
  XENP020153 vhCDR2
WIDPENGDTEYAPKFQG

SEQ ID NO: 38862 - protein, 9 aa, Artificial Sequence
  Description of Artificial Sequence: Synthetic peptide
  XENP020153 vhCDR3
RGVRQALDY

SEQ ID NO: 38863 - protein, 477 aa, Artificial Sequence; identical to SEQ ID NO: 21549
  Description of Artificial Sequence: Synthetic polypeptide
  XENP020153 2A11_H1L2-[CTLA-4]_H3.4_L0.12 scFv-Fc Heavy Chain

SEQ ID NO: 38864 - protein, 118 aa, Artificial Sequence; identical to SEQ ID NO: 2461
  Description of Artificial Sequence: Synthetic polypeptide
  VH of XENP020153

SEQ ID NO: 38865 - protein, 108 aa, Artificial Sequence; identical to SEQ ID NO: 1517
  Description of Artificial Sequence: Synthetic polypeptide
  VL of XENP020153

SEQ ID NO: 38866 - protein, 231 aa, Artificial Sequence; identical to SEQ ID NO: 21532
  Description of Artificial Sequence: Synthetic polypeptide
  Fc chain of XENP020153

SEQ ID NO: 38867 - protein, 5 aa, Artificial Sequence
  Description of Artificial Sequence: Synthetic peptide
  XENP020153 vhCDR1
SYTMH

SEQ ID NO: 38868 - protein, 17 aa, Artificial Sequence
  Description of Artificial Sequence: Synthetic peptide
  XENP020153 vhCDR2
FISYDGNHKYYADSVKG

SEQ ID NO: 38869 - protein, 9 aa, Artificial Sequence
  Description of Artificial Sequence: Synthetic peptide
  XENP020153 vhCDR3
TGHLGPFDL

SEQ ID NO: 38870 - protein, 12 aa, Artificial Sequence
  Description of Artificial Sequence: Synthetic peptide
  XENP020153 vlCDR1
RASQSVGSSYLA

SEQ ID NO: 38871 - protein, 7 aa, Artificial Sequence
  Description of Artificial Sequence: Synthetic peptide
  XENP020153 vlCDR2
GAFSRAT

SEQ ID NO: 38872 - protein, 9 aa, Artificial Sequence
  Description of Artificial Sequence: Synthetic peptide
  XENP020153 vlCDR3
QQYGSSPWT

SEQ ID NO: 38873 - protein, 214 aa, Artificial Sequence; identical to SEQ ID NO: 17250
  Description of Artificial Sequence: Synthetic polypeptide
  XENP020153 2A11_H1L2-[CTLA-4]_H3.4_L0.12 Light Chain

SEQ ID NO: 38874 - protein, 107 aa, Artificial Sequence; identical to SEQ ID NO: 17251
  Description of Artificial Sequence: Synthetic polypeptide
  VL of XENP020153

SEQ ID NO: 38875 - protein, 11 aa, Artificial Sequence
  Description of Artificial Sequence: Synthetic peptide
  XENP020153 vlCDR1
QASQDIGNYLN

SEQ ID NO: 38876 - protein, 7 aa, Artificial Sequence
  Description of Artificial Sequence: Synthetic peptide
  XENP020153 vlCDR2
YTSRLHS

SEQ ID NO: 38877 - protein, 9 aa, Artificial Sequence
  Description of Artificial Sequence: Synthetic peptide
  XENP020153 vlCDR3
QQGNTLPYT

SEQ ID NO: 38878 - protein, 450 aa, Artificial Sequence; identical to SEQ ID NO: 22304
  Description of Artificial Sequence: Synthetic polypeptide
  XENP020833 7G8_H3L1_Fab-[CTLA-4]_H3.23_L0.129 Fab-Fc Heavy Chain

SEQ ID NO: 38879 - protein, 121 aa, Artificial Sequence; identical to SEQ ID NO: 17806
  Description of Artificial Sequence: Synthetic polypeptide
  VH of XENP020833

SEQ ID NO: 38880 - protein, 5 aa, Artificial Sequence
  Description of Artificial Sequence: Synthetic peptide
  XENP020833 vhCDR1
DAWMD

SEQ ID NO: 38881 - protein, 19 aa, Artificial Sequence
  Description of Artificial Sequence: Synthetic peptide
  XENP020833 vhCDR2
EIRTKANNHATYYAESVKG

SEQ ID NO: 38882 - protein, 10 aa, Artificial Sequence
  Description of Artificial Sequence: Synthetic peptide
  XENP020833 vhCDR3
LANWDWYFDV

SEQ ID NO: 38883 - protein, 477 aa, Artificial Sequence; identical to SEQ ID NO: 21669
  Description of Artificial Sequence: Synthetic polypeptide
  XENP020833 7G8_H3L1_Fab-[CTLA-4]_H3.23_L0.129 scFv-Fc Heavy Chain

SEQ ID NO: 38884 - protein, 118 aa, Artificial Sequence; identical to SEQ ID NO: 2632
  Description of Artificial Sequence: Synthetic polypeptide
  VH of XENP020833

SEQ ID NO: 38885 - protein, 108 aa, Artificial Sequence; identical to SEQ ID NO: 2768
  Description of Artificial Sequence: Synthetic polypeptide
  VL of XENP020833

SEQ ID NO: 38886 - protein, 231 aa, Artificial Sequence; identical to SEQ ID NO: 21532
  Description of Artificial Sequence: Synthetic polypeptide
  Fc chain of XENP020833

SEQ ID NO: 38887 - protein, 5 aa, Artificial Sequence
  Description of Artificial Sequence: Synthetic peptide
  XENP020833 vhCDR1
SYTMH

SEQ ID NO: 38888 - protein, 17 aa, Artificial Sequence
  Description of Artificial Sequence: Synthetic peptide
  XENP020833 vhCDR2
FISYDGNYKYYADSVKG

SEQ ID NO: 38889 - protein, 9 aa, Artificial Sequence
  Description of Artificial Sequence: Synthetic peptide
  XENP020833 vhCDR3
GGHLGPFDL

SEQ ID NO: 38890 - protein, 12 aa, Artificial Sequence
  Description of Artificial Sequence: Synthetic peptide
  XENP020833 vlCDR1
RASQSVGSSYLA

SEQ ID NO: 38891 - protein, 7 aa, Artificial Sequence
  Description of Artificial Sequence: Synthetic peptide
  XENP020833 vlCDR2
GASSRAT

SEQ ID NO: 38892 - protein, 9 aa, Artificial Sequence
  Description of Artificial Sequence: Synthetic peptide
  XENP020833 vlCDR3
QQYGSSPWT

SEQ ID NO: 38893 - protein, 218 aa, Artificial Sequence; identical to SEQ ID NO: 17600
  Description of Artificial Sequence: Synthetic polypeptide
  XENP020833 7G8_H3L1_Fab-[CTLA-4]_H3.23_L0.129 Light Chain

SEQ ID NO: 38894 - protein, 111 aa, Artificial Sequence; identical to SEQ ID NO: 17601
  Description of Artificial Sequence: Synthetic polypeptide
  VL of XENP020833

SEQ ID NO: 38895 - protein, 15 aa, Artificial Sequence
  Description of Artificial Sequence: Synthetic peptide
  XENP020833 vlCDR1
RASQSVDYDGDSYMN

SEQ ID NO: 38896 - protein, 7 aa, Artificial Sequence
  Description of Artificial Sequence: Synthetic peptide
  XENP020833 vlCDR2
AASNLES

SEQ ID NO: 38897 - protein, 9 aa, Artificial Sequence
  Description of Artificial Sequence: Synthetic peptide
  XENP020833 vlCDR3
QQSNEDPFT

SEQ ID NO: 38898 - protein, 447 aa, Artificial Sequence; identical to SEQ ID NO: 17235
  Description of Artificial Sequence: Synthetic polypeptide
  XENP021859 2A11_H1_L2.47_Fab-[CTLA-4]_H3.23_L0.129 Fab-Fc Heavy Chain

SEQ ID NO: 38899 - protein, 118 aa, Artificial Sequence; identical to SEQ ID NO: 17236
  Description of Artificial Sequence: Synthetic polypeptide
  VH of XENP021859

SEQ ID NO: 38900 - protein, 5 aa, Artificial Sequence
  Description of Artificial Sequence: Synthetic peptide
  XENP021859 vhCDR1
DYYMH

SEQ ID NO: 38901 - protein, 17 aa, Artificial Sequence
  Description of Artificial Sequence: Synthetic peptide
  XENP021859 vhCDR2
WIDPENGDTEYAPKFQG

SEQ ID NO: 38902 - protein, 9 aa, Artificial Sequence
  Description of Artificial Sequence: Synthetic peptide
  XENP021859 vhCDR3
RGVRQALDY

SEQ ID NO: 38903 - protein, 477 aa, Artificial Sequence; identical to SEQ ID NO: 21669
  Description of Artificial Sequence: Synthetic polypeptide
  XENP021859 2A11_H1_L2.47_Fab-[CTLA-4]_H3.23_L0.129 scFv-Fc Heavy Chain

SEQ ID NO: 38904 - protein, 118 aa, Artificial Sequence; identical to SEQ ID NO: 2632
  Description of Artificial Sequence: Synthetic polypeptide
  VH of XENP021859

SEQ ID NO: 38905 - protein, 108 aa, Artificial Sequence; identical to SEQ ID NO: 2768
  Description of Artificial Sequence: Synthetic polypeptide
  VL of XENP021859

SEQ ID NO: 38906 - protein, 231 aa, Artificial Sequence; identical to SEQ ID NO: 21532
  Description of Artificial Sequence: Synthetic polypeptide
  Fc chain of XENP021859

SEQ ID NO: 38907 - protein, 5 aa, Artificial Sequence
  Description of Artificial Sequence: Synthetic peptide
  XENP021859 vhCDR1
SYTMH

SEQ ID NO: 38908 - protein, 17 aa, Artificial Sequence
  Description of Artificial Sequence: Synthetic peptide
  XENP021859 vhCDR2
FISYDGNYKYYADSVKG

SEQ ID NO: 38909 - protein, 9 aa, Artificial Sequence
  Description of Artificial Sequence: Synthetic peptide
  XENP021859 vhCDR3
GGHLGPFDL

SEQ ID NO: 38910 - protein, 12 aa, Artificial Sequence
  Description of Artificial Sequence: Synthetic peptide
  XENP021859 vlCDR1
RASQSVGSSYLA

SEQ ID NO: 38911 - protein, 7 aa, Artificial Sequence
  Description of Artificial Sequence: Synthetic peptide
  XENP021859 vlCDR2
GASSRAT

SEQ ID NO: 38912 - protein, 9 aa, Artificial Sequence
  Description of Artificial Sequence: Synthetic peptide
  XENP021859 vlCDR3
QQYGSSPWT

SEQ ID NO: 38913 - protein, 214 aa, Artificial Sequence; identical to SEQ ID NO: 22039
  Description of Artificial Sequence: Synthetic polypeptide
  XENP021859 2A11_H1_L2.47_Fab-[CTLA-4]_H3.23_L0.129 Light Chain

SEQ ID NO: 38914 - protein, 107 aa, Artificial Sequence; identical to SEQ ID NO: 22040
  Description of Artificial Sequence: Synthetic polypeptide
  VL of XENP021859

SEQ ID NO: 38915 - protein, 11 aa, Artificial Sequence
  Description of Artificial Sequence: Synthetic peptide
  XENP021859 vlCDR1
QASQDIGNYLN

SEQ ID NO: 38916 - protein, 7 aa, Artificial Sequence
  Description of Artificial Sequence: Synthetic peptide
  XENP021859 vlCDR2
YTSHLHS

SEQ ID NO: 38917 - protein, 9 aa, Artificial Sequence
  Description of Artificial Sequence: Synthetic peptide
  XENP021859 vlCDR3
QQGNTLPYT

SEQ ID NO: 38918 - protein, 447 aa, Artificial Sequence; identical to SEQ ID NO: 17235
  Description of Artificial Sequence: Synthetic polypeptide
  XENP021860 2A11_H1_L2.50_Fab-[CTLA-4]_H3.23_L0.129 Fab-Fc Heavy Chain

SEQ ID NO: 38919 - protein, 118 aa, Artificial Sequence; identical to SEQ ID NO: 17236
  Description of Artificial Sequence: Synthetic polypeptide
  VH of XENP021860

SEQ ID NO: 38920 - protein, 5 aa, Artificial Sequence
  Description of Artificial Sequence: Synthetic peptide
  XENP021860 vhCDR1
DYYMH

SEQ ID NO: 38921 - protein, 17 aa, Artificial Sequence
  Description of Artificial Sequence: Synthetic peptide
  XENP021860 vhCDR2
WIDPENGDTEYAPKFQG

SEQ ID NO: 38922 - protein, 9 aa, Artificial Sequence
  Description of Artificial Sequence: Synthetic peptide
  XENP021860 vhCDR3
RGVRQALDY

SEQ ID NO: 38923 - protein, 477 aa, Artificial Sequence; identical to SEQ ID NO: 21669
  Description of Artificial Sequence: Synthetic polypeptide
  XENP021860 2A11_H1_L2.50_Fab-[CTLA-4]_H3.23_L0.129 scFv-Fc Heavy Chain

SEQ ID NO: 38924 - protein, 118 aa, Artificial Sequence; identical to SEQ ID NO: 2632
  Description of Artificial Sequence: Synthetic polypeptide
  VH of XENP021860

SEQ ID NO: 38925 - protein, 108 aa, Artificial Sequence; identical to SEQ ID NO: 2768
  Description of Artificial Sequence: Synthetic polypeptide
  VL of XENP021860

SEQ ID NO: 38926 - protein, 231 aa, Artificial Sequence; identical to SEQ ID NO: 21532
  Description of Artificial Sequence: Synthetic polypeptide
  Fc chain of XENP021860

SEQ ID NO: 38927 - protein, 5 aa, Artificial Sequence
  Description of Artificial Sequence: Synthetic peptide
  XENP021860 vhCDR1
SYTMH

SEQ ID NO: 38928 - protein, 17 aa, Artificial Sequence
  Description of Artificial Sequence: Synthetic peptide
  XENP021860 vhCDR2
FISYDGNYKYYADSVKG

SEQ ID NO: 38929 - protein, 9 aa, Artificial Sequence
  Description of Artificial Sequence: Synthetic peptide
  XENP021860 vhCDR3
GGHLGPFDL

SEQ ID NO: 38930 - protein, 12 aa, Artificial Sequence
  Description of Artificial Sequence: Synthetic peptide
  XENP021860 vlCDR1
RASQSVGSSYLA

SEQ ID NO: 38931 - protein, 7 aa, Artificial Sequence
  Description of Artificial Sequence: Synthetic peptide
  XENP021860 vlCDR2
GASSRAT

SEQ ID NO: 38932 - protein, 9 aa, Artificial Sequence
  Description of Artificial Sequence: Synthetic peptide
  XENP021860 vlCDR3
QQYGSSPWT

SEQ ID NO: 38933 - protein, 214 aa, Artificial Sequence; identical to SEQ ID NO: 22059
  Description of Artificial Sequence: Synthetic polypeptide
  XENP021860 2A11_H1_L2.50_Fab-[CTLA-4]_H3.23_L0.129 Light Chain

SEQ ID NO: 38934 - protein, 107 aa, Artificial Sequence; identical to SEQ ID NO: 22060
  Description of Artificial Sequence: Synthetic polypeptide
  VL of XENP021860

SEQ ID NO: 38935 - protein, 11 aa, Artificial Sequence
  Description of Artificial Sequence: Synthetic peptide
  XENP021860 vlCDR1
QASQDIGNYLN

SEQ ID NO: 38936 - protein, 7 aa, Artificial Sequence
  Description of Artificial Sequence: Synthetic peptide
  XENP021860 vlCDR2
YTSYLHS

SEQ ID NO: 38937 - protein, 9 aa, Artificial Sequence
  Description of Artificial Sequence: Synthetic peptide
  XENP021860 vlCDR3
QQGNTLPYT

SEQ ID NO: 38938 - protein, 450 aa, Artificial Sequence; identical to SEQ ID NO: 22324
  Description of Artificial Sequence: Synthetic polypeptide
  XENP021895 7G8_H3.18_L1-[CTLA-4]_H3.23_L0.129 Fab-Fc Heavy Chain

SEQ ID NO: 38939 - protein, 121 aa, Artificial Sequence; identical to SEQ ID NO: 22325
  Description of Artificial Sequence: Synthetic polypeptide
  VH of XENP021895

SEQ ID NO: 38940 - protein, 5 aa, Artificial Sequence
  Description of Artificial Sequence: Synthetic peptide
  XENP021895 vhCDR1
DAWMD

SEQ ID NO: 38941 - protein, 19 aa, Artificial Sequence
  Description of Artificial Sequence: Synthetic peptide
  XENP021895 vhCDR2
EISTKANNHATYYAESVKG

SEQ ID NO: 38942 - protein, 10 aa, Artificial Sequence
  Description of Artificial Sequence: Synthetic peptide
  XENP021895 vhCDR3
LATWDWYFDV

SEQ ID NO: 38943 - protein, 477 aa, Artificial Sequence; identical to SEQ ID NO: 21669
  Description of Artificial Sequence: Synthetic polypeptide
  XENP021895 7G8_H3.18_L1-[CTLA-4]_H3.23_L0.129 scFv-Fc Heavy Chain

SEQ ID NO: 38944 - protein, 118 aa, Artificial Sequence; identical to SEQ ID NO: 2632
  Description of Artificial Sequence: Synthetic polypeptide
  VH of XENP021895

SEQ ID NO: 38945 - protein, 108 aa, Artificial Sequence; identical to SEQ ID NO: 2768
  Description of Artificial Sequence: Synthetic polypeptide
  VL of XENP021895

SEQ ID NO: 38946 - protein, 231 aa, Artificial Sequence; identical to SEQ ID NO: 21532
  Description of Artificial Sequence: Synthetic polypeptide
  Fc chain of XENP021895

SEQ ID NO: 38947 - protein, 5 aa, Artificial Sequence
  Description of Artificial Sequence: Synthetic peptide
  XENP021895 vhCDR1
SYTMH

SEQ ID NO: 38948 - protein, 17 aa, Artificial Sequence
  Description of Artificial Sequence: Synthetic peptide
  XENP021895 vhCDR2
FISYDGNYKYYADSVKG

SEQ ID NO: 38949 - protein, 9 aa, Artificial Sequence
  Description of Artificial Sequence: Synthetic peptide
  XENP021895 vhCDR3
GGHLGPFDL

SEQ ID NO: 38950 - protein, 12 aa, Artificial Sequence
  Description of Artificial Sequence: Synthetic peptide
  XENP021895 vlCDR1
RASQSVGSSYLA

SEQ ID NO: 38951 - protein, 7 aa, Artificial Sequence
  Description of Artificial Sequence: Synthetic peptide
  XENP021895 vlCDR2
GASSRAT

SEQ ID NO: 38952 - protein, 9 aa, Artificial Sequence
  Description of Artificial Sequence: Synthetic peptide
  XENP021895 vlCDR3
QQYGSSPWT

SEQ ID NO: 38953 - protein, 218 aa, Artificial Sequence; identical to SEQ ID NO: 17600
  Description of Artificial Sequence: Synthetic polypeptide
  XENP021895 7G8_H3.18_L1-[CTLA-4]_H3.23_L0.129 Light Chain

SEQ ID NO: 38954 - protein, 111 aa, Artificial Sequence; identical to SEQ ID NO: 17601
  Description of Artificial Sequence: Synthetic polypeptide
  VL of XENP021895

SEQ ID NO: 38955 - protein, 15 aa, Artificial Sequence
  Description of Artificial Sequence: Synthetic peptide
  XENP021895 vlCDR1
RASQSVDYDGDSYMN

SEQ ID NO: 38956 - protein, 7 aa, Artificial Sequence
  Description of Artificial Sequence: Synthetic peptide
  XENP021895 vlCDR2
AASNLES

SEQ ID NO: 38957 - protein, 9 aa, Artificial Sequence
  Description of Artificial Sequence: Synthetic peptide
  XENP021895 vlCDR3
QQSNEDPFT

SEQ ID NO: 38958 - protein, 450 aa, Artificial Sequence; identical to SEQ ID NO: 22324
  Description of Artificial Sequence: Synthetic polypeptide
  XENP021896 7G8_H3.18_L1.11-[CTLA-4]_H3.23_L0.129 Fab-Fc Heavy Chain

SEQ ID NO: 38959 - protein, 121 aa, Artificial Sequence; identical to SEQ ID NO: 22325
  Description of Artificial Sequence: Synthetic polypeptide
  VH of XENP021896

SEQ ID NO: 38960 - protein, 5 aa, Artificial Sequence
  Description of Artificial Sequence: Synthetic peptide
  XENP021896 vhCDR1
DAWMD

SEQ ID NO: 38961 - protein, 19 aa, Artificial Sequence
  Description of Artificial Sequence: Synthetic peptide
  XENP021896 vhCDR2
EISTKANNHATYYAESVKG

SEQ ID NO: 38962 - protein, 10 aa, Artificial Sequence
  Description of Artificial Sequence: Synthetic peptide
  XENP021896 vhCDR3
LATWDWYFDV

SEQ ID NO: 38963 - protein, 477 aa, Artificial Sequence; identical to SEQ ID NO: 21669
  Description of Artificial Sequence: Synthetic polypeptide
  XENP021896 7G8_H3.18_L1.11-[CTLA-4]_H3.23_L0.129 scFv-Fc Heavy Chain

SEQ ID NO: 38964 - protein, 118 aa, Artificial Sequence; identical to SEQ ID NO: 2632
  Description of Artificial Sequence: Synthetic polypeptide
  VH of XENP021896

SEQ ID NO: 38965 - protein, 108 aa, Artificial Sequence; identical to SEQ ID NO: 2768
  Description of Artificial Sequence: Synthetic polypeptide
  VL of XENP021896

SEQ ID NO: 38966 - protein, 231 aa, Artificial Sequence; identical to SEQ ID NO: 21532
  Description of Artificial Sequence: Synthetic polypeptide
  Fc chain of XENP021896

SEQ ID NO: 38967 - protein, 5 aa, Artificial Sequence
  Description of Artificial Sequence: Synthetic peptide
  XENP021896 vhCDR1
SYTMH

SEQ ID NO: 38968 - protein, 17 aa, Artificial Sequence
  Description of Artificial Sequence: Synthetic peptide
  XENP021896 vhCDR2
FISYDGNYKYYADSVKG

SEQ ID NO: 38969 - protein, 9 aa, Artificial Sequence
  Description of Artificial Sequence: Synthetic peptide
  XENP021896 vhCDR3
GGHLGPFDL

SEQ ID NO: 38970 - protein, 12 aa, Artificial Sequence
  Description of Artificial Sequence: Synthetic peptide
  XENP021896 vlCDR1
RASQSVGSSYLA

SEQ ID NO: 38971 - protein, 7 aa, Artificial Sequence
  Description of Artificial Sequence: Synthetic peptide
  XENP021896 vlCDR2
GASSRAT

SEQ ID NO: 38972 - protein, 9 aa, Artificial Sequence
  Description of Artificial Sequence: Synthetic peptide
  XENP021896 vlCDR3
QQYGSSPWT

SEQ ID NO: 38973 - protein, 218 aa, Artificial Sequence; identical to SEQ ID NO: 22359
  Description of Artificial Sequence: Synthetic polypeptide
  XENP021896 7G8_H3.18_L1.11-[CTLA-4]_H3.23_L0.129 Light Chain

SEQ ID NO: 38974 - protein, 111 aa, Artificial Sequence; identical to SEQ ID NO: 22360
  Description of Artificial Sequence: Synthetic polypeptide
  VL of XENP021896

SEQ ID NO: 38975 - protein, 15 aa, Artificial Sequence
  Description of Artificial Sequence: Synthetic peptide
  XENP021896 vlCDR1
RASQSVDYDGDSYMN

SEQ ID NO: 38976 - protein, 7 aa, Artificial Sequence
  Description of Artificial Sequence: Synthetic peptide
  XENP021896 vlCDR2
AASELES

SEQ ID NO: 38977 - protein, 9 aa, Artificial Sequence
  Description of Artificial Sequence: Synthetic peptide
  XENP021896 vlCDR3
QQSNEDPFT

SEQ ID NO: 38978 - protein, 450 aa, Artificial Sequence; identical to SEQ ID NO: 22384
  Description of Artificial Sequence: Synthetic polypeptide
  XENP021902 7G8_H3.23_L1.11-[CTLA-4]_H3.23_L0.129 Fab-Fc Heavy Chain

SEQ ID NO: 38979 - protein, 121 aa, Artificial Sequence; identical to SEQ ID NO: 22385
  Description of Artificial Sequence: Synthetic polypeptide
  VH of XENP021902

SEQ ID NO: 38980 - protein, 5 aa, Artificial Sequence
  Description of Artificial Sequence: Synthetic peptide
  XENP021902 vhCDR1
DAWMD

SEQ ID NO: 38981 - protein, 19 aa, Artificial Sequence
  Description of Artificial Sequence: Synthetic peptide
  XENP021902 vhCDR2
EISTKANNHATYYAESVKG

SEQ ID NO: 38982 - protein, 10 aa, Artificial Sequence
  Description of Artificial Sequence: Synthetic peptide
  XENP021902 vhCDR3
LATWDWYFDV

SEQ ID NO: 38983 - protein, 477 aa, Artificial Sequence; identical to SEQ ID NO: 21669
  Description of Artificial Sequence: Synthetic polypeptide
  XENP021902 7G8_H3.23_L1.11-[CTLA-4]_H3.23_L0.129 scFv-Fc Heavy Chain

SEQ ID NO: 38984 - protein, 118 aa, Artificial Sequence; identical to SEQ ID NO: 2632
  Description of Artificial Sequence: Synthetic polypeptide
  VH of XENP021902

SEQ ID NO: 38985 - protein, 108 aa, Artificial Sequence; identical to SEQ ID NO: 2768
  Description of Artificial Sequence: Synthetic polypeptide
  VL of XENP021902

SEQ ID NO: 38986 - protein, 231 aa, Artificial Sequence; identical to SEQ ID NO: 21532
  Description of Artificial Sequence: Synthetic polypeptide
  Fc chain of XENP021902

SEQ ID NO: 38987 - protein, 5 aa, Artificial Sequence
  Description of Artificial Sequence: Synthetic peptide
  XENP021902 vhCDR1
SYTMH

SEQ ID NO: 38988 - protein, 17 aa, Artificial Sequence
  Description of Artificial Sequence: Synthetic peptide
  XENP021902 vhCDR2
FISYDGNYKYYADSVKG

SEQ ID NO: 38989 - protein, 9 aa, Artificial Sequence
  Description of Artificial Sequence: Synthetic peptide
  XENP021902 vhCDR3
GGHLGPFDL

SEQ ID NO: 38990 - protein, 12 aa, Artificial Sequence
  Description of Artificial Sequence: Synthetic peptide
  XENP021902 vlCDR1
RASQSVGSSYLA

SEQ ID NO: 38991 - protein, 7 aa, Artificial Sequence
  Description of Artificial Sequence: Synthetic peptide
  XENP021902 vlCDR2
GASSRAT

SEQ ID NO: 38992 - protein, 9 aa, Artificial Sequence
  Description of Artificial Sequence: Synthetic peptide
  XENP021902 vlCDR3
QQYGSSPWT

SEQ ID NO: 38993 - protein, 218 aa, Artificial Sequence; identical to SEQ ID NO: 22359
  Description of Artificial Sequence: Synthetic polypeptide
  XENP021902 7G8_H3.23_L1.11-[CTLA-4]_H3.23_L0.129 Light Chain

SEQ ID NO: 38994 - protein, 111 aa, Artificial Sequence; identical to SEQ ID NO: 22360
  Description of Artificial Sequence: Synthetic polypeptide
  VL of XENP021902

SEQ ID NO: 38995 - protein, 15 aa, Artificial Sequence
  Description of Artificial Sequence: Synthetic peptide
  XENP021902 vlCDR1
RASQSVDYDGDSYMN

SEQ ID NO: 38996 - protein, 7 aa, Artificial Sequence
  Description of Artificial Sequence: Synthetic peptide
  XENP021902 vlCDR2
AASELES

SEQ ID NO: 38997 - protein, 9 aa, Artificial Sequence
  Description of Artificial Sequence: Synthetic peptide
  XENP021902 vlCDR3
QQSNEDPFT

SEQ ID NO: 38998 - protein, 450 aa, Artificial Sequence; identical to SEQ ID NO: 22424
  Description of Artificial Sequence: Synthetic polypeptide
  XENP021904 7G8_H3.28_L1-[CTLA-4]_H3.23_L0.129 Fab-Fc Heavy Chain

SEQ ID NO: 38999 - protein, 121 aa, Artificial Sequence; identical to SEQ ID NO: 22425
  Description of Artificial Sequence: Synthetic polypeptide
  VH of XENP021904

SEQ ID NO: 39000 - protein, 5 aa, Artificial Sequence
  Description of Artificial Sequence: Synthetic peptide
  XENP021904 vhCDR1
DAWMD

SEQ ID NO: 39001 - protein, 19 aa, Artificial Sequence
  Description of Artificial Sequence: Synthetic peptide
  XENP021904 vhCDR2
EISTKAYNHATYYAESVKG

SEQ ID NO: 39002 - protein, 10 aa, Artificial Sequence
  Description of Artificial Sequence: Synthetic peptide
  XENP021904 vhCDR3
LATWDWYFDV

SEQ ID NO: 39003 - protein, 477 aa, Artificial Sequence; identical to SEQ ID NO: 21669
  Description of Artificial Sequence: Synthetic polypeptide
  XENP021904 7G8_H3.28_L1-[CTLA-4]_H3.23_L0.129 scFv-Fc Heavy Chain

SEQ ID NO: 39004 - protein, 118 aa, Artificial Sequence; identical to SEQ ID NO: 2632
  Description of Artificial Sequence: Synthetic polypeptide
  VH of XENP021904

SEQ ID NO: 39005 - protein, 108 aa, Artificial Sequence; identical to SEQ ID NO: 2768
  Description of Artificial Sequence: Synthetic polypeptide
  VL of XENP021904

SEQ ID NO: 39006 - protein, 231 aa, Artificial Sequence; identical to SEQ ID NO: 21532
  Description of Artificial Sequence: Synthetic polypeptide
  Fc chain of XENP021904

SEQ ID NO: 39007 - protein, 5 aa, Artificial Sequence
  Description of Artificial Sequence: Synthetic peptide
  XENP021904 vhCDR1
SYTMH

SEQ ID NO: 39008 - protein, 17 aa, Artificial Sequence
  Description of Artificial Sequence: Synthetic peptide
  XENP021904 vhCDR2
FISYDGNYKYYADSVKG

SEQ ID NO: 39009 - protein, 9 aa, Artificial Sequence
  Description of Artificial Sequence: Synthetic peptide
  XENP021904 vhCDR3
GGHLGPFDL

SEQ ID NO: 39010 - protein, 12 aa, Artificial Sequence
  Description of Artificial Sequence: Synthetic peptide
  XENP021904 vlCDR1
RASQSVGSSYLA

SEQ ID NO: 39011 - protein, 7 aa, Artificial Sequence
  Description of Artificial Sequence: Synthetic peptide
  XENP021904 vlCDR2
GASSRAT

SEQ ID NO: 39012 - protein, 9 aa, Artificial Sequence
  Description of Artificial Sequence: Synthetic peptide
  XENP021904 vlCDR3
QQYGSSPWT

SEQ ID NO: 39013 - protein, 218 aa, Artificial Sequence; identical to SEQ ID NO: 17600
  Description of Artificial Sequence: Synthetic polypeptide
  XENP021904 7G8_H3.28_L1-[CTLA-4]_H3.23_L0.129 Light Chain

SEQ ID NO: 39014 - protein, 111 aa, Artificial Sequence; identical to SEQ ID NO: 17601
  Description of Artificial Sequence: Synthetic polypeptide
  VL of XENP021904

SEQ ID NO: 39015 - protein, 15 aa, Artificial Sequence
  Description of Artificial Sequence: Synthetic peptide
  XENP021904 vlCDR1
RASQSVDYDGDSYMN

SEQ ID NO: 39016 - protein, 7 aa, Artificial Sequence
  Description of Artificial Sequence: Synthetic peptide
  XENP021904 vlCDR2
AASNLES

SEQ ID NO: 39017 - protein, 9 aa, Artificial Sequence
  Description of Artificial Sequence: Synthetic peptide
  XENP021904 vlCDR3
QQSNEDPFT

SEQ ID NO: 39018 - protein, 450 aa, Artificial Sequence; identical to SEQ ID NO: 22424
  Description of Artificial Sequence: Synthetic polypeptide
  XENP021905 7G8_H3.28_L1.11-[CTLA-4]_H3.23_L0.129 Fab-Fc Heavy Chain

SEQ ID NO: 39019 - protein, 121 aa, Artificial Sequence; identical to SEQ ID NO: 22425
  Description of Artificial Sequence: Synthetic polypeptide
  VH of XENP021905

SEQ ID NO: 39020 - protein, 5 aa, Artificial Sequence
  Description of Artificial Sequence: Synthetic peptide
  XENP021905 vhCDR1
DAWMD

SEQ ID NO: 39021 - protein, 19 aa, Artificial Sequence
  Description of Artificial Sequence: Synthetic peptide
  XENP021905 vhCDR2
EISTKAYNHATYYAESVKG

SEQ ID NO: 39022 - protein, 10 aa, Artificial Sequence
  Description of Artificial Sequence: Synthetic peptide
  XENP021905 vhCDR3
LATWDWYFDV

SEQ ID NO: 39023 - protein, 477 aa, Artificial Sequence; identical to SEQ ID NO: 21669
  Description of Artificial Sequence: Synthetic polypeptide
  XENP021905 7G8_H3.28_L1.11-[CTLA-4]_H3.23_L0.129 scFv-Fc Heavy Chain

SEQ ID NO: 39024 - protein, 118 aa, Artificial Sequence; identical to SEQ ID NO: 2632
  Description of Artificial Sequence: Synthetic polypeptide
  VH of XENP021905

SEQ ID NO: 39025 - protein, 108 aa, Artificial Sequence; identical to SEQ ID NO: 2768
  Description of Artificial Sequence: Synthetic polypeptide
  VL of XENP021905

SEQ ID NO: 39026 - protein, 231 aa, Artificial Sequence; identical to SEQ ID NO: 21532
  Description of Artificial Sequence: Synthetic polypeptide
  Fc chain of XENP021905

SEQ ID NO: 39027 - protein, 5 aa, Artificial Sequence
  Description of Artificial Sequence: Synthetic peptide
  XENP021905 vhCDR1
SYTMH

SEQ ID NO: 39028 - protein, 17 aa, Artificial Sequence
  Description of Artificial Sequence: Synthetic peptide
  XENP021905 vhCDR2
FISYDGNYKYYADSVKG

SEQ ID NO: 39029 - protein, 9 aa, Artificial Sequence
  Description of Artificial Sequence: Synthetic peptide
  XENP021905 vhCDR3
GGHLGPFDL

SEQ ID NO: 39030 - protein, 12 aa, Artificial Sequence
  Description of Artificial Sequence: Synthetic peptide
  XENP021905 vlCDR1
RASQSVGSSYLA

SEQ ID NO: 39031 - protein, 7 aa, Artificial Sequence
  Description of Artificial Sequence: Synthetic peptide
  XENP021905 vlCDR2
GASSRAT

SEQ ID NO: 39032 - protein, 9 aa, Artificial Sequence
  Description of Artificial Sequence: Synthetic peptide
  XENP021905 vlCDR3
QQYGSSPWT

SEQ ID NO: 39033 - protein, 218 aa, Artificial Sequence; identical to SEQ ID NO: 22359
  Description of Artificial Sequence: Synthetic polypeptide
  XENP021905 7G8_H3.28_L1.11-[CTLA-4]_H3.23_L0.129 Light Chain

SEQ ID NO: 39034 - protein, 111 aa, Artificial Sequence; identical to SEQ ID NO: 22360
  Description of Artificial Sequence: Synthetic polypeptide
  VL of XENP021905

SEQ ID NO: 39035 - protein, 15 aa, Artificial Sequence
  Description of Artificial Sequence: Synthetic peptide
  XENP021905 vlCDR1
RASQSVDYDGDSYMN

SEQ ID NO: 39036 - protein, 7 aa, Artificial Sequence
  Description of Artificial Sequence: Synthetic peptide
  XENP021905 vlCDR2
AASELES

SEQ ID NO: 39037 - protein, 9 aa, Artificial Sequence
  Description of Artificial Sequence: Synthetic peptide
  XENP021905 vlCDR3
QQSNEDPFT

SEQ ID NO: 39038 - protein, 450 aa, Artificial Sequence; identical to SEQ ID NO: 22424
  Description of Artificial Sequence: Synthetic polypeptide
  XENP021906 7G8_H3.28_L1.13-[CTLA-4]_H3.23_L0.129 Fab-Fc Heavy Chain

SEQ ID NO: 39039 - protein, 121 aa, Artificial Sequence; identical to SEQ ID NO: 22425
  Description of Artificial Sequence: Synthetic polypeptide
  VH of XENP021906

SEQ ID NO: 39040 - protein, 5 aa, Artificial Sequence
  Description of Artificial Sequence: Synthetic peptide
  XENP021906 vhCDR1
DAWMD

SEQ ID NO: 39041 - protein, 19 aa, Artificial Sequence
  Description of Artificial Sequence: Synthetic peptide
  XENP021906 vhCDR2
EISTKAYNHATYYAESVKG

SEQ ID NO: 39042 - protein, 10 aa, Artificial Sequence
  Description of Artificial Sequence: Synthetic peptide
  XENP021906 vhCDR3
LATWDWYFDV

SEQ ID NO: 39043 - protein, 477 aa, Artificial Sequence; identical to SEQ ID NO: 21669
  Description of Artificial Sequence: Synthetic polypeptide
  XENP021906 7G8_H3.28_L1.13-[CTLA-4]_H3.23_L0.129 scFv-Fc Heavy Chain

SEQ ID NO: 39044 - protein, 118 aa, Artificial Sequence; identical to SEQ ID NO: 2632
  Description of Artificial Sequence: Synthetic polypeptide
  VH of XENP021906

SEQ ID NO: 39045 - protein, 108 aa, Artificial Sequence; identical to SEQ ID NO: 2768
  Description of Artificial Sequence: Synthetic polypeptide
  VL of XENP021906

SEQ ID NO: 39046 - protein, 231 aa, Artificial Sequence; identical to SEQ ID NO: 21532
  Description of Artificial Sequence: Synthetic polypeptide
  Fc chain of XENP021906

SEQ ID NO: 39047 - protein, 5 aa, Artificial Sequence
  Description of Artificial Sequence: Synthetic peptide
  XENP021906 vhCDR1
SYTMH

SEQ ID NO: 39048 - protein, 17 aa, Artificial Sequence
  Description of Artificial Sequence: Synthetic peptide
  XENP021906 vhCDR2
FISYDGNYKYYADSVKG

SEQ ID NO: 39049 - protein, 9 aa, Artificial Sequence
  Description of Artificial Sequence: Synthetic peptide
  XENP021906 vhCDR3
GGHLGPFDL

SEQ ID NO: 39050 - protein, 12 aa, Artificial Sequence
  Description of Artificial Sequence: Synthetic peptide
  XENP021906 vlCDR1
RASQSVGSSYLA

SEQ ID NO: 39051 - protein, 7 aa, Artificial Sequence
  Description of Artificial Sequence: Synthetic peptide
  XENP021906 vlCDR2
GASSRAT

SEQ ID NO: 39052 - protein, 9 aa, Artificial Sequence
  Description of Artificial Sequence: Synthetic peptide
  XENP021906 vlCDR3
QQYGSSPWT

SEQ ID NO: 39053 - protein, 218 aa, Artificial Sequence; identical to SEQ ID NO: 22419
  Description of Artificial Sequence: Synthetic polypeptide
  XENP021906 7G8_H3.28_L1.13-[CTLA-4]_H3.23_L0.129 Light Chain

SEQ ID NO: 39054 - protein, 111 aa, Artificial Sequence; identical to SEQ ID NO: 22420
  Description of Artificial Sequence: Synthetic polypeptide
  VL of XENP021906

SEQ ID NO: 39055 - protein, 15 aa, Artificial Sequence
  Description of Artificial Sequence: Synthetic peptide
  XENP021906 vlCDR1
RASQSVDHDGDSYMN

SEQ ID NO: 39056 - protein, 7 aa, Artificial Sequence
  Description of Artificial Sequence: Synthetic peptide
  XENP021906 vlCDR2
AASELES

SEQ ID NO: 39057 - protein, 9 aa, Artificial Sequence
  Description of Artificial Sequence: Synthetic peptide
  XENP021906 vlCDR3
QQSNEDPFT

SEQ ID NO: 39058 - protein, 447 aa, Artificial Sequence; identical to SEQ ID NO: 22064
  Description of Artificial Sequence: Synthetic polypeptide
  XENP022505 2A11_H1.125_L2.113_Fab-[CTLA-4]_H3.23_L0.129 Fab-Fc Heavy Chain

SEQ ID NO: 39059 - protein, 118 aa, Artificial Sequence; identical to SEQ ID NO: 22065
  Description of Artificial Sequence: Synthetic polypeptide
  VH of XENP022505

SEQ ID NO: 39060 - protein, 5 aa, Artificial Sequence
  Description of Artificial Sequence: Synthetic peptide
  XENP022505 vhCDR1
HYFMH

SEQ ID NO: 39061 - protein, 17 aa, Artificial Sequence
  Description of Artificial Sequence: Synthetic peptide
  XENP022505 vhCDR2
WIDPYLGDTEYAPKFQG

SEQ ID NO: 39062 - protein, 9 aa, Artificial Sequence
  Description of Artificial Sequence: Synthetic peptide
  XENP022505 vhCDR3
RGVYQALDY

SEQ ID NO: 39063 - protein, 477 aa, Artificial Sequence; identical to SEQ ID NO: 21669
  Description of Artificial Sequence: Synthetic polypeptide
  XENP022505 2A11_H1.125_L2.113_Fab-[CTLA-4]_H3.23_L0.129 scFv-Fc Heavy Chain

SEQ ID NO: 39064 - protein, 118 aa, Artificial Sequence; identical to SEQ ID NO: 2632
  Description of Artificial Sequence: Synthetic polypeptide
  VH of XENP022505

SEQ ID NO: 39065 - protein, 108 aa, Artificial Sequence; identical to SEQ ID NO: 2768
  Description of Artificial Sequence: Synthetic polypeptide
  VL of XENP022505

SEQ ID NO: 39066 - protein, 231 aa, Artificial Sequence; identical to SEQ ID NO: 21532
  Description of Artificial Sequence: Synthetic polypeptide
  Fc chain of XENP022505

SEQ ID NO: 39067 - protein, 5 aa, Artificial Sequence
  Description of Artificial Sequence: Synthetic peptide
  XENP022505 vhCDR1
SYTMH

SEQ ID NO: 39068 - protein, 17 aa, Artificial Sequence
  Description of Artificial Sequence: Synthetic peptide
  XENP022505 vhCDR2
FISYDGNYKYYADSVKG

SEQ ID NO: 39069 - protein, 9 aa, Artificial Sequence
  Description of Artificial Sequence: Synthetic peptide
  XENP022505 vhCDR3
GGHLGPFDL

SEQ ID NO: 39070 - protein, 12 aa, Artificial Sequence
  Description of Artificial Sequence: Synthetic peptide
  XENP022505 vlCDR1
RASQSVGSSYLA

SEQ ID NO: 39071 - protein, 7 aa, Artificial Sequence
  Description of Artificial Sequence: Synthetic peptide
  XENP022505 vlCDR2
GASSRAT

SEQ ID NO: 39072 - protein, 9 aa, Artificial Sequence
  Description of Artificial Sequence: Synthetic peptide
  XENP022505 vlCDR3
QQYGSSPWT

SEQ ID NO: 39073 - protein, 214 aa, Artificial Sequence; identical to SEQ ID NO: 22079
  Description of Artificial Sequence: Synthetic polypeptide
  XENP022505 2A11_H1.125_L2.113_Fab-[CTLA-4]_H3.23_L0.129 Light Chain

SEQ ID NO: 39074 - protein, 107 aa, Artificial Sequence; identical to SEQ ID NO: 22080
  Description of Artificial Sequence: Synthetic polypeptide
  VL of XENP022505

SEQ ID NO: 39075 - protein, 11 aa, Artificial Sequence
  Description of Artificial Sequence: Synthetic peptide
  XENP022505 vlCDR1
QASQDIGNYLN

SEQ ID NO: 39076 - protein, 7 aa, Artificial Sequence
  Description of Artificial Sequence: Synthetic peptide
  XENP022505 vlCDR2
FTSYLHS

SEQ ID NO: 39077 - protein, 9 aa, Artificial Sequence
  Description of Artificial Sequence: Synthetic peptide
  XENP022505 vlCDR3
QQGNTLPYT

SEQ ID NO: 39078 - protein, 447 aa, Artificial Sequence; identical to SEQ ID NO: 17235
  Description of Artificial Sequence: Synthetic polypeptide
  XENP022510 2A11_H1_L2.25_Fab-[CTLA-4]_H3.23_L0.129 Fab-Fc Heavy Chain

SEQ ID NO: 39079 - protein, 118 aa, Artificial Sequence; identical to SEQ ID NO: 17236
  Description of Artificial Sequence: Synthetic polypeptide
  VH of XENP022510

SEQ ID NO: 39080 - protein, 5 aa, Artificial Sequence
  Description of Artificial Sequence: Synthetic peptide
  XENP022510 vhCDR1
DYYMH

SEQ ID NO: 39081 - protein, 17 aa, Artificial Sequence
  Description of Artificial Sequence: Synthetic peptide
  XENP022510 vhCDR2
WIDPENGDTEYAPKFQG

SEQ ID NO: 39082 - protein, 9 aa, Artificial Sequence
  Description of Artificial Sequence: Synthetic peptide
  XENP022510 vhCDR3
RGVRQALDY

SEQ ID NO: 39083 - protein, 477 aa, Artificial Sequence; identical to SEQ ID NO: 21669
  Description of Artificial Sequence: Synthetic polypeptide
  XENP022510 2A11_H1_L2.25_Fab-[CTLA-4]_H3.23_L0.129 scFv-Fc Heavy Chain

SEQ ID NO: 39084 - protein, 118 aa, Artificial Sequence; identical to SEQ ID NO: 2632
  Description of Artificial Sequence: Synthetic polypeptide
  VH of XENP022510

SEQ ID NO: 39085 - protein, 108 aa, Artificial Sequence; identical to SEQ ID NO: 2768
  Description of Artificial Sequence: Synthetic polypeptide
  VL of XENP022510

SEQ ID NO: 39086 - protein, 231 aa, Artificial Sequence; identical to SEQ ID NO: 21532
  Description of Artificial Sequence: Synthetic polypeptide
  Fc chain of XENP022510

SEQ ID NO: 39087 - protein, 5 aa, Artificial Sequence
  Description of Artificial Sequence: Synthetic peptide
  XENP022510 vhCDR1
SYTMH

SEQ ID NO: 39088 - protein, 17 aa, Artificial Sequence
  Description of Artificial Sequence: Synthetic peptide
  XENP022510 vhCDR2
FISYDGNYKYYADSVKG

SEQ ID NO: 39089 - protein, 9 aa, Artificial Sequence
  Description of Artificial Sequence: Synthetic peptide
  XENP022510 vhCDR3
GGHLGPFDL

SEQ ID NO: 39090 - protein, 12 aa, Artificial Sequence
  Description of Artificial Sequence: Synthetic peptide
  XENP022510 vlCDR1
RASQSVGSSYLA

SEQ ID NO: 39091 - protein, 7 aa, Artificial Sequence
  Description of Artificial Sequence: Synthetic peptide
  XENP022510 vlCDR2
GASSRAT

SEQ ID NO: 39092 - protein, 9 aa, Artificial Sequence
  Description of Artificial Sequence: Synthetic peptide
  XENP022510 vlCDR3
QQYGSSPWT

SEQ ID NO: 39093 - protein, 214 aa, Artificial Sequence; identical to SEQ ID NO: 22179
  Description of Artificial Sequence: Synthetic polypeptide
  XENP022510 2A11_H1_L2.25_Fab-[CTLA-4]_H3.23_L0.129 Light Chain

SEQ ID NO: 39094 - protein, 107 aa, Artificial Sequence; identical to SEQ ID NO: 22180
  Description of Artificial Sequence: Synthetic polypeptide
  VL of XENP022510

SEQ ID NO: 39095 - protein, 11 aa, Artificial Sequence
  Description of Artificial Sequence: Synthetic peptide
  XENP022510 vlCDR1
QASQDIGNHLN

SEQ ID NO: 39096 - protein, 7 aa, Artificial Sequence
  Description of Artificial Sequence: Synthetic peptide
  XENP022510 vlCDR2
YTSRLHS

SEQ ID NO: 39097 - protein, 9 aa, Artificial Sequence
  Description of Artificial Sequence: Synthetic peptide
  XENP022510 vlCDR3
QQGNTLPYT

SEQ ID NO: 39098 - protein, 450 aa, Artificial Sequence; identical to SEQ ID NO: 22484
  Description of Artificial Sequence: Synthetic polypeptide
  XENP022602 7G8_H3.30_L1.34-[CTLA-4]_H3.23_L0.129 Fab-Fc Heavy Chain

SEQ ID NO: 39099 - protein, 121 aa, Artificial Sequence; identical to SEQ ID NO: 22485
  Description of Artificial Sequence: Synthetic polypeptide
  VH of XENP022602

SEQ ID NO: 39100 - protein, 5 aa, Artificial Sequence
  Description of Artificial Sequence: Synthetic peptide
  XENP022602 vhCDR1
DAWMS

SEQ ID NO: 39101 - protein, 19 aa, Artificial Sequence
  Description of Artificial Sequence: Synthetic peptide
  XENP022602 vhCDR2
EISTKANNHATYYAESVKG

SEQ ID NO: 39102 - protein, 10 aa, Artificial Sequence
  Description of Artificial Sequence: Synthetic peptide
  XENP022602 vhCDR3
LATWDWYFDV

SEQ ID NO: 39103 - protein, 477 aa, Artificial Sequence; identical to SEQ ID NO: 21669
  Description of Artificial Sequence: Synthetic polypeptide
  XENP022602 7G8_H3.30_L1.34-[CTLA-4]_H3.23_L0.129 scFv-Fc Heavy Chain

SEQ ID NO: 39104 - protein, 118 aa, Artificial Sequence; identical to SEQ ID NO: 2632
  Description of Artificial Sequence: Synthetic polypeptide
  VH of XENP022602

SEQ ID NO: 39105 - protein, 108 aa, Artificial Sequence; identical to SEQ ID NO: 2768
  Description of Artificial Sequence: Synthetic polypeptide
  VL of XENP022602

SEQ ID NO: 39106 - protein, 231 aa, Artificial Sequence; identical to SEQ ID NO: 21532
  Description of Artificial Sequence: Synthetic polypeptide
  Fc chain of XENP022602

SEQ ID NO: 39107 - protein, 5 aa, Artificial Sequence
  Description of Artificial Sequence: Synthetic peptide
  XENP022602 vhCDR1
SYTMH

SEQ ID NO: 39108 - protein, 17 aa, Artificial Sequence
  Description of Artificial Sequence: Synthetic peptide
  XENP022602 vhCDR2
FISYDGNYKYYADSVKG

SEQ ID NO: 39109 - protein, 9 aa, Artificial Sequence
  Description of Artificial Sequence: Synthetic peptide
  XENP022602 vhCDR3
GGHLGPFDL

SEQ ID NO: 39110 - protein, 12 aa, Artificial Sequence
  Description of Artificial Sequence: Synthetic peptide
  XENP022602 vlCDR1
RASQSVGSSYLA

SEQ ID NO: 39111 - protein, 7 aa, Artificial Sequence
  Description of Artificial Sequence: Synthetic peptide
  XENP022602 vlCDR2
GASSRAT

SEQ ID NO: 39112 - protein, 9 aa, Artificial Sequence
  Description of Artificial Sequence: Synthetic peptide
  XENP022602 vlCDR3
QQYGSSPWT

SEQ ID NO: 39113 - protein, 218 aa, Artificial Sequence; identical to SEQ ID NO: 22599
  Description of Artificial Sequence: Synthetic polypeptide
  XENP022602 7G8_H3.30_L1.34-[CTLA-4]_H3.23_L0.129 Light Chain

SEQ ID NO: 39114 - protein, 111 aa, Artificial Sequence; identical to SEQ ID NO: 22600
  Description of Artificial Sequence: Synthetic polypeptide
  VL of XENP022602

SEQ ID NO: 39115 - protein, 15 aa, Artificial Sequence
  Description of Artificial Sequence: Synthetic peptide
  XENP022602 vlCDR1
RASQSVDYDGDSYMN

SEQ ID NO: 39116 - protein, 7 aa, Artificial Sequence
  Description of Artificial Sequence: Synthetic peptide
  XENP022602 vlCDR2
AASELES

SEQ ID NO: 39117 - protein, 9 aa, Artificial Sequence
  Description of Artificial Sequence: Synthetic peptide
  XENP022602 vlCDR3
QQSNEDPFT

SEQ ID NO: 39118 - protein, 447 aa, Artificial Sequence; identical to SEQ ID NO: 22084
  Description of Artificial Sequence: Synthetic polypeptide
  XENP022675 2A11_H1.144_L2.142_Fab-[CTLA-4]_H3.23_L0.129 Fab-Fc Heavy Chain

SEQ ID NO: 39119 - protein, 118 aa, Artificial Sequence; identical to SEQ ID NO: 22085
  Description of Artificial Sequence: Synthetic polypeptide
  VH of XENP022675

SEQ ID NO: 39120 - protein, 5 aa, Artificial Sequence
  Description of Artificial Sequence: Synthetic peptide
  XENP022675 vhCDR1
DYFMH

SEQ ID NO: 39121 - protein, 17 aa, Artificial Sequence
  Description of Artificial Sequence: Synthetic peptide
  XENP022675 vhCDR2
WIDPELGDTEYAPKFQG

SEQ ID NO: 39122 - protein, 9 aa, Artificial Sequence
  Description of Artificial Sequence: Synthetic peptide
  XENP022675 vhCDR3
RGVYQALDY

SEQ ID NO: 39123 - protein, 477 aa, Artificial Sequence; identical to SEQ ID NO: 21669
  Description of Artificial Sequence: Synthetic polypeptide
  XENP022675 2A11_H1.144_L2.142_Fab-[CTLA-4]_H3.23_L0.129 scFv-Fc Heavy Chain

SEQ ID NO: 39124 - protein, 118 aa, Artificial Sequence; identical to SEQ ID NO: 2632
  Description of Artificial Sequence: Synthetic polypeptide
  VH of XENP022675

SEQ ID NO: 39125 - protein, 108 aa, Artificial Sequence; identical to SEQ ID NO: 2768
  Description of Artificial Sequence: Synthetic polypeptide
  VL of XENP022675

SEQ ID NO: 39126 - protein, 231 aa, Artificial Sequence; identical to SEQ ID NO: 21532
  Description of Artificial Sequence: Synthetic polypeptide
  Fc chain of XENP022675

SEQ ID NO: 39127 - protein, 5 aa, Artificial Sequence
  Description of Artificial Sequence: Synthetic peptide
  XENP022675 vhCDR1
SYTMH

SEQ ID NO: 39128 - protein, 17 aa, Artificial Sequence
  Description of Artificial Sequence: Synthetic peptide
  XENP022675 vhCDR2
FISYDGNYKYYADSVKG

SEQ ID NO: 39129 - protein, 9 aa, Artificial Sequence
  Description of Artificial Sequence: Synthetic peptide
  XENP022675 vhCDR3
GGHLGPFDL

SEQ ID NO: 39130 - protein, 12 aa, Artificial Sequence
  Description of Artificial Sequence: Synthetic peptide
  XENP022675 vlCDR1
RASQSVGSSYLA

SEQ ID NO: 39131 - protein, 7 aa, Artificial Sequence
  Description of Artificial Sequence: Synthetic peptide
  XENP022675 vlCDR2
GASSRAT

SEQ ID NO: 39132 - protein, 9 aa, Artificial Sequence
  Description of Artificial Sequence: Synthetic peptide
  XENP022675 vlCDR3
QQYGSSPWT

SEQ ID NO: 39133 - protein, 214 aa, Artificial Sequence; identical to SEQ ID NO: 22279
  Description of Artificial Sequence: Synthetic polypeptide
  XENP022675 2A11_H1.144_L2.142_Fab-[CTLA-4]_H3.23_L0.129 Light Chain

SEQ ID NO: 39134 - protein, 107 aa, Artificial Sequence; identical to SEQ ID NO: 22280
  Description of Artificial Sequence: Synthetic polypeptide
  VL of XENP022675

SEQ ID NO: 39135 - protein, 11 aa, Artificial Sequence
  Description of Artificial Sequence: Synthetic peptide
  XENP022675 vlCDR1
QASQDIGNYLN

SEQ ID NO: 39136 - protein, 7 aa, Artificial Sequence
  Description of Artificial Sequence: Synthetic peptide
  XENP022675 vlCDR2
FTSYLHS

SEQ ID NO: 39137 - protein, 9 aa, Artificial Sequence
  Description of Artificial Sequence: Synthetic peptide
  XENP022675 vlCDR3
QQGNTLPYT

SEQ ID NO: 39138 - protein, 450 aa, Artificial Sequence; identical to SEQ ID NO: 35607
  Description of Artificial Sequence: Synthetic polypeptide
  XENP022841 7G8_H3.30_L1.34_Fab-[CTLA-4]_H3.23_L0.129_scFv M428L/N434S Fab-Fc Heavy Chain

SEQ ID NO: 39139 - protein, 121 aa, Artificial Sequence; identical to SEQ ID NO: 22485
  Description of Artificial Sequence: Synthetic polypeptide
  VH of XENP022841

SEQ ID NO: 39140 - protein, 5 aa, Artificial Sequence
  Description of Artificial Sequence: Synthetic peptide
  XENP022841 vhCDR1
DAWMS

SEQ ID NO: 39141 - protein, 19 aa, Artificial Sequence
  Description of Artificial Sequence: Synthetic peptide
  XENP022841 vhCDR2
EISTKANNHATYYAESVKG

SEQ ID NO: 39142 - protein, 10 aa, Artificial Sequence
  Description of Artificial Sequence: Synthetic peptide
  XENP022841 vhCDR3
LATWDWYFDV

SEQ ID NO: 39143 - protein, 477 aa, Artificial Sequence; identical to SEQ ID NO: 35612
  Description of Artificial Sequence: Synthetic polypeptide
  XENP022841 7G8_H3.30_L1.34_Fab-[CTLA-4]_H3.23_L0.129_scFv M428L/N434S scFv-Fc Heavy Chain

SEQ ID NO: 39144 - protein, 118 aa, Artificial Sequence; identical to SEQ ID NO: 2632
  Description of Artificial Sequence: Synthetic polypeptide
  VH of XENP022841

SEQ ID NO: 39145 - protein, 108 aa, Artificial Sequence; identical to SEQ ID NO: 2768
  Description of Artificial Sequence: Synthetic polypeptide
  VL of XENP022841

SEQ ID NO: 39146 - protein, 231 aa, Artificial Sequence; identical to SEQ ID NO: 21572
  Description of Artificial Sequence: Synthetic polypeptide
  Fc chain of XENP022841

SEQ ID NO: 39147 - protein, 5 aa, Artificial Sequence
  Description of Artificial Sequence: Synthetic peptide
  XENP022841 vhCDR1
SYTMH

SEQ ID NO: 39148 - protein, 17 aa, Artificial Sequence
  Description of Artificial Sequence: Synthetic peptide
  XENP022841 vhCDR2
FISYDGNYKYYADSVKG

SEQ ID NO: 39149 - protein, 9 aa, Artificial Sequence
  Description of Artificial Sequence: Synthetic peptide
  XENP022841 vhCDR3
GGHLGPFDL

SEQ ID NO: 39150 - protein, 12 aa, Artificial Sequence
  Description of Artificial Sequence: Synthetic peptide
  XENP022841 vlCDR1
RASQSVGSSYLA

SEQ ID NO: 39151 - protein, 7 aa, Artificial Sequence
  Description of Artificial Sequence: Synthetic peptide
  XENP022841 vlCDR2
GASSRAT

SEQ ID NO: 39152 - protein, 9 aa, Artificial Sequence
  Description of Artificial Sequence: Synthetic peptide
  XENP022841 vlCDR3
QQYGSSPWT

SEQ ID NO: 39153 - protein, 218 aa, Artificial Sequence; identical to SEQ ID NO: 22599
  Description of Artificial Sequence: Synthetic polypeptide
  XENP022841 7G8_H3.30_L1.34_Fab-[CTLA-4]_H3.23_L0.129_scFv M428L/N434S Light Chain

SEQ ID NO: 39154 - protein, 111 aa, Artificial Sequence; identical to SEQ ID NO: 22600
  Description of Artificial Sequence: Synthetic polypeptide
  VL of XENP022841

SEQ ID NO: 39155 - protein, 15 aa, Artificial Sequence
  Description of Artificial Sequence: Synthetic peptide
  XENP022841 vlCDR1
RASQSVDYDGDSYMN

SEQ ID NO: 39156 - protein, 7 aa, Artificial Sequence
  Description of Artificial Sequence: Synthetic peptide
  XENP022841 vlCDR2
AASELES

SEQ ID NO: 39157 - protein, 9 aa, Artificial Sequence
  Description of Artificial Sequence: Synthetic peptide
  XENP022841 vlCDR3
QQSNEDPFT

SEQ ID NO: 39158 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 39159 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39160 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 39161 - protein, 231 aa, Artificial Sequence; identical to SEQ ID NO: 39159
  Description of Artificial Sequence: Synthetic polypeptide

SEQ ID NO: 39162 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 39163 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39164 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVKQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSKLTVDKSRWEEGDVFSCSVMHEALHNHYTQKSLSLSLGK

SEQ ID NO: 39165 - protein, 229 aa, Artificial Sequence
  Description of Artificial Sequence: Synthetic polypeptide
ESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 39166 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 39167 - protein, 228 aa, Artificial Sequence
  Description of Artificial Sequence: Synthetic polypeptide
ERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 39168 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 39169 - protein, 228 aa, Artificial Sequence
  Description of Artificial Sequence: Synthetic polypeptide
ERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 39170 - protein, 329 aa, Artificial Sequence; identical to SEQ ID NO: 37725
  Description of Artificial Sequence: Synthetic polypeptide

SEQ ID NO: 39171 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39172 - protein, 329 aa, Artificial Sequence; identical to SEQ ID NO: 39160
  Description of Artificial Sequence: Synthetic polypeptide

SEQ ID NO: 39173 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39174 - protein, 329 aa, Artificial Sequence; identical to SEQ ID NO: 39162
  Description of Artificial Sequence: Synthetic polypeptide

SEQ ID NO: 39175 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39176 - protein, 327 aa, Artificial Sequence; identical to SEQ ID NO: 39164
  Description of Artificial Sequence: Synthetic polypeptide

SEQ ID NO: 39177 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 39178 - protein, 326 aa, Artificial Sequence; identical to SEQ ID NO: 39166
  Description of Artificial Sequence: Synthetic polypeptide

SEQ ID NO: 39179 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 39180 - protein, 326 aa, Artificial Sequence; identical to SEQ ID NO: 39168
  Description of Artificial Sequence: Synthetic polypeptide

SEQ ID NO: 39181 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 39182 - protein, 288 aa, Homo sapiens; identical to SEQ ID NO: 1

SEQ ID NO: 39183 - protein, 150 aa, Homo sapiens [sequence omitted]

SEQ ID NO: 39184 - protein, 288 aa, Macaca fascicularis; identical to SEQ ID NO: 3

SEQ ID NO: 39185 - protein, 150 aa, Macaca fascicularis; identical to SEQ ID NO: 4

SEQ ID NO: 39186 - protein, 223 aa, Homo sapiens; identical to SEQ ID NO: 5

SEQ ID NO: 39187 - protein, 126 aa, Homo sapiens [sequence omitted]

SEQ ID NO: 39188 - protein, 223 aa, Macaca fascicularis; identical to SEQ ID NO: 7

SEQ ID NO: 39189 - protein, 126 aa, Macaca fascicularis; identical to SEQ ID NO: 8

SEQ ID NO: 39190 - protein, 525 aa, Homo sapiens; identical to SEQ ID NO: 9

SEQ ID NO: 39191 - protein, 422 aa, Homo sapiens; identical to SEQ ID NO: 10

SEQ ID NO: 39192 - protein, 533 aa, Macaca fascicularis; identical to SEQ ID NO: 11
  MOD_RES (74)..(74): Any amino acid

SEQ ID NO: 39193 - protein, 422 aa, Macaca fascicularis; identical to SEQ ID NO: 12
  MOD_RES (46)..(46): Any amino acid

SEQ ID NO: 39194 - protein, 289 aa, Homo sapiens; identical to SEQ ID NO: 13

SEQ ID NO: 39195 - protein, 127 aa, Homo sapiens; identical to SEQ ID NO: 14

SEQ ID NO: 39196 - protein, 289 aa, Macaca fascicularis; identical to SEQ ID NO: 15

SEQ ID NO: 39197 - protein, 127 aa, Macaca fascicularis; identical to SEQ ID NO: 16

SEQ ID NO: 39198 - protein, 300 aa, Homo sapiens; identical to SEQ ID NO: 17

SEQ ID NO: 39199 - protein, 181 aa, Homo sapiens; identical to SEQ ID NO: 18

SEQ ID NO: 39200 - protein, 302 aa, Macaca fascicularis; identical to SEQ ID NO: 19

SEQ ID NO: 39201 - protein, 182 aa, Macaca fascicularis; identical to SEQ ID NO: 20

SEQ ID NO: 39202 - protein, 20 aa, Artificial Sequence
  Description of Artificial Sequence: Synthetic peptide
GKPGSGKPGSGKPGSGKPGS

SEQ ID NO: 39203 - protein, 15 aa, Artificial Sequence
  Description of Artificial Sequence: Synthetic peptide
GGGGSGGGGSGGGGS

SEQ ID NO: 39204 - protein, 18 aa, Artificial Sequence
  Description of Artificial Sequence: Synthetic peptide
GSTSGSGKPGSGEGSTKG

SEQ ID NO: 39205 - protein, 14 aa, Artificial Sequence
  Description of Artificial Sequence: Synthetic peptide
IRPRAIGGSKPRVA

SEQ ID NO: 39206 - protein, 15 aa, Artificial Sequence
  Description of Artificial Sequence: Synthetic peptide
GKGGSGKGGSGKGGS

SEQ ID NO: 39207 - protein, 15 aa, Artificial Sequence
  Description of Artificial Sequence: Synthetic peptide
GGKGSGGKGSGGKGS

SEQ ID NO: 39208 - protein, 15 aa, Artificial Sequence
  Description of Artificial Sequence: Synthetic peptide
GGGKSGGGKSGGGKS

SEQ ID NO: 39209 - protein, 15 aa, Artificial Sequence
  Description of Artificial Sequence: Synthetic peptide
GKGKSGKGKSGKGKS

SEQ ID NO: 39210 - protein, 15 aa, Artificial Sequence
  Description of Artificial Sequence: Synthetic peptide
GGGKSGGKGSGKGGS

SEQ ID NO: 39211 - protein, 15 aa, Artificial Sequence
  Description of Artificial Sequence: Synthetic peptide
GKPGSGKPGSGKPGS

SEQ ID NO: 39212 - protein, 20 aa, Artificial Sequence
  Description of Artificial Sequence: Synthetic peptide
GKGKSGKGKSGKGKSGKGKS

SEQ ID NO: 39213 - protein, 20 aa, Artificial Sequence
  Description of Artificial Sequence: Synthetic peptide
GGGGSGGGGSGGGGSGGGGS

SEQ ID NO: 39214 - protein, 14 aa, Artificial Sequence
  Description of Artificial Sequence: Synthetic peptide
STAGDTHLGGEDFD

SEQ ID NO: 39215 - protein, 15 aa, Artificial Sequence
  Description of Artificial Sequence: Synthetic peptide
GEGGSGEGGSGEGGS

SEQ ID NO: 39216 - protein, 15 aa, Artificial Sequence
  Description of Artificial Sequence: Synthetic peptide
GGEGSGGEGSGGEGS

SEQ ID NO: 39217 - protein, 15 aa, Artificial Sequence
  Description of Artificial Sequence: Synthetic peptide
GGGESGGGESGGGES

SEQ ID NO: 39218 - protein, 15 aa, Artificial Sequence
  Description of Artificial Sequence: Synthetic peptide
GEGESGEGESGEGES

SEQ ID NO: 39219 - protein, 15 aa, Artificial Sequence
  Description of Artificial Sequence: Synthetic peptide
GGGESGGEGSGEGGS

SEQ ID NO: 39220 - protein, 20 aa, Artificial Sequence
  Description of Artificial Sequence: Synthetic peptide
GEGESGEGESGEGESGEGES

SEQ ID NO: 39221 - protein, 19 aa, Artificial Sequence
  Description of Artificial Sequence: Synthetic peptide
PRGASKSGSASQTGSAPGS

SEQ ID NO: 39222 - protein, 19 aa, Artificial Sequence
  Description of Artificial Sequence: Synthetic peptide
GTAAAGAGAAGGAAAGAAG

SEQ ID NO: 39223 - protein, 19 aa, Artificial Sequence
  Description of Artificial Sequence: Synthetic peptide
GTSGSSGSGSGGSGSGGGG

SEQ ID NO: 39224 - protein, 446 aa, Artificial Sequence
  Description of Artificial Sequence: Synthetic polypeptide
  XENP021575 1C11[PD-1]_H0L0_IgG1_PVA_/S267K Heavy Chain
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39225 - protein, 117 aa, Artificial Sequence; identical to SEQ ID NO: 33044
  Description of Artificial Sequence: Synthetic polypeptide
  VH of XENP021575

SEQ ID NO: 39226 - protein, 5 aa, Artificial Sequence
  Description of Artificial Sequence: Synthetic peptide
  XENP021575 vhCDR1
HYGMN

SEQ ID NO: 39227 - protein, 17 aa, Artificial Sequence
  Description of Artificial Sequence: Synthetic peptide
  XENP021575 vhCDR2
WINTYTGEPTYADDFKG

SEQ ID NO: 39228 - protein, 8 aa, Artificial Sequence
  Description of Artificial Sequence: Synthetic peptide
  XENP021575 vhCDR3
DYYGSSPY

SEQ ID NO: 39229 - protein, 219 aa, Artificial Sequence; identical to SEQ ID NO: 33048
  Description of Artificial Sequence: Synthetic polypeptide
  XENP021575 1C11[PD-1]_H0L0_IgG1_PVA_/S267K Light Chain

SEQ ID NO: 39230 - protein, 112 aa, Artificial Sequence; identical to SEQ ID NO: 33049
  Description of Artificial Sequence: Synthetic polypeptide
  VL of XENP021575

SEQ ID NO: 39231 - protein, 16 aa, Artificial Sequence
  Description of Artificial Sequence: Synthetic peptide
  XENP021575 vlCDR1
RSSQSIVHSNGNTYLE

SEQ ID NO: 39232 - protein, 7 aa, Artificial Sequence
  Description of Artificial Sequence: Synthetic peptide
  XENP021575 vlCDR2
KVSNRFS

SEQ ID NO: 39233 - protein, 9 aa, Artificial Sequence
  Description of Artificial Sequence: Synthetic peptide
  XENP021575 vlCDR3
FQGSHVPNT

SEQ ID NO: 39234 - protein, 446 aa, Artificial Sequence
  Description of Artificial Sequence: Synthetic polypeptide
  XENP022543 1C11[PD-1]_H1L1_IgG1_PVA_/S267K Heavy Chain
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39235 - protein, 117 aa, Artificial Sequence; identical to SEQ ID NO: 33004
  Description of Artificial Sequence: Synthetic polypeptide
  VH of XENP022543

SEQ ID NO: 39236 - protein, 5 aa, Artificial Sequence
  Description of Artificial Sequence: Synthetic peptide
  XENP022543 vhCDR1
HYGMN

SEQ ID NO: 39237 - protein, 17 aa, Artificial Sequence
  Description of Artificial Sequence: Synthetic peptide
  XENP022543 vhCDR2
WINTYTGEPTYADKFQG

SEQ ID NO: 39238 - protein, 8 aa, Artificial Sequence
  Description of Artificial Sequence: Synthetic peptide
  XENP022543 vhCDR3
DYYGSSPY

SEQ ID NO: 39239 - protein, 219 aa, Artificial Sequence; identical to SEQ ID NO: 33018
  Description of Artificial Sequence: Synthetic polypeptide
  XENP022543 1C11[PD-1]_H1L1_IgG1_PVA_/S267K Light Chain

SEQ ID NO: 39240 - protein, 112 aa, Artificial Sequence; identical to SEQ ID NO: 33019
  Description of Artificial Sequence: Synthetic polypeptide
  VL of XENP022543

SEQ ID NO: 39241 - protein, 16 aa, Artificial Sequence
  Description of Artificial Sequence: Synthetic peptide
  XENP022543 vlCDR1
RSSQSIVHSNGNTYLE

SEQ ID NO: 39242 - protein, 7 aa, Artificial Sequence
  Description of Artificial Sequence: Synthetic peptide
  XENP022543 vlCDR2
KVSNRFS

SEQ ID NO: 39243 - protein, 9 aa, Artificial Sequence
  Description of Artificial Sequence: Synthetic peptide
  XENP022543 vlCDR3
FQGSHVPNT

SEQ ID NO: 39244 - protein, 446 aa, Artificial Sequence
  Description of Artificial Sequence: Synthetic polypeptide
  XENP022544 1C11[PD-1]_H2L1_IgG1_PVA_/S267K Heavy Chain
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39245 - protein, 117 aa, Artificial Sequence; identical to SEQ ID NO: 33014
  Description of Artificial Sequence: Synthetic polypeptide
  VH of XENP022544

SEQ ID NO: 39246 - protein, 5 aa, Artificial Sequence
  Description of Artificial Sequence: Synthetic peptide
  XENP022544 vhCDR1
HYGMN

SEQ ID NO: 39247 - protein, 17 aa, Artificial Sequence
  Description of Artificial Sequence: Synthetic peptide
  XENP022544 vhCDR2
WINTYTGEPTYADSVKG

SEQ ID NO: 39248 - protein, 8 aa, Artificial Sequence
  Description of Artificial Sequence: Synthetic peptide
  XENP022544 vhCDR3
DYYGSSPY

SEQ ID NO: 39249 - protein, 219 aa, Artificial Sequence; identical to SEQ ID NO: 33018
  Description of Artificial Sequence: Synthetic polypeptide
  XENP022544 1C11[PD-1]_H2L1_IgG1_PVA_/S267K Light Chain

SEQ ID NO: 39250 - protein, 112 aa, Artificial Sequence; identical to SEQ ID NO: 33019
  Description of Artificial Sequence: Synthetic polypeptide
  VL of XENP022544

SEQ ID NO: 39251 - protein, 16 aa, Artificial Sequence
  Description of Artificial Sequence: Synthetic peptide
  XENP022544 vlCDR1
RSSQSIVHSNGNTYLE

SEQ ID NO: 39252 - protein, 7 aa, Artificial Sequence
  Description of Artificial Sequence: Synthetic peptide
  XENP022544 vlCDR2
KVSNRFS

SEQ ID NO: 39253 - protein, 9 aa, Artificial Sequence
  Description of Artificial Sequence: Synthetic peptide
  XENP022544 vlCDR3
FQGSHVPNT

SEQ ID NO: 39254 - protein, 446 aa, Artificial Sequence
  Description of Artificial Sequence: Synthetic polypeptide
  XENP022545 1C11[PD-1]_H3L1_IgG1_PVA_/S267K Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39255 - protein, 117 aa, Artificial Sequence; identical to SEQ ID NO: 33034
  Description of Artificial Sequence: Synthetic polypeptide
  VH of XENP022545

SEQ ID NO: 39256 - protein, 5 aa, Artificial Sequence
  Description of Artificial Sequence: Synthetic peptide
  XENP022545 vhCDR1
HYGMN

SEQ ID NO: 39257 - protein, 17 aa, Artificial Sequence
  Description of Artificial Sequence: Synthetic peptide
  XENP022545 vhCDR2
WINTYTGEPTYADGFTG

SEQ ID NO: 39258 - protein, 8 aa, Artificial Sequence
  Description of Artificial Sequence: Synthetic peptide
  XENP022545 vhCDR3
DYYGSSPY

SEQ ID NO: 39259 - protein, 219 aa, Artificial Sequence; identical to SEQ ID NO: 33018
  Description of Artificial Sequence: Synthetic polypeptide
  XENP022545 1C11[PD-1]_H3L1_IgG1_PVA_/S267K Light Chain

SEQ ID NO: 39260 - protein, 112 aa, Artificial Sequence; identical to SEQ ID NO: 33019
  Description of Artificial Sequence: Synthetic polypeptide
  VL of XENP022545

SEQ ID NO: 39261 - protein, 16 aa, Artificial Sequence
  Description of Artificial Sequence: Synthetic peptide
  XENP022545 vlCDR1
RSSQSIVHSNGNTYLE

SEQ ID NO: 39262 - protein, 7 aa, Artificial Sequence
  Description of Artificial Sequence: Synthetic peptide
  XENP022545 vlCDR2
KVSNRFS

SEQ ID NO: 39263 - protein, 9 aa, Artificial Sequence
  Description of Artificial Sequence: Synthetic peptide
  XENP022545 vlCDR3
FQGSHVPNT

SEQ ID NO: 39264 - protein, 446 aa, Artificial Sequence
  Description of Artificial Sequence: Synthetic polypeptide
  XENP022546 1C11[PD-1]_H4L1_IgG1_PVA_/S267K Heavy Chain
EVQLLESGGGLVQPGGSLRLSCAASGYTFTHYGMNWVRQAPGKGLEWVSWINTYTGEPTYADSVKGRFTISLDTSKSTAYLQMNSLRAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39265 - protein, 117 aa, Artificial Sequence
  Description of Artificial Sequence: Synthetic polypeptide
  VH of XENP022546
EVQLLESGGGLVQPGGSLRLSCAASGYTFTHYGMNWVRQAPGKGLEWVSWINTYTGEPTYADSVKGRFTISLDTSKSTAYLQMNSLRAEDTAVYYCARDYYGSSPYWGQGTLVTVSS

SEQ ID NO: 39266 - protein, 5 aa, Artificial Sequence
  Description of Artificial Sequence: Synthetic peptide
  XENP022546 vhCDR1
HYGMN

SEQ ID NO: 39267 - protein, 17 aa, Artificial Sequence
  Description of Artificial Sequence: Synthetic peptide
  XENP022546 vhCDR2
WINTYTGEPTYADSVKG

SEQ ID NO: 39268 - protein, 8 aa, Artificial Sequence
  Description of Artificial Sequence: Synthetic peptide
  XENP022546 vhCDR3
DYYGSSPY

SEQ ID NO: 39269 - protein, 219 aa, Artificial Sequence; identical to SEQ ID NO: 33018
  Description of Artificial Sequence: Synthetic polypeptide
  XENP022546 1C11[PD-1]_H4L1_IgG1_PVA_/S267K Light Chain

SEQ ID NO: 39270 - protein, 112 aa, Artificial Sequence; identical to SEQ ID NO: 33019
  Description of Artificial Sequence: Synthetic polypeptide
  VL of XENP022546

SEQ ID NO: 39271 - protein, 16 aa, Artificial Sequence
  Description of Artificial Sequence: Synthetic peptide
  XENP022546 vlCDR1
RSSQSIVHSNGNTYLE

SEQ ID NO: 39272 - protein, 7 aa, Artificial Sequence
  Description of Artificial Sequence: Synthetic peptide
  XENP022546 vlCDR2
KVSNRFS

SEQ ID NO: 39273 - protein, 9 aa, Artificial Sequence
  Description of Artificial Sequence: Synthetic peptide
  XENP022546 vlCDR3
FQGSHVPNT

SEQ ID NO: 39274 - protein, 446 aa, Artificial Sequence; identical to SEQ ID NO: 39234
  Description of Artificial Sequence: Synthetic polypeptide
  XENP022547 1C11[PD-1]_H1L2_IgG1_PVA_/S267K Heavy Chain

SEQ ID NO: 39275 - protein, 117 aa, Artificial Sequence; identical to SEQ ID NO: 33004
  Description of Artificial Sequence: Synthetic polypeptide
  VH of XENP022547

SEQ ID NO: 39276 - protein, 5 aa, Artificial Sequence
  Description of Artificial Sequence: Synthetic peptide
  XENP022547 vhCDR1
HYGMN

SEQ ID NO: 39277 - protein, 17 aa, Artificial Sequence
  Description of Artificial Sequence: Synthetic peptide
  XENP022547 vhCDR2
WINTYTGEPTYADKFQG

SEQ ID NO: 39278 - protein, 8 aa, Artificial Sequence
  Description of Artificial Sequence: Synthetic peptide
  XENP022547 vhCDR3
DYYGSSPY

SEQ ID NO: 39279 - protein, 219 aa, Artificial Sequence; identical to SEQ ID NO: 33028
  Description of Artificial Sequence: Synthetic polypeptide
  XENP022547 1C11[PD-1]_H1L2_IgG1_PVA_/S267K Light Chain

SEQ ID NO: 39280 - protein, 112 aa, Artificial Sequence; identical to SEQ ID NO: 33029
  Description of Artificial Sequence: Synthetic polypeptide
  VL of XENP022547

SEQ ID NO: 39281 - protein, 16 aa, Artificial Sequence
  Description of Artificial Sequence: Synthetic peptide
  XENP022547 vlCDR1
RSSQSIVHSNGNTYLE

SEQ ID NO: 39282 - protein, 7 aa, Artificial Sequence
  Description of Artificial Sequence: Synthetic peptide
  XENP022547 vlCDR2
KVSNRFS

SEQ ID NO: 39283 - protein, 9 aa, Artificial Sequence
  Description of Artificial Sequence: Synthetic peptide
  XENP022547 vlCDR3
FQGSHVPNT

SEQ ID NO: 39284 - protein, 446 aa, Artificial Sequence; identical to SEQ ID NO: 39244
  Description of Artificial Sequence: Synthetic polypeptide
  XENP022548 1C11[PD-1]_H2L2_IgG1_PVA_/S267K Heavy Chain

SEQ ID NO: 39285 - protein, 117 aa, Artificial Sequence; identical to SEQ ID NO: 33014
  Description of Artificial Sequence: Synthetic polypeptide
  VH of XENP022548

SEQ ID NO: 39286 - protein, 5 aa, Artificial Sequence
  Description of Artificial Sequence: Synthetic peptide
  XENP022548 vhCDR1
HYGMN

SEQ ID NO: 39287 - protein, 17 aa, Artificial Sequence
  Description of Artificial Sequence: Synthetic peptide
  XENP022548 vhCDR2
WINTYTGEPTYADSVKG

SEQ ID NO: 39288 - protein, 8 aa, Artificial Sequence
  Description of Artificial Sequence: Synthetic peptide
  XENP022548 vhCDR3
DYYGSSPY

SEQ ID NO: 39289 - protein, 219 aa, Artificial Sequence; identical to SEQ ID NO: 33028
  Description of Artificial Sequence: Synthetic polypeptide
  XENP022548 1C11[PD-1]_H2L2_IgG1_PVA_/S267K Light Chain

SEQ ID NO: 39290 - protein, 112 aa, Artificial Sequence; identical to SEQ ID NO: 33029
  Description of Artificial Sequence: Synthetic polypeptide
  VL of XENP022548

SEQ ID NO: 39291 - protein, 16 aa, Artificial Sequence
  Description of Artificial Sequence: Synthetic peptide
  XENP022548 vlCDR1
RSSQSIVHSNGNTYLE

SEQ ID NO: 39292 - protein, 7 aa, Artificial Sequence
  Description of Artificial Sequence: Synthetic peptide
  XENP022548 vlCDR2
KVSNRFS

SEQ ID NO: 39293 - protein, 9 aa, Artificial Sequence
  Description of Artificial Sequence: Synthetic peptide
  XENP022548 vlCDR3
FQGSHVPNT

SEQ ID NO: 39294 - protein, 446 aa, Artificial Sequence; identical to SEQ ID NO: 39254
  Description of Artificial Sequence: Synthetic polypeptide
  XENP022549 1C11[PD-1]_H3L2_IgG1_PVA_/S267K Heavy Chain

SEQ ID NO: 39295 - protein, 117 aa, Artificial Sequence; identical to SEQ ID NO: 33034
  Description of Artificial Sequence: Synthetic polypeptide
  VH of XENP022549

SEQ ID NO: 39296 - protein, 5 aa, Artificial Sequence
  Description of Artificial Sequence: Synthetic peptide
  XENP022549 vhCDR1
HYGMN

SEQ ID NO: 39297 - protein, 17 aa, Artificial Sequence
  Description of Artificial Sequence: Synthetic peptide
  XENP022549 vhCDR2
WINTYTGEPTYADGFTG

SEQ ID NO: 39298 - protein, 8 aa, Artificial Sequence
  Description of Artificial Sequence: Synthetic peptide
  XENP022549 vhCDR3
DYYGSSPY

SEQ ID NO: 39299 - protein, 219 aa, Artificial Sequence; identical to SEQ ID NO: 33028
  Description of Artificial Sequence: Synthetic polypeptide
  XENP022549 1C11[PD-1]_H3L2_IgG1_PVA_/S267K Light Chain

SEQ ID NO: 39300 - protein, 112 aa, Artificial Sequence; identical to SEQ ID NO: 33029
  Description of Artificial Sequence: Synthetic polypeptide
  VL of XENP022549

SEQ ID NO: 39301 - protein, 16 aa, Artificial Sequence
  Description of Artificial Sequence: Synthetic peptide
  XENP022549 vlCDR1
RSSQSIVHSNGNTYLE

SEQ ID NO: 39302 - protein, 7 aa, Artificial Sequence
  Description of Artificial Sequence: Synthetic peptide
  XENP022549 vlCDR2
KVSNRFS

SEQ ID NO: 39303 - protein, 9 aa, Artificial Sequence
  Description of Artificial Sequence: Synthetic peptide
  XENP022549 vlCDR3
FQGSHVPNT

SEQ ID NO: 39304 - protein, 446 aa, Artificial Sequence; identical to SEQ ID NO: 39264
  Description of Artificial Sequence: Synthetic polypeptide
  XENP022550 1C11[PD-1]_H4L2_IgG1_PVA_/S267K Heavy Chain

SEQ ID NO: 39305 - protein, 117 aa, Artificial Sequence; identical to SEQ ID NO: 39265
  Description of Artificial Sequence: Synthetic polypeptide
  VH of XENP022550

SEQ ID NO: 39306 - protein, 5 aa, Artificial Sequence
  Description of Artificial Sequence: Synthetic peptide
  XENP022550 vhCDR1
HYGMN

SEQ ID NO: 39307 - protein, 17 aa, Artificial Sequence
  Description of Artificial Sequence: Synthetic peptide
  XENP022550 vhCDR2
WINTYTGEPTYADSVKG

SEQ ID NO: 39308 - protein, 8 aa, Artificial Sequence
  Description of Artificial Sequence: Synthetic peptide
  XENP022550 vhCDR3
DYYGSSPY

SEQ ID NO: 39309 - protein, 219 aa, Artificial Sequence; identical to SEQ ID NO: 33028
  Description of Artificial Sequence: Synthetic polypeptide
  XENP022550 1C11[PD-1]_H4L2_IgG1_PVA_/S267K Light Chain

SEQ ID NO: 39310 - protein, 112 aa, Artificial Sequence; identical to SEQ ID NO: 33029
  Description of Artificial Sequence: Synthetic polypeptide
  VL of XENP022550

SEQ ID NO: 39311 - protein, 16 aa, Artificial Sequence
  Description of Artificial Sequence: Synthetic peptide
  XENP022550 vlCDR1
RSSQSIVHSNGNTYLE

SEQ ID NO: 39312 - protein, 7 aa, Artificial Sequence
  Description of Artificial Sequence: Synthetic peptide
  XENP022550 vlCDR2
KVSNRFS

SEQ ID NO: 39313 - protein, 9 aa, Artificial Sequence
  Description of Artificial Sequence: Synthetic peptide
  XENP022550 vlCDR3
FQGSHVPNT

SEQ ID NO: 39314 - protein, 446 aa, Artificial Sequence; identical to SEQ ID NO: 39234
  Description of Artificial Sequence: Synthetic polypeptide
  XENP022551 1C11[PD-1]_H1L3_IgG1_PVA_/S267K Heavy Chain

SEQ ID NO: 39315 - protein, 117 aa, Artificial Sequence; identical to SEQ ID NO: 33004
  Description of Artificial Sequence: Synthetic polypeptide
  VH of XENP022551

SEQ ID NO: 39316 - protein, 5 aa, Artificial Sequence
  Description of Artificial Sequence: Synthetic peptide
  XENP022551 vhCDR1
HYGMN

SEQ ID NO: 39317 - protein, 17 aa, Artificial Sequence
  Description of Artificial Sequence: Synthetic peptide
  XENP022551 vhCDR2
WINTYTGEPTYADKFQG

SEQ ID NO: 39318 - protein, 8 aa, Artificial Sequence
  Description of Artificial Sequence: Synthetic peptide
  XENP022551 vhCDR3
DYYGSSPY

SEQ ID NO: 39319 - protein, 219 aa, Artificial Sequence; identical to SEQ ID NO: 33008
  Description of Artificial Sequence: Synthetic polypeptide
  XENP022551 1C11[PD-1]_H1L3_IgG1_PVA_/S267K Light Chain

SEQ ID NO: 39320 - protein, 112 aa, Artificial Sequence; identical to SEQ ID NO: 33009
  Description of Artificial Sequence: Synthetic polypeptide
  VL of XENP022551

SEQ ID NO: 39321 - protein, 16 aa, Artificial Sequence
  Description of Artificial Sequence: Synthetic peptide
  XENP022551 vlCDR1
KSSQSIVHSNGNTYLE

SEQ ID NO: 39322 - protein, 7 aa, Artificial Sequence
  Description of Artificial Sequence: Synthetic peptide
  XENP022551 vlCDR2
KVSNRFS

SEQ ID NO: 39323 - protein, 9 aa, Artificial Sequence
  Description of Artificial Sequence: Synthetic peptide
  XENP022551 vlCDR3
FQGSHVPNT

SEQ ID NO: 39324 - protein, 446 aa, Artificial Sequence; identical to SEQ ID NO: 39244
  Description of Artificial Sequence: Synthetic polypeptide
  XENP022552 1C11[PD-1]_H2L3_IgG1_PVA_/S267K Heavy Chain

SEQ ID NO: 39325 - protein, 117 aa, Artificial Sequence; identical to SEQ ID NO: 33014
  Description of Artificial Sequence: Synthetic polypeptide
  VH of XENP022552

SEQ ID NO: 39326 - protein, 5 aa, Artificial Sequence
  Description of Artificial Sequence: Synthetic peptide
  XENP022552 vhCDR1
HYGMN

SEQ ID NO: 39327 - protein, 17 aa, Artificial Sequence
  Description of Artificial Sequence: Synthetic peptide
  XENP022552 vhCDR2
WINTYTGEPTYADSVKG

SEQ ID NO: 39328 - protein, 8 aa, Artificial Sequence
  Description of Artificial Sequence: Synthetic peptide
  XENP022552 vhCDR3
DYYGSSPY

SEQ ID NO: 39329 - protein, 219 aa, Artificial Sequence; identical to SEQ ID NO: 33008
  Description of Artificial Sequence: Synthetic polypeptide
  XENP022552 1C11[PD-1]_H2L3_IgG1_PVA_/S267K Light Chain

SEQ ID NO: 39330 - protein, 112 aa, Artificial Sequence; identical to SEQ ID NO: 33009
  Description of Artificial Sequence: Synthetic polypeptide
  VL of XENP022552

SEQ ID NO: 39331 - protein, 16 aa, Artificial Sequence
  Description of Artificial Sequence: Synthetic peptide
  XENP022552 vlCDR1
KSSQSIVHSNGNTYLE

SEQ ID NO: 39332 - protein, 7 aa, Artificial Sequence
  Description of Artificial Sequence: Synthetic peptide
  XENP022552 vlCDR2
KVSNRFS

SEQ ID NO: 39333 - protein, 9 aa, Artificial Sequence
  Description of Artificial Sequence: Synthetic peptide
  XENP022552 vlCDR3
FQGSHVPNT

SEQ ID NO: 39334 - protein, 446 aa, Artificial Sequence; identical to SEQ ID NO: 39254
  Description of Artificial Sequence: Synthetic polypeptide
  XENP022553 1C11[PD-1]_H3L3_IgG1_PVA_/S267K Heavy Chain

SEQ ID NO: 39335 - protein, 117 aa, Artificial Sequence; identical to SEQ ID NO: 33034
  Description of Artificial Sequence: Synthetic polypeptide
  VH of XENP022553

SEQ ID NO: 39336 - protein, 5 aa, Artificial Sequence
  Description of Artificial Sequence: Synthetic peptide
  XENP022553 vhCDR1
HYGMN

SEQ ID NO: 39337 - protein, 17 aa, Artificial Sequence
  Description of Artificial Sequence: Synthetic peptide
  XENP022553 vhCDR2
WINTYTGEPTYADGFTG

SEQ ID NO: 39338 - protein, 8 aa, Artificial Sequence
  Description of Artificial Sequence: Synthetic peptide
  XENP022553 vhCDR3
DYYGSSPY

SEQ ID NO: 39339 - protein, 219 aa, Artificial Sequence; identical to SEQ ID NO: 33008
  Description of Artificial Sequence: Synthetic polypeptide
  XENP022553 1C11[PD-1]_H3L3_IgG1_PVA_/S267K Light Chain

SEQ ID NO: 39340 - protein, 112 aa, Artificial Sequence; identical to SEQ ID NO: 33009
  Description of Artificial Sequence: Synthetic polypeptide
  VL of XENP022553

SEQ ID NO: 39341 - protein, 16 aa, Artificial Sequence
  Description of Artificial Sequence: Synthetic peptide
  XENP022553 vlCDR1
KSSQSIVHSNGNTYLE

SEQ ID NO: 39342 - protein, 7 aa, Artificial Sequence
  Description of Artificial Sequence: Synthetic peptide
  XENP022553 vlCDR2
KVSNRFS

SEQ ID NO: 39343 - protein, 9 aa, Artificial Sequence
  Description of Artificial Sequence: Synthetic peptide
  XENP022553 vlCDR3
FQGSHVPNT

SEQ ID NO: 39344 - protein, 446 aa, Artificial Sequence; identical to SEQ ID NO: 39264
  Description of Artificial Sequence: Synthetic polypeptide
  XENP022554 1C11[PD-1]_H4L3_IgG1_PVA_/S267K Heavy Chain

SEQ ID NO: 39345 - protein, 117 aa, Artificial Sequence; identical to SEQ ID NO: 39265
  Description of Artificial Sequence: Synthetic polypeptide
  VH of XENP022554

SEQ ID NO: 39346 - protein, 5 aa, Artificial Sequence
  Description of Artificial Sequence: Synthetic peptide
  XENP022554 vhCDR1
HYGMN

SEQ ID NO: 39347 - protein, 17 aa, Artificial Sequence
  Description of Artificial Sequence: Synthetic peptide
  XENP022554 vhCDR2
WINTYTGEPTYADSVKG

SEQ ID NO: 39348 - protein, 8 aa, Artificial Sequence
  Description of Artificial Sequence: Synthetic peptide
  XENP022554 vhCDR3
DYYGSSPY

SEQ ID NO: 39349 - protein, 219 aa, Artificial Sequence; identical to SEQ ID NO: 33008
  Description of Artificial Sequence: Synthetic polypeptide
  XENP022554 1C11[PD-1]_H4L3_IgG1_PVA_/S267K Light Chain

SEQ ID NO: 39350 - protein, 112 aa, Artificial Sequence; identical to SEQ ID NO: 33009
  Description of Artificial Sequence: Synthetic polypeptide
  VL of XENP022554

SEQ ID NO: 39351 - protein, 16 aa, Artificial Sequence
  Description of Artificial Sequence: Synthetic peptide
  XENP022554 vlCDR1
KSSQSIVHSNGNTYLE

SEQ ID NO: 39352 - protein, 7 aa, Artificial Sequence
  Description of Artificial Sequence: Synthetic peptide
  XENP022554 vlCDR2
KVSNRFS

SEQ ID NO: 39353 - protein, 9 aa, Artificial Sequence
  Description of Artificial Sequence: Synthetic peptide
  XENP022554 vlCDR3
FQGSHVPNT

SEQ ID NO: 39354 - protein, 249 aa, Artificial Sequence
  Description of Artificial Sequence: Synthetic polypeptide
  XENP022538 1C11[PD-1]_H3L3_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39355 - protein, 117 aa, Artificial Sequence; identical to SEQ ID NO: 33034
  Description of Artificial Sequence: Synthetic polypeptide
  VH of XENP022538

SEQ ID NO: 39356 - protein, 112 aa, Artificial Sequence; identical to SEQ ID NO: 33009
  Description of Artificial Sequence: Synthetic polypeptide
  VL of XENP022538

SEQ ID NO: 39357 - protein, 5 aa, Artificial Sequence
  Description of Artificial Sequence: Synthetic peptide
  XENP022538 vhCDR1
HYGMN

SEQ ID NO: 39358 - protein, 17 aa, Artificial Sequence
  Description of Artificial Sequence: Synthetic peptide
  XENP022538 vhCDR2
WINTYTGEPTYADGFTG

SEQ ID NO: 39359 - protein, 8 aa, Artificial Sequence
  Description of Artificial Sequence: Synthetic peptide
  XENP022538 vhCDR3
DYYGSSPY

SEQ ID NO: 39360 - protein, 16 aa, Artificial Sequence
  Description of Artificial Sequence: Synthetic peptide
  XENP022538 vlCDR1
KSSQSIVHSNGNTYLE

SEQ ID NO: 39361 - protein, 7 aa, Artificial Sequence
  Description of Artificial Sequence: Synthetic peptide
  XENP022538 vlCDR2
KVSNRFS

SEQ ID NO: 39362 - protein, 9 aa, Artificial Sequence
  Description of Artificial Sequence: Synthetic peptide
  XENP022538 vlCDR3
FQGSHVPNT

SEQ ID NO: 39363 - protein, 249 aa, Artificial Sequence
  Description of Artificial Sequence: Synthetic polypeptide
  XENP023577 1C11_H3_L3.1_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39364 - protein, 117 aa, Artificial Sequence; identical to SEQ ID NO: 33034
  Description of Artificial Sequence: Synthetic polypeptide
  VH of XENP023577

SEQ ID NO: 39365 - protein, 112 aa, Artificial Sequence
  Description of Artificial Sequence: Synthetic polypeptide
  VL of XENP023577
DILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39366 - protein, 5 aa, Artificial Sequence
  Description of Artificial Sequence: Synthetic peptide
  XENP023577 vhCDR1
HYGMN

SEQ ID NO: 39367 - protein, 17 aa, Artificial Sequence
  Description of Artificial Sequence: Synthetic peptide
  XENP023577 vhCDR2
WINTYTGEPTYADGFTG

SEQ ID NO: 39368 - protein, 8 aa, Artificial Sequence
  Description of Artificial Sequence: Synthetic peptide
  XENP023577 vhCDR3
DYYGSSPY

SEQ ID NO: 39369 - protein, 16 aa, Artificial Sequence
  Description of Artificial Sequence: Synthetic peptide
  XENP023577 vlCDR1
KSSQSIVHSNGNTYLE

SEQ ID NO: 39370 - protein, 7 aa, Artificial Sequence
  Description of Artificial Sequence: Synthetic peptide
  XENP023577 vlCDR2
KVSNRFS

SEQ ID NO: 39371 - protein, 9 aa, Artificial Sequence
  Description of Artificial Sequence: Synthetic peptide
  XENP023577 vlCDR3
FQGSHVPNT

SEQ ID NO: 39372 - protein, 249 aa, Artificial Sequence
  Description of Artificial Sequence: Synthetic polypeptide
  XENP023579 1C11_H3_L3.3_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39373 - protein, 117 aa, Artificial Sequence; identical to SEQ ID NO: 33034
  Description of Artificial Sequence: Synthetic polypeptide
  VH of XENP023579

SEQ ID NO: 39374 - protein, 112 aa, Artificial Sequence
  Description of Artificial Sequence: Synthetic polypeptide
  VL of XENP023579
DVVMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39375 - protein, 5 aa, Artificial Sequence
  Description of Artificial Sequence: Synthetic peptide
  XENP023579 vhCDR1
HYGMN

SEQ ID NO: 39376 - protein, 17 aa, Artificial Sequence
  Description of Artificial Sequence: Synthetic peptide
  XENP023579 vhCDR2
WINTYTGEPTYADGFTG

SEQ ID NO: 39377 - protein, 8 aa, Artificial Sequence
  Description of Artificial Sequence: Synthetic peptide
  XENP023579 vhCDR3
DYYGSSPY

SEQ ID NO: 39378 - protein, 16 aa, Artificial Sequence
  Description of Artificial Sequence: Synthetic peptide
  XENP023579 vlCDR1
KSSQSIVHSNGNTYLE

SEQ ID NO: 39379 - protein, 7 aa, Artificial Sequence
  Description of Artificial Sequence: Synthetic peptide
  XENP023579 vlCDR2
KVSNRFS

SEQ ID NO: 39380 - protein, 9 aa, Artificial Sequence
  Description of Artificial Sequence: Synthetic peptide
  XENP023579 vlCDR3
FQGSHVPNT

SEQ ID NO: 39381 - protein, 249 aa, Artificial Sequence
  Description of Artificial Sequence: Synthetic polypeptide
  XENP023589 1C11_H3_L3.15_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39382 - protein, 117 aa, Artificial Sequence; identical to SEQ ID NO: 33034
  Description of Artificial Sequence: Synthetic polypeptide
  VH of XENP023589

SEQ ID NO: 39383 - protein, 112 aa, Artificial Sequence
  Description of Artificial Sequence: Synthetic polypeptide
  VL of XENP023589
DVLMTQSPDSLSVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39384 - protein, 5 aa, Artificial Sequence
  Description of Artificial Sequence: Synthetic peptide
  XENP023589 vhCDR1
HYGMN

SEQ ID NO: 39385 - protein, 17 aa, Artificial Sequence
  Description of Artificial Sequence: Synthetic peptide
  XENP023589 vhCDR2
WINTYTGEPTYADGFTG

SEQ ID NO: 39386 - protein, 8 aa, Artificial Sequence
  Description of Artificial Sequence: Synthetic peptide
  XENP023589 vhCDR3
DYYGSSPY

SEQ ID NO: 39387 - protein, 16 aa, Artificial Sequence
  Description of Artificial Sequence: Synthetic peptide
  XENP023589 vlCDR1
KSSQSIVHSNGNTYLE

SEQ ID NO: 39388 - protein, 7 aa, Artificial Sequence
  Description of Artificial Sequence: Synthetic peptide
  XENP023589 vlCDR2
KVSNRFS

SEQ ID NO: 39389 - protein, 9 aa, Artificial Sequence
  Description of Artificial Sequence: Synthetic peptide
  XENP023589 vlCDR3
FQGSHVPNT

SEQ ID NO: 39390 - protein, 249 aa, Artificial Sequence
  Description of Artificial Sequence: Synthetic polypeptide
  XENP023601 1C11_H3_L3.23_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERVTINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39391 - protein, 117 aa, Artificial Sequence; identical to SEQ ID NO: 33034
  Description of Artificial Sequence: Synthetic polypeptide
  VH of XENP023601

SEQ ID NO: 39392 - protein, 112 aa, Artificial Sequence
  Description of Artificial Sequence: Synthetic polypeptide
  VL of XENP023601
DVLMTQSPDSLAVSLGERVTINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39393 - protein, 5 aa, Artificial Sequence
  Description of Artificial Sequence: Synthetic peptide
  XENP023601 vhCDR1
HYGMN

SEQ ID NO: 39394 - protein, 17 aa, Artificial Sequence
  Description of Artificial Sequence: Synthetic peptide
  XENP023601 vhCDR2
WINTYTGEPTYADGFTG

SEQ ID NO: 39395 - protein, 8 aa, Artificial Sequence
  Description of Artificial Sequence: Synthetic peptide
  XENP023601 vhCDR3
DYYGSSPY

SEQ ID NO: 39396 - protein, 16 aa, Artificial Sequence
  Description of Artificial Sequence: Synthetic peptide
  XENP023601 vlCDR1
KSSQSIVHSNGNTYLE

SEQ ID NO: 39397 - protein, 7 aa, Artificial Sequence
  Description of Artificial Sequence: Synthetic peptide
  XENP023601 vlCDR2
KVSNRFS

SEQ ID NO: 39398 - protein, 9 aa, Artificial Sequence
  Description of Artificial Sequence: Synthetic peptide
  XENP023601 vlCDR3
FQGSHVPNT

SEQ ID NO: 39399 - protein, 249 aa, Artificial Sequence
  Description of Artificial Sequence: Synthetic polypeptide
  XENP023605 1C11_H3_L3.28_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCRSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39400 - protein, 117 aa, Artificial Sequence; identical to SEQ ID NO: 33034
  Description of Artificial Sequence: Synthetic polypeptide
  VH of XENP023605

SEQ ID NO: 39401 - protein, 112 aa, Artificial Sequence
  Description of Artificial Sequence: Synthetic polypeptide
  VL of XENP023605
DVLMTQSPDSLAVSLGERATINCRSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39402 - protein, 5 aa, Artificial Sequence
  Description of Artificial Sequence: Synthetic peptide
  XENP023605 vhCDR1
HYGMN

SEQ ID NO: 39403 - protein, 17 aa, Artificial Sequence
  Description of Artificial Sequence: Synthetic peptide
  XENP023605 vhCDR2
WINTYTGEPTYADGFTG

SEQ ID NO: 39404 - protein, 8 aa, Artificial Sequence
  Description of Artificial Sequence: Synthetic peptide
  XENP023605 vhCDR3
DYYGSSPY

SEQ ID NO: 39405 - protein, 16 aa, Artificial Sequence
  Description of Artificial Sequence: Synthetic peptide
  XENP023605 vlCDR1
RSSQSIVHSNGNTYLE

SEQ ID NO: 39406 - protein, 7 aa, Artificial Sequence
  Description of Artificial Sequence: Synthetic peptide
  XENP023605 vlCDR2
KVSNRFS

SEQ ID NO: 39407 - protein, 9 aa, Artificial Sequence
  Description of Artificial Sequence: Synthetic peptide
  XENP023605 vlCDR3
FQGSHVPNT

SEQ ID NO: 39408 - protein, 249 aa, Artificial Sequence
  Description of Artificial Sequence: Synthetic polypeptide
  XENP023609 1C11_H3_L3.32_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKASQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39409 - protein, 117 aa, Artificial Sequence; identical to SEQ ID NO: 33034
  Description of Artificial Sequence: Synthetic polypeptide
  VH of XENP023609

SEQ ID NO: 39410 - protein, 112 aa, Artificial Sequence
  Description of Artificial Sequence: Synthetic polypeptide
  VL of XENP023609
DVLMTQSPDSLAVSLGERATINCKASQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39411 - protein, 5 aa, Artificial Sequence
  Description of Artificial Sequence: Synthetic peptide
  XENP023609 vhCDR1
HYGMN

SEQ ID NO: 39412 - protein, 17 aa, Artificial Sequence
  Description of Artificial Sequence: Synthetic peptide
  XENP023609 vhCDR2
WINTYTGEPTYADGFTG

SEQ ID NO: 39413 - protein, 8 aa, Artificial Sequence
  Description of Artificial Sequence: Synthetic peptide
  XENP023609 vhCDR3
DYYGSSPY

SEQ ID NO: 39414 - protein, 16 aa, Artificial Sequence
  Description of Artificial Sequence: Synthetic peptide
  XENP023609 vlCDR1
KASQSIVHSNGNTYLE

SEQ ID NO: 39415 - protein, 7 aa, Artificial Sequence
  Description of Artificial Sequence: Synthetic peptide
  XENP023609 vlCDR2
KVSNRFS

SEQ ID NO: 39416 - protein, 9 aa, Artificial Sequence
  Description of Artificial Sequence: Synthetic peptide
  XENP023609 vlCDR3
FQGSHVPNT

SEQ ID NO: 39417 - protein, 249 aa, Artificial Sequence
  Description of Artificial Sequence: Synthetic polypeptide
  XENP023615 1C11_H3_L3.46_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQPPKLLIYKVSNRFSGVPDRFSGSGSGTDFTLTISSLQAEDVAVYYCFQGSHVPNTFGGGTKVEIK

SEQ ID NO: 39418 - protein, 117 aa, Artificial Sequence; identical to SEQ ID NO: 33034
  Description of Artificial Sequence: Synthetic polypeptide
  VH of XENP023615

SEQ ID NO: 39419 - protein, 112 aa, Artificial Sequence
  Description of Artificial Sequence: Synthetic polypeptide
  VL of XENP023615
DVLMTQSPDSLAVSLGERATINCKSSQSIVHSNGNTYLEWYQQKPGQPPKLLIYKVSNRFSGVPDRFSGSGSGTDFTLTISSLQAEDVAVYYCFQGSHVPNTFGGGTKVEIK

SEQ ID NO: 39420 - protein, 5 aa, Artificial Sequence
  Description of Artificial Sequence: Synthetic peptide
  XENP023615 vhCDR1
HYGMN

SEQ ID NO: 39421 - protein, 17 aa, Artificial Sequence
  Description of Artificial Sequence: Synthetic peptide
  XENP023615 vhCDR2
WINTYTGEPTYADGFTG

SEQ ID NO: 39422 - protein, 8 aa, Artificial Sequence
  Description of Artificial Sequence: Synthetic peptide
  XENP023615 vhCDR3
DYYGSSPY

SEQ ID NO: 39423 - protein, 16 aa, Artificial Sequence
  Description of Artificial Sequence: Synthetic peptide
  XENP023615 vlCDR1
KSSQSIVHSNGNTYLE

SEQ ID NO: 39424 - protein, 7 aa, Artificial Sequence
  Description of Artificial Sequence: Synthetic peptide
  XENP023615 vlCDR2
KVSNRFS

SEQ ID NO: 39425 - protein, 9 aa, Artificial Sequence
  Description of Artificial Sequence: Synthetic peptide
  XENP023615 vlCDR3
FQGSHVPNT

SEQ ID NO: 39426 - protein, 249 aa, Artificial Sequence
  Description of Artificial Sequence: Synthetic polypeptide
  XENP023616 1C11_H3_L3.47_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQAPKLLIYKVSNRFSGVPDRFSGSGSGTDFTLTISSLQAEDVAVYYCFQGSHVPNTFGGGTKVEIK

SEQ ID NO: 39427 - protein, 117 aa, Artificial Sequence; identical to SEQ ID NO: 33034
  Description of Artificial Sequence: Synthetic polypeptide
  VH of XENP023616

SEQ ID NO: 39428 - protein, 112 aa, Artificial Sequence
  Description of Artificial Sequence: Synthetic polypeptide
  VL of XENP023616
DVLMTQSPDSLAVSLGERATINCKSSQSIVHSNGNTYLEWYQQKPGQAPKLLIYKVSNRFSGVPDRFSGSGSGTDFTLTISSLQAEDVAVYYCFQGSHVPNTFGGGTKVEIK

SEQ ID NO: 39429 - protein, 5 aa, Artificial Sequence
  Description of Artificial Sequence: Synthetic peptide
  XENP023616 vhCDR1
HYGMN

SEQ ID NO: 39430 - protein, 17 aa, Artificial Sequence
  Description of Artificial Sequence: Synthetic peptide
  XENP023616 vhCDR2
WINTYTGEPTYADGFTG

SEQ ID NO: 39431 - protein, 8 aa, Artificial Sequence
  Description of Artificial Sequence: Synthetic peptide
  XENP023616 vhCDR3
DYYGSSPY

SEQ ID NO: 39432 - protein, 16 aa, Artificial Sequence
  Description of Artificial Sequence: Synthetic peptide
  XENP023616 vlCDR1
KSSQSIVHSNGNTYLE

SEQ ID NO: 39433 - protein, 7 aa, Artificial Sequence
  Description of Artificial Sequence: Synthetic peptide
  XENP023616 vlCDR2
KVSNRFS

SEQ ID NO: 39434 - protein, 9 aa, Artificial Sequence
  Description of Artificial Sequence: Synthetic peptide
  XENP023616 vlCDR3
FQGSHVPNT

SEQ ID NO: 39435 - protein, 249 aa, Artificial Sequence
  Description of Artificial Sequence: Synthetic polypeptide
  XENP023624 1C11_H3_L3.57_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFTGVPDRFSGSGSGTDFTLTISSLQAEDVAVYYCFQGSHVPNTFGGGTKVEIK

SEQ ID NO: 39436 - protein, 117 aa, Artificial Sequence; identical to SEQ ID NO: 33034
  Description of Artificial Sequence: Synthetic polypeptide
  VH of XENP023624

SEQ ID NO: 39437 - protein, 112 aa, Artificial Sequence
  Description of Artificial Sequence: Synthetic polypeptide
  VL of XENP023624
DVLMTQSPDSLAVSLGERATINCKSSQSIVHSNGNTYLEWYQQKPGQSPKLLIYKVSNRFTGVPDRFSGSGSGTDFTLTISSLQAEDVAVYYCFQGSHVPNTFGGGTKVEIK

SEQ ID NO: 39438 - protein, 5 aa, Artificial Sequence
  Description of Artificial Sequence: Synthetic peptide
  XENP023624 vhCDR1
HYGMN

SEQ ID NO: 39439 - protein, 17 aa, Artificial Sequence
  Description of Artificial Sequence: Synthetic peptide
  XENP023624 vhCDR2
WINTYTGEPTYADGFTG

SEQ ID NO: 39440 - protein, 8 aa, Artificial Sequence
  Description of Artificial Sequence: Synthetic peptide
  XENP023624 vhCDR3
DYYGSSPY

SEQ ID NO: 39441 - protein, 16 aa, Artificial Sequence
  Description of Artificial Sequence: Synthetic peptide
  XENP023624 vlCDR1
KSSQSIVHSNGNTYLE

SEQ ID NO: 39442 - protein, 7 aa, Artificial Sequence
  Description of Artificial Sequence: Synthetic peptide
  XENP023624 vlCDR2
KVSNRFT

SEQ ID NO: 39443 - protein, 9 aa, Artificial Sequence
  Description of Artificial Sequence: Synthetic peptide
  XENP023624 vlCDR3
FQGSHVPNT

SEQ ID NO: 39444 - protein, 249 aa, Artificial Sequence
  Description of Artificial Sequence: Synthetic polypeptide
  XENP023626 1C11_H3_L3.59_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIK

SEQ ID NO: 39445 - protein, 117 aa, Artificial Sequence; identical to SEQ ID NO: 33034
  Description of Artificial Sequence: Synthetic polypeptide
  VH of XENP023626

SEQ ID NO: 39446 - protein, 112 aa, Artificial Sequence
  Description of Artificial Sequence: Synthetic polypeptide
  VL of XENP023626
DVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIK

SEQ ID NO: 39447 - protein, 5 aa, Artificial Sequence
  Description of Artificial Sequence: Synthetic peptide
  XENP023626 vhCDR1
HYGMN

SEQ ID NO: 39448 - protein, 17 aa, Artificial Sequence
  Description of Artificial Sequence: Synthetic peptide
  XENP023626 vhCDR2
WINTYTGEPTYADGFTG

SEQ ID NO: 39449 - protein, 8 aa, Artificial Sequence
  Description of Artificial Sequence: Synthetic peptide
  XENP023626 vhCDR3
DYYGSSPY

SEQ ID NO: 39450 - protein, 16 aa, Artificial Sequence
  Description of Artificial Sequence: Synthetic peptide
  XENP023626 vlCDR1
KSSQSIVHSNGNTYLE

SEQ ID NO: 39451 - protein, 7 aa, Artificial Sequence
  Description of Artificial Sequence: Synthetic peptide
  XENP023626 vlCDR2
KVSNRFS

SEQ ID NO: 39452 - protein, 9 aa, Artificial Sequence
  Description of Artificial Sequence: Synthetic peptide
  XENP023626 vlCDR3
FQGSHVPNT

SEQ ID NO: 39453 - protein, 249 aa, Artificial Sequence
  Description of Artificial Sequence: Synthetic polypeptide
  XENP023628 1C11_H3_L3.62_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSMQAEDVAVYYCFQGSHVPNTFGGGTKVEIK

SEQ ID NO: 39454 - protein, 117 aa, Artificial Sequence; identical to SEQ ID NO: 33034
  Description of Artificial Sequence: Synthetic polypeptide
  VH of XENP023628

SEQ ID NO: 39455 - protein, 112 aa, Artificial Sequence
  Description of Artificial Sequence: Synthetic polypeptide
  VL of XENP023628
DVLMTQSPDSLAVSLGERATINCKSSQSIVHSNGNTYLEWYQQKPGQSPKLLIYKVSNRFSGVPDRFSGSGSGTDFTLTISSMQAEDVAVYYCFQGSHVPNTFGGGTKVEIK

SEQ ID NO: 39456 - protein, 5 aa, Artificial Sequence
  Description of Artificial Sequence: Synthetic peptide
  XENP023628 vhCDR1
HYGMN

SEQ ID NO: 39457 - protein, 17 aa, Artificial Sequence
  Description of Artificial Sequence: Synthetic peptide
  XENP023628 vhCDR2
WINTYTGEPTYADGFTG

SEQ ID NO: 39458 - protein, 8 aa, Artificial Sequence
  Description of Artificial Sequence: Synthetic peptide
  XENP023628 vhCDR3
DYYGSSPY

SEQ ID NO: 39459 - protein, 16 aa, Artificial Sequence
  Description of Artificial Sequence: Synthetic peptide
  XENP023628 vlCDR1
KSSQSIVHSNGNTYLE

SEQ ID NO: 39460 - protein, 7 aa, Artificial Sequence
  Description of Artificial Sequence: Synthetic peptide
  XENP023628 vlCDR2
KVSNRFS

SEQ ID NO: 39461 - protein, 9 aa, Artificial Sequence
  Description of Artificial Sequence: Synthetic peptide
  XENP023628 vlCDR3
FQGSHVPNT

SEQ ID NO: 39462 - protein, 249 aa, Artificial Sequence
  Description of Artificial Sequence: Synthetic polypeptide
  XENP023629 1C11_H3_L3.63_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVQAEDVAVYYCFQGSHVPNTFGGGTKVEIK

SEQ ID NO: 39463 - protein, 117 aa, Artificial Sequence; identical to SEQ ID NO: 33034
  Description of Artificial Sequence: Synthetic polypeptide
  VH of XENP023629

SEQ ID NO: 39464 - protein, 112 aa, Artificial Sequence
  Description of Artificial Sequence: Synthetic polypeptide
  VL of XENP023629
DVLMTQSPDSLAVSLGERATINCKSSQSIVHSNGNTYLEWYQQKPGQSPKLLIYKVSNRFSGVPDRFSGSGSGTDFTLTISSVQAEDVAVYYCFQGSHVPNTFGGGTKVEIK

SEQ ID NO: 39465 - protein, 5 aa, Artificial Sequence
  Description of Artificial Sequence: Synthetic peptide
  XENP023629 vhCDR1
HYGMN

SEQ ID NO: 39466 - protein, 17 aa, Artificial Sequence
  Description of Artificial Sequence: Synthetic peptide
  XENP023629 vhCDR2
WINTYTGEPTYADGFTG

SEQ ID NO: 39467 - protein, 8 aa, Artificial Sequence
  Description of Artificial Sequence: Synthetic peptide
  XENP023629 vhCDR3
DYYGSSPY

SEQ ID NO: 39468 - protein, 16 aa, Artificial Sequence
  Description of Artificial Sequence: Synthetic peptide
  XENP023629 vlCDR1
KSSQSIVHSNGNTYLE

SEQ ID NO: 39469 - protein, 7 aa, Artificial Sequence
  Description of Artificial Sequence: Synthetic peptide
  XENP023629 vlCDR2
KVSNRFS

SEQ ID NO: 39470 - protein, 9 aa, Artificial Sequence
  Description of Artificial Sequence: Synthetic peptide
  XENP023629 vlCDR3
FQGSHVPNT

SEQ ID NO: 39471 - protein, 249 aa, Artificial Sequence
  Description of Artificial Sequence: Synthetic polypeptide
  XENP023633 1C11_H3_L3.69_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDAAVYYCFQGSHVPNTFGGGTKVEIK

SEQ ID NO: 39472 - protein, 117 aa, Artificial Sequence; identical to SEQ ID NO: 33034
  Description of Artificial Sequence: Synthetic polypeptide
  VH of XENP023633

SEQ ID NO: 39473 - protein, 112 aa, Artificial Sequence
  Description of Artificial Sequence: Synthetic polypeptide
  VL of XENP023633
DVLMTQSPDSLAVSLGERATINCKSSQSIVHSNGNTYLEWYQQKPGQSPKLLIYKVSNRFSGVPDRFSGSGSGTDFTLTISSLQAEDAAVYYCFQGSHVPNTFGGGTKVEIK

SEQ ID NO: 39474 - protein, 5 aa, Artificial Sequence
  Description of Artificial Sequence: Synthetic peptide
  XENP023633 vhCDR1
HYGMN

SEQ ID NO: 39475 - protein, 17 aa, Artificial Sequence
  Description of Artificial Sequence: Synthetic peptide
  XENP023633 vhCDR2
WINTYTGEPTYADGFTG

SEQ ID NO: 39476 - protein, 8 aa, Artificial Sequence
  Description of Artificial Sequence: Synthetic peptide
  XENP023633 vhCDR3
DYYGSSPY

SEQ ID NO: 39477 - protein, 16 aa, Artificial Sequence
  Description of Artificial Sequence: Synthetic peptide
  XENP023633 vlCDR1
KSSQSIVHSNGNTYLE

SEQ ID NO: 39478 - protein, 7 aa, Artificial Sequence
  Description of Artificial Sequence: Synthetic peptide
  XENP023633 vlCDR2
KVSNRFS

SEQ ID NO: 39479 - protein, 9 aa, Artificial Sequence
  Description of Artificial Sequence: Synthetic peptide
  XENP023633 vlCDR3
FQGSHVPNT

SEQ ID NO: 39480 - protein, 249 aa, Artificial Sequence
  Description of Artificial Sequence: Synthetic polypeptide
  XENP023636 1C11_H3_L3.73_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIK

SEQ ID NO: 39481 - protein, 117 aa, Artificial Sequence; identical to SEQ ID NO: 33034
  Description of Artificial Sequence: Synthetic polypeptide
  VH of XENP023636

SEQ ID NO: 39482 - protein, 112 aa, Artificial Sequence
  Description of Artificial Sequence: Synthetic polypeptide
  VL of XENP023636
DVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIK

SEQ ID NO: 39483 - protein, 5 aa, Artificial Sequence
  Description of Artificial Sequence: Synthetic peptide
  XENP023636 vhCDR1
HYGMN

SEQ ID NO: 39484 - protein, 17 aa, Artificial Sequence
  Description of Artificial Sequence: Synthetic peptide
  XENP023636 vhCDR2
WINTYTGEPTYADGFTG

SEQ ID NO: 39485 - protein, 8 aa, Artificial Sequence
  Description of Artificial Sequence: Synthetic peptide
  XENP023636 vhCDR3
DYYGSSPY

SEQ ID NO: 39486 - protein, 16 aa, Artificial Sequence
  Description of Artificial Sequence: Synthetic peptide
  XENP023636 vlCDR1
KSSQSIVHSNGNTYLE

SEQ ID NO: 39487 - protein, 7 aa, Artificial Sequence
  Description of Artificial Sequence: Synthetic peptide
  XENP023636 vlCDR2
KVSNRFS

SEQ ID NO: 39488 - protein, 9 aa, Artificial Sequence
  Description of Artificial Sequence: Synthetic peptide
  XENP023636 vlCDR3
FQGSHVPNT

SEQ ID NO: 39489 - protein, 249 aa, Artificial Sequence
  Description of Artificial Sequence: Synthetic polypeptide
  XENP023640 1C11_H3_L3.81_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGQGTKVEIK

SEQ ID NO: 39490 - protein, 117 aa, Artificial Sequence; identical to SEQ ID NO: 33034
  Description of Artificial Sequence: Synthetic polypeptide
  VH of XENP023640

SEQ ID NO: 39491 - protein, 112 aa, Artificial Sequence
  Description of Artificial Sequence: Synthetic polypeptide
  VL of XENP023640
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGQGTKVEIK

SEQ ID NO: 39492 - protein, 5 aa, Artificial Sequence
  Description of Artificial Sequence: Synthetic peptide
  XENP023640 vhCDR1
HYGMN

SEQ ID NO: 39493 - protein, 17 aa, Artificial Sequence
  Description of Artificial Sequence: Synthetic peptide
  XENP023640 vhCDR2
WINTYTGEPTYADGFTG

SEQ ID NO: 39494 - protein, 8 aa, Artificial Sequence
  Description of Artificial Sequence: Synthetic peptide
  XENP023640 vhCDR3
DYYGSSPY

SEQ ID NO: 39495 - protein, 16 aa, Artificial Sequence
  Description of Artificial Sequence: Synthetic peptide
  XENP023640 vlCDR1
KSSQSIVHSNGNTYLE

SEQ ID NO: 39496 - protein, 7 aa, Artificial Sequence
  Description of Artificial Sequence: Synthetic peptide
  XENP023640 vlCDR2
KVSNRFS

SEQ ID NO: 39497 - protein, 9 aa, Artificial Sequence
  Description of Artificial Sequence: Synthetic peptide
  XENP023640 vlCDR3
FQGSHVPNT

SEQ ID NO: 39498 - protein, 249 aa, Artificial Sequence
  Description of Artificial Sequence: Synthetic polypeptide
  XENP023755 1C11_H3.1_L3_scFv(GKPGS)4
QVQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39499 - protein, 117 aa, Artificial Sequence; identical to SEQ ID NO: 33650
  Description of Artificial Sequence: Synthetic polypeptide
  VH of XENP023755

SEQ ID NO: 39500 - protein, 112 aa, Artificial Sequence; identical to SEQ ID NO: 33009
  Description of Artificial Sequence: Synthetic polypeptide
  VL of XENP023755

SEQ ID NO: 39501 - protein, 5 aa, Artificial Sequence
  Description of Artificial Sequence: Synthetic peptide
  XENP023755 vhCDR1
HYGMN

SEQ ID NO: 39502 - protein, 17 aa, Artificial Sequence
  Description of Artificial Sequence: Synthetic peptide
  XENP023755 vhCDR2
WINTYTGEPTYADGFTG

SEQ ID NO: 39503 - protein, 8 aa, Artificial Sequence
  Description of Artificial Sequence: Synthetic peptide
  XENP023755 vhCDR3
DYYGSSPY

SEQ ID NO: 39504 - protein, 16 aa, Artificial Sequence
  Description of Artificial Sequence: Synthetic peptide
  XENP023755 vlCDR1
KSSQSIVHSNGNTYLE

SEQ ID NO: 39505 - protein, 7 aa, Artificial Sequence
  Description of Artificial Sequence: Synthetic peptide
  XENP023755 vlCDR2
KVSNRFS

SEQ ID NO: 39506 - protein, 9 aa, Artificial Sequence
  Description of Artificial Sequence: Synthetic peptide
  XENP023755 vlCDR3
FQGSHVPNT

SEQ ID NO: 39507 - protein, 249 aa, Artificial Sequence
  Description of Artificial Sequence: Synthetic polypeptide
  XENP023758 1C11_H3.5_L3_scFv(GKPGS)4
QIQLVQSGAELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39508 - protein, 117 aa, Artificial Sequence; identical to SEQ ID NO: 33677
  Description of Artificial Sequence: Synthetic polypeptide
  VH of XENP023758

SEQ ID NO: 39509 - protein, 112 aa, Artificial Sequence; identical to SEQ ID NO: 33009
  Description of Artificial Sequence: Synthetic polypeptide
  VL of XENP023758

SEQ ID NO: 39510 - protein, 5 aa, Artificial Sequence
  Description of Artificial Sequence: Synthetic peptide
  XENP023758 vhCDR1
HYGMN

SEQ ID NO: 39511 - protein, 17 aa, Artificial Sequence
  Description of Artificial Sequence: Synthetic peptide
  XENP023758 vhCDR2
WINTYTGEPTYADGFTG

SEQ ID NO: 39512 - protein, 8 aa, Artificial Sequence
  Description of Artificial Sequence: Synthetic peptide
  XENP023758 vhCDR3
DYYGSSPY

SEQ ID NO: 39513 - protein, 16 aa, Artificial Sequence
  Description of Artificial Sequence: Synthetic peptide
  XENP023758 vlCDR1
KSSQSIVHSNGNTYLE

SEQ ID NO: 39514 - protein, 7 aa, Artificial Sequence
  Description of Artificial Sequence: Synthetic peptide
  XENP023758 vlCDR2
KVSNRFS

SEQ ID NO: 39515 - protein, 9 aa, Artificial Sequence
  Description of Artificial Sequence: Synthetic peptide
  XENP023758 vlCDR3
FQGSHVPNT

SEQ ID NO: 39516 - protein, 249 aa, Artificial Sequence
  Description of Artificial Sequence: Synthetic polypeptide
  XENP023760 1C11_H3.7_L3_scFv(GKPGS)4
QIQLVQSGPELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39517 - protein, 117 aa, Artificial Sequence; identical to SEQ ID NO: 33695
  Description of Artificial Sequence: Synthetic polypeptide
  VH of XENP023760

SEQ ID NO: 39518 - protein, 112 aa, Artificial Sequence; identical to SEQ ID NO: 33009
  Description of Artificial Sequence: Synthetic polypeptide
  VL of XENP023760

SEQ ID NO: 39519 - protein, 5 aa, Artificial Sequence
  Description of Artificial Sequence: Synthetic peptide
  XENP023760 vhCDR1
HYGMN

SEQ ID NO: 39520 - protein, 17 aa, Artificial Sequence
  Description of Artificial Sequence: Synthetic peptide
  XENP023760 vhCDR2
WINTYTGEPTYADGFTG

SEQ ID NO: 39521 - protein, 8 aa, Artificial Sequence
  Description of Artificial Sequence: Synthetic peptide
  XENP023760 vhCDR3
DYYGSSPY

SEQ ID NO: 39522 - protein, 16 aa, Artificial Sequence
  Description of Artificial Sequence: Synthetic peptide
  XENP023760 vlCDR1
KSSQSIVHSNGNTYLE

SEQ ID NO: 39523 - protein, 7 aa, Artificial Sequence
  Description of Artificial Sequence: Synthetic peptide
  XENP023760 vlCDR2
KVSNRFS

SEQ ID NO: 39524 - protein, 9 aa, Artificial Sequence
  Description of Artificial Sequence: Synthetic peptide
  XENP023760 vlCDR3
FQGSHVPNT

SEQ ID NO: 39525 - protein, 249 aa, Artificial Sequence
  Description of Artificial Sequence: Synthetic polypeptide
  XENP023765 1C11_H3.18_L3_scFv(GKPGS)4
QIQLVQSGSELKKPGASVKVSCKASGYTFTHYGMNWVKQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39526 - protein, 117 aa, Artificial Sequence; identical to SEQ ID NO: 33740
  Description of Artificial Sequence: Synthetic polypeptide
  VH of XENP023765

SEQ ID NO: 39527 - protein, 112 aa, Artificial Sequence; identical to SEQ ID NO: 33009
  Description of Artificial Sequence: Synthetic polypeptide
  VL of XENP023765

SEQ ID NO: 39528 - protein, 5 aa, Artificial Sequence
  Description of Artificial Sequence: Synthetic peptide
  XENP023765 vhCDR1
HYGMN

SEQ ID NO: 39529 - protein, 17 aa, Artificial Sequence
  Description of Artificial Sequence: Synthetic peptide
  XENP023765 vhCDR2
WINTYTGEPTYADGFTG

SEQ ID NO: 39530 - protein, 8 aa, Artificial Sequence
  Description of Artificial Sequence: Synthetic peptide
  XENP023765 vhCDR3
DYYGSSPY

SEQ ID NO: 39531 - protein, 16 aa, Artificial Sequence
  Description of Artificial Sequence: Synthetic peptide
  XENP023765 vlCDR1
KSSQSIVHSNGNTYLE

SEQ ID NO: 39532 - protein, 7 aa, Artificial Sequence
  Description of Artificial Sequence: Synthetic peptide
  XENP023765 vlCDR2
KVSNRFS

SEQ ID NO: 39533 - protein, 9 aa, Artificial Sequence
  Description of Artificial Sequence: Synthetic peptide
  XENP023765 vlCDR3
FQGSHVPNT

SEQ ID NO: 39534 - protein, 249 aa, Artificial Sequence
  Description of Artificial Sequence: Synthetic polypeptide
  XENP023770 1C11_H3.25_L3_scFv(GKPGS)4
QIQLVQSGSELKKPGASVKVSCKASGYTFTHYGMNWVRQAPGQGLEWMGWINTNTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39535 - protein, 117 aa, Artificial Sequence; identical to SEQ ID NO: 33785
  Description of Artificial Sequence: Synthetic polypeptide
  VH of XENP023770

SEQ ID NO: 39536 - protein, 112 aa, Artificial Sequence; identical to SEQ ID NO: 33009
  Description of Artificial Sequence: Synthetic polypeptide
  VL of XENP023770

SEQ ID NO: 39537 - protein, 5 aa, Artificial Sequence
  Description of Artificial Sequence: Synthetic peptide
  XENP023770 vhCDR1
HYGMN

SEQ ID NO: 39538 - protein, 17 aa, Artificial Sequence
  Description of Artificial Sequence: Synthetic peptide
  XENP023770 vhCDR2
WINTNTGEPTYADGFTG

SEQ ID NO: 39539 - protein, 8 aa, Artificial Sequence
  Description of Artificial Sequence: Synthetic peptide
  XENP023770 vhCDR3
DYYGSSPY

SEQ ID NO: 39540 - protein, 16 aa, Artificial Sequence
  Description of Artificial Sequence: Synthetic peptide
  XENP023770 vlCDR1
KSSQSIVHSNGNTYLE

SEQ ID NO: 39541 - protein, 7 aa, Artificial Sequence
  Description of Artificial Sequence: Synthetic peptide
  XENP023770 vlCDR2
KVSNRFS

SEQ ID NO: 39542 - protein, 9 aa, Artificial Sequence
  Description of Artificial Sequence: Synthetic peptide
  XENP023770 vlCDR3
FQGSHVPNT

SEQ ID NO: 39543 - protein, 249 aa, Artificial Sequence
  Description of Artificial Sequence: Synthetic polypeptide
  XENP023776 1C11_H3.35_L3_scFv(GKPGS)4
QIQLVQSGSELKKPGASVKVSCKASGYTFTHYGMNWVRQAPGQGLEWMGWINTYTGEPTYADKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39544 - protein, 117 aa, Artificial Sequence; identical to SEQ ID NO: 33839
  Description of Artificial Sequence: Synthetic polypeptide
  VH of XENP023776

SEQ ID NO: 39545 - protein, 112 aa, Artificial Sequence; identical to SEQ ID NO: 33009
  Description of Artificial Sequence: Synthetic polypeptide
  VL of XENP023776

SEQ ID NO: 39546 - protein, 5 aa, Artificial Sequence
  Description of Artificial Sequence: Synthetic peptide
  XENP023776 vhCDR1
HYGMN

SEQ ID NO: 39547 - protein, 17 aa, Artificial Sequence
  Description of Artificial Sequence: Synthetic peptide
  XENP023776 vhCDR2
WINTYTGEPTYADKFTG

SEQ ID NO: 39548 - protein, 8 aa, Artificial Sequence
  Description of Artificial Sequence: Synthetic peptide
  XENP023776 vhCDR3
DYYGSSPY

SEQ ID NO: 39549 - protein, 16 aa, Artificial Sequence
  Description of Artificial Sequence: Synthetic peptide
  XENP023776 vlCDR1
KSSQSIVHSNGNTYLE

SEQ ID NO: 39550 - protein, 7 aa, Artificial Sequence
  Description of Artificial Sequence: Synthetic peptide
  XENP023776 vlCDR2
KVSNRFS

SEQ ID NO: 39551 - protein, 9 aa, Artificial Sequence
  Description of Artificial Sequence: Synthetic peptide
  XENP023776 vlCDR3
FQGSHVPNT

SEQ ID NO: 39552 - protein, 249 aa, Artificial Sequence
  Description of Artificial Sequence: Synthetic polypeptide
  XENP023779 1C11_H3.41_L3_scFv(GKPGS)4
QIQLVQSGSELKKPGASVKVSCKASGYTFTHYGMNWVRQAPGQGLEWMGWINTYTGEPTYADGFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39553 - protein, 117 aa, Artificial Sequence; identical to SEQ ID NO: 33866
  Description of Artificial Sequence: Synthetic polypeptide
  VH of XENP023779

SEQ ID NO: 39554 - protein, 112 aa, Artificial Sequence; identical to SEQ ID NO: 33009
  Description of Artificial Sequence: Synthetic polypeptide
  VL of XENP023779

SEQ ID NO: 39555 - protein, 5 aa, Artificial Sequence
  Description of Artificial Sequence: Synthetic peptide
  XENP023779 vhCDR1
HYGMN

SEQ ID NO: 39556 - protein, 17 aa, Artificial Sequence
  Description of Artificial Sequence: Synthetic peptide
  XENP023779 vhCDR2
WINTYTGEPTYADGFKG

SEQ ID NO: 39557 - protein, 8 aa, Artificial Sequence
  Description of Artificial Sequence: Synthetic peptide
  XENP023779 vhCDR3
DYYGSSPY

SEQ ID NO: 39558 - protein, 16 aa, Artificial Sequence
  Description of Artificial Sequence: Synthetic peptide
  XENP023779 vlCDR1
KSSQSIVHSNGNTYLE

SEQ ID NO: 39559 - protein, 7 aa, Artificial Sequence
  Description of Artificial Sequence: Synthetic peptide
  XENP023779 vlCDR2
KVSNRFS

SEQ ID NO: 39560 - protein, 9 aa, Artificial Sequence
  Description of Artificial Sequence: Synthetic peptide
  XENP023779 vlCDR3
FQGSHVPNT

SEQ ID NO: 39561 - protein, 249 aa, Artificial Sequence
  Description of Artificial Sequence: Synthetic polypeptide
  XENP023780 1C11_H3.42_L3_scFv(GKPGS)4
QIQLVQSGSELKKPGASVKVSCKASGYTFTHYGMNWVRQAPGQGLEWMGWINTYTGEPTYADGFQGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39562 - protein, 117 aa, Artificial Sequence; identical to SEQ ID NO: 33875
  Description of Artificial Sequence: Synthetic polypeptide
  VH of XENP023780

SEQ ID NO: 39563 - protein, 112 aa, Artificial Sequence; identical to SEQ ID NO: 33009
  Description of Artificial Sequence: Synthetic polypeptide
  VL of XENP023780

SEQ ID NO: 39564 - protein, 5 aa, Artificial Sequence
  Description of Artificial Sequence: Synthetic peptide
  XENP023780 vhCDR1
HYGMN

SEQ ID NO: 39565 - protein, 17 aa, Artificial Sequence
  Description of Artificial Sequence: Synthetic peptide
  XENP023780 vhCDR2
WINTYTGEPTYADGFQG

SEQ ID NO: 39566 - protein, 8 aa, Artificial Sequence
  Description of Artificial Sequence: Synthetic peptide
  XENP023780 vhCDR3
DYYGSSPY

SEQ ID NO: 39567 - protein, 16 aa, Artificial Sequence
  Description of Artificial Sequence: Synthetic peptide
  XENP023780 vlCDR1
KSSQSIVHSNGNTYLE

SEQ ID NO: 39568 - protein, 7 aa, Artificial Sequence
  Description of Artificial Sequence: Synthetic peptide
  XENP023780 vlCDR2
KVSNRFS

SEQ ID NO: 39569 - protein, 9 aa, Artificial Sequence
  Description of Artificial Sequence: Synthetic peptide
  XENP023780 vlCDR3
FQGSHVPNT

SEQ ID NO: 39570 - protein, 249 aa, Artificial Sequence
  Description of Artificial Sequence: Synthetic polypeptide
  XENP023781 1C11_H3.43_L3_scFv(GKPGS)4
QIQLVQSGSELKKPGASVKVSCKASGYTFTHYGMNWVRQAPGQGLEWMGWINTYTGEPTYADGFTGRVVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39571 - protein, 117 aa, Artificial Sequence; identical to SEQ ID NO: 33884
  Description of Artificial Sequence: Synthetic polypeptide
  VH of XENP023781

SEQ ID NO: 39572 - protein, 112 aa, Artificial Sequence; identical to SEQ ID NO: 33009
  Description of Artificial Sequence: Synthetic polypeptide
  VL of XENP023781

SEQ ID NO: 39573 - protein, 5 aa, Artificial Sequence
  Description of Artificial Sequence: Synthetic peptide
  XENP023781 vhCDR1
HYGMN

SEQ ID NO: 39574 - protein, 17 aa, Artificial Sequence
  Description of Artificial Sequence: Synthetic peptide
  XENP023781 vhCDR2
WINTYTGEPTYADGFTG

SEQ ID NO: 39575 - protein, 8 aa, Artificial Sequence
  Description of Artificial Sequence: Synthetic peptide
  XENP023781 vhCDR3
DYYGSSPY

SEQ ID NO: 39576 - protein, 16 aa, Artificial Sequence
  Description of Artificial Sequence: Synthetic peptide
  XENP023781 vlCDR1
KSSQSIVHSNGNTYLE

SEQ ID NO: 39577 - protein, 7 aa, Artificial Sequence
  Description of Artificial Sequence: Synthetic peptide
  XENP023781 vlCDR2
KVSNRFS

SEQ ID NO: 39578 - protein, 9 aa, Artificial Sequence
  Description of Artificial Sequence: Synthetic peptide
  XENP023781 vlCDR3
FQGSHVPNT

SEQ ID NO: 39579 - protein, 249 aa, Artificial Sequence
  Description of Artificial Sequence: Synthetic polypeptide
  XENP023786 1C11_H3.50_L3_scFv(GKPGS)4
QIQLVQSGSELKKPGASVKVSCKASGYTFTHYGMNWVRQAPGQGLEWMGWINTYTGEPTYADGFTGRFVFSADTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39580 - protein, 117 aa, Artificial Sequence; identical to SEQ ID NO: 33929
  Description of Artificial Sequence: Synthetic polypeptide
  VH of XENP023786

SEQ ID NO: 39581 - protein, 112 aa, Artificial Sequence; identical to SEQ ID NO: 33009
  Description of Artificial Sequence: Synthetic polypeptide
  VL of XENP023786

SEQ ID NO: 39582 - protein, 5 aa, Artificial Sequence
  Description of Artificial Sequence: Synthetic peptide
  XENP023786 vhCDR1
HYGMN

SEQ ID NO: 39583 - protein, 17 aa, Artificial Sequence
  Description of Artificial Sequence: Synthetic peptide
  XENP023786 vhCDR2
WINTYTGEPTYADGFTG

SEQ ID NO: 39584 - protein, 8 aa, Artificial Sequence
  Description of Artificial Sequence: Synthetic peptide
  XENP023786 vhCDR3
DYYGSSPY

SEQ ID NO: 39585 - protein, 16 aa, Artificial Sequence
  Description of Artificial Sequence: Synthetic peptide
  XENP023786 vlCDR1
KSSQSIVHSNGNTYLE

SEQ ID NO: 39586 - protein, 7 aa, Artificial Sequence
  Description of Artificial Sequence: Synthetic peptide
  XENP023786 vlCDR2
KVSNRFS

SEQ ID NO: 39587 - protein, 9 aa, Artificial Sequence
  Description of Artificial Sequence: Synthetic peptide
  XENP023786 vlCDR3
FQGSHVPNT

SEQ ID NO: 39588 - protein, 249 aa, Artificial Sequence
  Description of Artificial Sequence: Synthetic polypeptide
  XENP023793 1C11_H3.59_L3_scFv(GKPGS)4
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39589 - protein, 117 aa, Artificial Sequence; identical to SEQ ID NO: 33992
  Description of Artificial Sequence: Synthetic polypeptide
  VH of XENP023793

SEQ ID NO: 39590 - protein, 112 aa, Artificial Sequence; identical to SEQ ID NO: 33009
  Description of Artificial Sequence: Synthetic polypeptide
  VL of XENP023793

SEQ ID NO: 39591 - protein, 5 aa, Artificial Sequence
  Description of Artificial Sequence: Synthetic peptide
  XENP023793 vhCDR1
HYGMN

SEQ ID NO: 39592 - protein, 17 aa, Artificial Sequence
  Description of Artificial Sequence: Synthetic peptide
  XENP023793 vhCDR2
WINTYTGEPTYADGFTG

SEQ ID NO: 39593 - protein, 8 aa, Artificial Sequence
  Description of Artificial Sequence: Synthetic peptide
  XENP023793 vhCDR3
DYYGSSPY

SEQ ID NO: 39594 - protein, 16 aa, Artificial Sequence
  Description of Artificial Sequence: Synthetic peptide
  XENP023793 vlCDR1
KSSQSIVHSNGNTYLE

SEQ ID NO: 39595 - protein, 7 aa, Artificial Sequence
  Description of Artificial Sequence: Synthetic peptide
  XENP023793 vlCDR2
KVSNRFS

SEQ ID NO: 39596 - protein, 9 aa, Artificial Sequence
  Description of Artificial Sequence: Synthetic peptide
  XENP023793 vlCDR3
FQGSHVPNT

SEQ ID NO: 39597 - protein, 249 aa, Artificial Sequence
  Description of Artificial Sequence: Synthetic polypeptide
  XENP023796 1C11_H3.62_L3_scFv(GKPGS)4
QIQLVQSGSELKKPGASVKVSCKASGYTFTHYGMNWVRQAPGQGLEWMGWINTYTGEPTYADGFTGRFVFSLDTSVSTIYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39598 - protein, 117 aa, Artificial Sequence; identical to SEQ ID NO: 34019
  Description of Artificial Sequence: Synthetic polypeptide
  VH of XENP023796

SEQ ID NO: 39599 - protein, 112 aa, Artificial Sequence; identical to SEQ ID NO: 33009
  Description of Artificial Sequence: Synthetic polypeptide
  VL of XENP023796

SEQ ID NO: 39600 - protein, 5 aa, Artificial Sequence
  Description of Artificial Sequence: Synthetic peptide
  XENP023796 vhCDR1
HYGMN

SEQ ID NO: 39601 - protein, 17 aa, Artificial Sequence
  Description of Artificial Sequence: Synthetic peptide
  XENP023796 vhCDR2
WINTYTGEPTYADGFTG

SEQ ID NO: 39602 - protein, 8 aa, Artificial Sequence
  Description of Artificial Sequence: Synthetic peptide
  XENP023796 vhCDR3
DYYGSSPY

SEQ ID NO: 39603 - protein, 16 aa, Artificial Sequence
  Description of Artificial Sequence: Synthetic peptide
  XENP023796 vlCDR1
KSSQSIVHSNGNTYLE

SEQ ID NO: 39604 - protein, 7 aa, Artificial Sequence
  Description of Artificial Sequence: Synthetic peptide
  XENP023796 vlCDR2
KVSNRFS

SEQ ID NO: 39605 - protein, 9 aa, Artificial Sequence
  Description of Artificial Sequence: Synthetic peptide
  XENP023796 vlCDR3
FQGSHVPNT

SEQ ID NO: 39606 - protein, 249 aa, Artificial Sequence
  Description of Artificial Sequence: Synthetic polypeptide
  XENP023811 1C11_H3.74_L3_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39607 - protein, 117 aa, Artificial Sequence; identical to SEQ ID NO: 34118
  Description of Artificial Sequence: Synthetic polypeptide
  VH of XENP023811

SEQ ID NO: 39608 - protein, 112 aa, Artificial Sequence; identical to SEQ ID NO: 33009
  Description of Artificial Sequence: Synthetic polypeptide
  VL of XENP023811

SEQ ID NO: 39609 - protein, 5 aa, Artificial Sequence
  Description of Artificial Sequence: Synthetic peptide
  XENP023811 vhCDR1
HYGMN

SEQ ID NO: 39610 - protein, 17 aa, Artificial Sequence
  Description of Artificial Sequence: Synthetic peptide
  XENP023811 vhCDR2
WINTYTGEPTYADGFTG

SEQ ID NO: 39611 - protein, 8 aa, Artificial Sequence
  Description of Artificial Sequence: Synthetic peptide
  XENP023811 vhCDR3
DYYGSSPY

SEQ ID NO: 39612 - protein, 16 aa, Artificial Sequence
  Description of Artificial Sequence: Synthetic peptide
  XENP023811 vlCDR1
KSSQSIVHSNGNTYLE

SEQ ID NO: 39613 - protein, 7 aa, Artificial Sequence
  Description of Artificial Sequence: Synthetic peptide
  XENP023811 vlCDR2
KVSNRFS

SEQ ID NO: 39614 - protein, 9 aa, Artificial Sequence
  Description of Artificial Sequence: Synthetic peptide
  XENP023811 vlCDR3
FQGSHVPNT

SEQ ID NO: 39615 - protein, 249 aa, Artificial Sequence
  Description of Artificial Sequence: Synthetic polypeptide
  XENP024201 1C11_H3_L3.113_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGKSPKLLIYKVSNRFSGVPDRFSGSGSGTDFTLTISSLQAEDVAVYYCFQGSHVPNTFGGGTKVEIK

SEQ ID NO: 39616 - protein, 117 aa, Artificial Sequence; identical to SEQ ID NO: 33034
  Description of Artificial Sequence: Synthetic polypeptide
  VH of XENP024201

SEQ ID NO: 39617 - protein, 112 aa, Artificial Sequence
  Description of Artificial Sequence: Synthetic polypeptide
  VL of XENP024201
DVLMTQSPDSLAVSLGERATINCKSSQSIVHSNGNTYLEWYQQKPGKSPKLLIYKVSNRFSGVPDRFSGSGSGTDFTLTISSLQAEDVAVYYCFQGSHVPNTFGGGTKVEIK

SEQ ID NO: 39618 - protein, 5 aa, Artificial Sequence
  Description of Artificial Sequence: Synthetic peptide
  XENP024201 vhCDR1
HYGMN

SEQ ID NO: 39619 - protein, 17 aa, Artificial Sequence
  Description of Artificial Sequence: Synthetic peptide
  XENP024201 vhCDR2
WINTYTGEPTYADGFTG

SEQ ID NO: 39620 - protein, 8 aa, Artificial Sequence
  Description of Artificial Sequence: Synthetic peptide
  XENP024201 vhCDR3
DYYGSSPY

SEQ ID NO: 39621 - protein, 16 aa, Artificial Sequence
  Description of Artificial Sequence: Synthetic peptide
  XENP024201 vlCDR1
KSSQSIVHSNGNTYLE

SEQ ID NO: 39622 - protein, 7 aa, Artificial Sequence
  Description of Artificial Sequence: Synthetic peptide
  XENP024201 vlCDR2
KVSNRFS

SEQ ID NO: 39623 - protein, 9 aa, Artificial Sequence
  Description of Artificial Sequence: Synthetic peptide
  XENP024201 vlCDR3
FQGSHVPNT

SEQ ID NO: 39624 - protein, 249 aa, Artificial Sequence
  Description of Artificial Sequence: Synthetic polypeptide
  XENP024207 1C11_H3_L3.122_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGIPDRFSGSGSGTDFTLTISSLQAEDVAVYYCFQGSHVPNTFGGGTKVEIK

SEQ ID NO: 39625 - protein, 117 aa, Artificial Sequence; identical to SEQ ID NO: 33034
  Description of Artificial Sequence: Synthetic polypeptide
  VH of XENP024207

SEQ ID NO: 39626 - protein, 112 aa, Artificial Sequence
  Description of Artificial Sequence: Synthetic polypeptide
  VL of XENP024207
DVLMTQSPDSLAVSLGERATINCKSSQSIVHSNGNTYLEWYQQKPGQSPKLLIYKVSNRFSGIPDRFSGSGSGTDFTLTISSLQAEDVAVYYCFQGSHVPNTFGGGTKVEIK

SEQ ID NO: 39627 - protein, 5 aa, Artificial Sequence
  Description of Artificial Sequence: Synthetic peptide
  XENP024207 vhCDR1
HYGMN

SEQ ID NO: 39628 - protein, 17 aa, Artificial Sequence
  Description of Artificial Sequence: Synthetic peptide
  XENP024207 vhCDR2
WINTYTGEPTYADGFTG

SEQ ID NO: 39629 - protein, 8 aa, Artificial Sequence
  Description of Artificial Sequence: Synthetic peptide
  XENP024207 vhCDR3
DYYGSSPY

SEQ ID NO: 39630 - protein, 16 aa, Artificial Sequence
  Description of Artificial Sequence: Synthetic peptide
  XENP024207 vlCDR1
KSSQSIVHSNGNTYLE

SEQ ID NO: 39631 - protein, 7 aa, Artificial Sequence
  Description of Artificial Sequence: Synthetic peptide
  XENP024207 vlCDR2
KVSNRFS

SEQ ID NO: 39632 - protein, 9 aa, Artificial Sequence
  Description of Artificial Sequence: Synthetic peptide
  XENP024207 vlCDR3
FQGSHVPNT

SEQ ID NO: 39633 - protein, 249 aa, Artificial Sequence
  Description of Artificial Sequence: Synthetic polypeptide
  XENP024208 1C11_H3_L3.124_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPARFSGSGSGTDFTLTISSLQAEDVAVYYCFQGSHVPNTFGGGTKVEIK

SEQ ID NO: 39634 - protein, 117 aa, Artificial Sequence; identical to SEQ ID NO: 33034
  Description of Artificial Sequence: Synthetic polypeptide
  VH of XENP024208

SEQ ID NO: 39635 - protein, 112 aa, Artificial Sequence
  Description of Artificial Sequence: Synthetic polypeptide
  VL of XENP024208
DVLMTQSPDSLAVSLGERATINCKSSQSIVHSNGNTYLEWYQQKPGQSPKLLIYKVSNRFSGVPARFSGSGSGTDFTLTISSLQAEDVAVYYCFQGSHVPNTFGGGTKVEIK

SEQ ID NO: 39636 - protein, 5 aa, Artificial Sequence
  Description of Artificial Sequence: Synthetic peptide
  XENP024208 vhCDR1
HYGMN

SEQ ID NO: 39637 - protein, 17 aa, Artificial Sequence
  Description of Artificial Sequence: Synthetic peptide
  XENP024208 vhCDR2
WINTYTGEPTYADGFTG

SEQ ID NO: 39638 - protein, 8 aa, Artificial Sequence
  Description of Artificial Sequence: Synthetic peptide
  XENP024208 vhCDR3
DYYGSSPY

SEQ ID NO: 39639 - protein, 16 aa, Artificial Sequence
  Description of Artificial Sequence: Synthetic peptide
  XENP024208 vlCDR1
KSSQSIVHSNGNTYLE

SEQ ID NO: 39640 - protein, 7 aa, Artificial Sequence
  Description of Artificial Sequence: Synthetic peptide
  XENP024208 vlCDR2
KVSNRFS

SEQ ID NO: 39641 - protein, 9 aa, Artificial Sequence
  Description of Artificial Sequence: Synthetic peptide
  XENP024208 vlCDR3
FQGSHVPNT

SEQ ID NO: 39642 - protein, 249 aa, Artificial Sequence
  Description of Artificial Sequence: Synthetic polypeptide
  XENP024209 1C11_H3_L3.125_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIK

SEQ ID NO: 39643 - protein, 117 aa, Artificial Sequence; identical to SEQ ID NO: 33034
  Description of Artificial Sequence: Synthetic polypeptide
  VH of XENP024209

SEQ ID NO: 39644 - protein, 112 aa, Artificial Sequence
  Description of Artificial Sequence: Synthetic polypeptide
  VL of XENP024209
DVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIK

SEQ ID NO: 39645 - protein, 5 aa, Artificial Sequence
  Description of Artificial Sequence: Synthetic peptide
  XENP024209 vhCDR1
HYGMN

SEQ ID NO: 39646 - protein, 17 aa, Artificial Sequence
  Description of Artificial Sequence: Synthetic peptide
  XENP024209 vhCDR2
WINTYTGEPTYADGFTG

SEQ ID NO: 39647 - protein, 8 aa, Artificial Sequence
  Description of Artificial Sequence: Synthetic peptide
  XENP024209 vhCDR3
DYYGSSPY

SEQ ID NO: 39648 - protein, 16 aa, Artificial Sequence
  Description of Artificial Sequence: Synthetic peptide
  XENP024209 vlCDR1
KSSQSIVHSNGNTYLE

SEQ ID NO: 39649 - protein, 7 aa, Artificial Sequence
  Description of Artificial Sequence: Synthetic peptide
  XENP024209 vlCDR2
KVSNRFS

SEQ ID NO: 39650 - protein, 9 aa, Artificial Sequence
  Description of Artificial Sequence: Synthetic peptide
  XENP024209 vlCDR3
FQGSHVPNT

SEQ ID NO: 39651 - protein, 249 aa, Artificial Sequence
  Description of Artificial Sequence: Synthetic polypeptide
  XENP024210 1C11_H3_L3.132_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGPGTKVEIK

SEQ ID NO: 39652 - protein, 117 aa, Artificial Sequence; identical to SEQ ID NO: 33034
  Description of Artificial Sequence: Synthetic polypeptide
  VH of XENP024210

SEQ ID NO: 39653 - protein, 112 aa, Artificial Sequence
  Description of Artificial Sequence: Synthetic polypeptide
  VL of XENP024210
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGPGTKVEIK

SEQ ID NO: 39654 - protein, 5 aa, Artificial Sequence
  Description of Artificial Sequence: Synthetic peptide
  XENP024210 vhCDR1
HYGMN

SEQ ID NO: 39655 - protein, 17 aa, Artificial Sequence
  Description of Artificial Sequence: Synthetic peptide
  XENP024210 vhCDR2
WINTYTGEPTYADGFTG

SEQ ID NO: 39656 - protein, 8 aa, Artificial Sequence
  Description of Artificial Sequence: Synthetic peptide
  XENP024210 vhCDR3
DYYGSSPY

SEQ ID NO: 39657 - protein, 16 aa, Artificial Sequence
  Description of Artificial Sequence: Synthetic peptide
  XENP024210 vlCDR1
KSSQSIVHSNGNTYLE

SEQ ID NO: 39658 - protein, 7 aa, Artificial Sequence
  Description of Artificial Sequence: Synthetic peptide
  XENP024210 vlCDR2
KVSNRFS

SEQ ID NO: 39659 - protein, 9 aa, Artificial Sequence
  Description of Artificial Sequence: Synthetic peptide
  XENP024210 vlCDR3
FQGSHVPNT

SEQ ID NO: 39660 - protein, 249 aa, Artificial Sequence
  Description of Artificial Sequence: Synthetic polypeptide
  XENP024211 1C11_H3.78_L3_scFv(GKPGS)4
QIQLVQSGPELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39661 - protein, 117 aa, Artificial Sequence; identical to SEQ ID NO: 34280
  Description of Artificial Sequence: Synthetic polypeptide
  VH of XENP024211

SEQ ID NO: 39662 - protein, 112 aa, Artificial Sequence; identical to SEQ ID NO: 33009
  Description of Artificial Sequence: Synthetic polypeptide
  VL of XENP024211

SEQ ID NO: 39663 - protein, 5 aa, Artificial Sequence
  Description of Artificial Sequence: Synthetic peptide
  XENP024211 vhCDR1
HYGMN

SEQ ID NO: 39664 - protein, 17 aa, Artificial Sequence
  Description of Artificial Sequence: Synthetic peptide
  XENP024211 vhCDR2
WINTNTGEPTYADGFTG

SEQ ID NO: 39665 - protein, 8 aa, Artificial Sequence
  Description of Artificial Sequence: Synthetic peptide
  XENP024211 vhCDR3
DYYGSSPY

SEQ ID NO: 39666 - protein, 16 aa, Artificial Sequence
  Description of Artificial Sequence: Synthetic peptide
  XENP024211 vlCDR1
KSSQSIVHSNGNTYLE

SEQ ID NO: 39667 - protein, 7 aa, Artificial Sequence
  Description of Artificial Sequence: Synthetic peptide
  XENP024211 vlCDR2
KVSNRFS

SEQ ID NO: 39668 - protein, 9 aa, Artificial Sequence
  Description of Artificial Sequence: Synthetic peptide
  XENP024211 vlCDR3
FQGSHVPNT

SEQ ID NO: 39669 - protein, 249 aa, Artificial Sequence
  Description of Artificial Sequence: Synthetic polypeptide
  XENP024212 1C11_H3.80_L3_scFv(GKPGS)4
QIQLVQSGSELKKPGASVKVSCKASGYTFTHYGMNWVRQAPGQGLEWMGWINTNTGEPTYADGFTGRFVFSVDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39670 - protein, 117 aa, Artificial Sequence; identical to SEQ ID NO: 34289
  Description of Artificial Sequence: Synthetic polypeptide
  VH of XENP024212

SEQ ID NO: 39671 - protein, 112 aa, Artificial Sequence; identical to SEQ ID NO: 33009
  Description of Artificial Sequence: Synthetic polypeptide
  VL of XENP024212

SEQ ID NO: 39672 - protein, 5 aa, Artificial Sequence
  Description of Artificial Sequence: Synthetic peptide
  XENP024212 vhCDR1
HYGMN

SEQ ID NO: 39673 - protein, 17 aa, Artificial Sequence
  Description of Artificial Sequence: Synthetic peptide
  XENP024212 vhCDR2
WINTNTGEPTYADGFTG

SEQ ID NO: 39674 - protein, 8 aa, Artificial Sequence
  Description of Artificial Sequence: Synthetic peptide
  XENP024212 vhCDR3
DYYGSSPY

SEQ ID NO: 39675 - protein, 16 aa, Artificial Sequence
  Description of Artificial Sequence: Synthetic peptide
  XENP024212 vlCDR1
KSSQSIVHSNGNTYLE

SEQ ID NO: 39676 - protein, 7 aa, Artificial Sequence
  Description of Artificial Sequence: Synthetic peptide
  XENP024212 vlCDR2
KVSNRFS

SEQ ID NO: 39677 - protein, 9 aa, Artificial Sequence
  Description of Artificial Sequence: Synthetic peptide
  XENP024212 vlCDR3
FQGSHVPNT

SEQ ID NO: 39678 - protein, 249 aa, Artificial Sequence
  Description of Artificial Sequence: Synthetic polypeptide
  XENP024213 1C11_H3.81_L3_scFv(GKPGS)4
QIQLVQSGSELKKPGASVKVSCKASGYTFTHYGMNWVRQAPGQGLEWMGWINTYTGEPTYADKFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39679 - protein, 117 aa, Artificial Sequence; identical to SEQ ID NO: 34298
  Description of Artificial Sequence: Synthetic polypeptide
  VH of XENP024213

SEQ ID NO: 39680 - protein, 112 aa, Artificial Sequence; identical to SEQ ID NO: 33009
  Description of Artificial Sequence: Synthetic polypeptide
  VL of XENP024213

SEQ ID NO: 39681 - protein, 5 aa, Artificial Sequence
  Description of Artificial Sequence: Synthetic peptide
  XENP024213 vhCDR1
HYGMN

SEQ ID NO: 39682 - protein, 17 aa, Artificial Sequence
  Description of Artificial Sequence: Synthetic peptide
  XENP024213 vhCDR2
WINTYTGEPTYADKFKG

SEQ ID NO: 39683 - protein, 8 aa, Artificial Sequence
  Description of Artificial Sequence: Synthetic peptide
  XENP024213 vhCDR3
DYYGSSPY

SEQ ID NO: 39684 - protein, 16 aa, Artificial Sequence
  Description of Artificial Sequence: Synthetic peptide
  XENP024213 vlCDR1
KSSQSIVHSNGNTYLE

SEQ ID NO: 39685 - protein, 7 aa, Artificial Sequence
  Description of Artificial Sequence: Synthetic peptide
  XENP024213 vlCDR2
KVSNRFS

SEQ ID NO: 39686 - protein, 9 aa, Artificial Sequence
  Description of Artificial Sequence: Synthetic peptide
  XENP024213 vlCDR3
FQGSHVPNT

SEQ ID NO: 39687 - protein, 249 aa, Artificial Sequence
  Description of Artificial Sequence: Synthetic polypeptide
  XENP024214 1C11_H3.82_L3_scFv(GKPGS)4
QIQLVQSGSELKKPGASVKVSCKASGYTFTHYGMNWVRQAPGQGLEWMGWINTYTGEPTYADKFQGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39688 - protein, 117 aa, Artificial Sequence; identical to SEQ ID NO: 34307
  Description of Artificial Sequence: Synthetic polypeptide
  VH of XENP024214

SEQ ID NO: 39689 - protein, 112 aa, Artificial Sequence; identical to SEQ ID NO: 33009
  Description of Artificial Sequence: Synthetic polypeptide
  VL of XENP024214

SEQ ID NO: 39690 - protein, 5 aa, Artificial Sequence
  Description of Artificial Sequence: Synthetic peptide
  XENP024214 vhCDR1
HYGMN

SEQ ID NO: 39691 - protein, 17 aa, Artificial Sequence
  Description of Artificial Sequence: Synthetic peptide
  XENP024214 vhCDR2
WINTYTGEPTYADKFQG

SEQ ID NO: 39692 - protein, 8 aa, Artificial Sequence
  Description of Artificial Sequence: Synthetic peptide
  XENP024214 vhCDR3
DYYGSSPY

SEQ ID NO: 39693 - protein, 16 aa, Artificial Sequence
  Description of Artificial Sequence: Synthetic peptide
  XENP024214 vlCDR1
KSSQSIVHSNGNTYLE

SEQ ID NO: 39694 - protein, 7 aa, Artificial Sequence
  Description of Artificial Sequence: Synthetic peptide
  XENP024214 vlCDR2
KVSNRFS

SEQ ID NO: 39695 - protein, 9 aa, Artificial Sequence
  Description of Artificial Sequence: Synthetic peptide
  XENP024214 vlCDR3
FQGSHVPNT

SEQ ID NO: 39696 - protein, 249 aa, Artificial Sequence
  Description of Artificial Sequence: Synthetic polypeptide
  XENP024215 1C11_H3.83_L3_scFv(GKPGS)4
QIQLVQSGSELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39697 - protein, 117 aa, Artificial Sequence; identical to SEQ ID NO: 34316
  Description of Artificial Sequence: Synthetic polypeptide
  VH of XENP024215

SEQ ID NO: 39698 - protein, 112 aa, Artificial Sequence; identical to SEQ ID NO: 33009
  Description of Artificial Sequence: Synthetic polypeptide
  VL of XENP024215

SEQ ID NO: 39699 - protein, 5 aa, Artificial Sequence
  Description of Artificial Sequence: Synthetic peptide
  XENP024215 vhCDR1
HYGMN

SEQ ID NO: 39700 - protein, 17 aa, Artificial Sequence
  Description of Artificial Sequence: Synthetic peptide
  XENP024215 vhCDR2
WINTNTGEPTYADGFTG

SEQ ID NO: 39701 - protein, 8 aa, Artificial Sequence
  Description of Artificial Sequence: Synthetic peptide
  XENP024215 vhCDR3
DYYGSSPY

SEQ ID NO: 39702 - protein, 16 aa, Artificial Sequence
  Description of Artificial Sequence: Synthetic peptide
  XENP024215 vlCDR1
KSSQSIVHSNGNTYLE

SEQ ID NO: 39703 - protein, 7 aa, Artificial Sequence
  Description of Artificial Sequence: Synthetic peptide
  XENP024215 vlCDR2
KVSNRFS

SEQ ID NO: 39704 - protein, 9 aa, Artificial Sequence
  Description of Artificial Sequence: Synthetic peptide
  XENP024215 vlCDR3
FQGSHVPNT

SEQ ID NO: 39705 - protein, 249 aa, Artificial Sequence
  Description of Artificial Sequence: Synthetic polypeptide
  XENP024216 1C11_H3.84_L3_scFv(GKPGS)4
QIQLVQSGSELKKPGASVKVSCKASGYTFTHYGMNWVRQAPGQGLEWMGWINTYTGEPTYADKFKGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39706 - protein, 117 aa, Artificial Sequence; identical to SEQ ID NO: 34325
  Description of Artificial Sequence: Synthetic polypeptide
  VH of XENP024216

SEQ ID NO: 39707 - protein, 112 aa, Artificial Sequence; identical to SEQ ID NO: 33009
  Description of Artificial Sequence: Synthetic polypeptide
  VL of XENP024216

SEQ ID NO: 39708 - protein, 5 aa, Artificial Sequence
  Description of Artificial Sequence: Synthetic peptide
  XENP024216 vhCDR1
HYGMN

SEQ ID NO: 39709 - protein, 17 aa, Artificial Sequence
  Description of Artificial Sequence: Synthetic peptide
  XENP024216 vhCDR2
WINTYTGEPTYADKFKG

SEQ ID NO: 39710 - protein, 8 aa, Artificial Sequence
  Description of Artificial Sequence: Synthetic peptide
  XENP024216 vhCDR3
DYYGSSPY

SEQ ID NO: 39711 - protein, 16 aa, Artificial Sequence
  Description of Artificial Sequence: Synthetic peptide
  XENP024216 vlCDR1
KSSQSIVHSNGNTYLE

SEQ ID NO: 39712 - protein, 7 aa, Artificial Sequence
  Description of Artificial Sequence: Synthetic peptide
  XENP024216 vlCDR2
KVSNRFS

SEQ ID NO: 39713 - protein, 9 aa, Artificial Sequence
  Description of Artificial Sequence: Synthetic peptide
  XENP024216 vlCDR3
FQGSHVPNT

SEQ ID NO: 39714 - protein, 249 aa, Artificial Sequence
  Description of Artificial Sequence: Synthetic polypeptide
  XENP024217 1C11_H3.85_L3_scFv(GKPGS)4
QIQLVQSGSELKKPGASVKVSCKASGYTFTHYGMNWVRQAPGQGLEWMGWINTYTGEPTYADKFQGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39715 - protein, 117 aa, Artificial Sequence; identical to SEQ ID NO: 34334
  Description of Artificial Sequence: Synthetic polypeptide
  VH of XENP024217

SEQ ID NO: 39716 - protein, 112 aa, Artificial Sequence; identical to SEQ ID NO: 33009
  Description of Artificial Sequence: Synthetic polypeptide
  VL of XENP024217

SEQ ID NO: 39717 - protein, 5 aa, Artificial Sequence
  Description of Artificial Sequence: Synthetic peptide
  XENP024217 vhCDR1
HYGMN

SEQ ID NO: 39718 - protein, 17 aa, Artificial Sequence
  Description of Artificial Sequence: Synthetic peptide
  XENP024217 vhCDR2
WINTYTGEPTYADKFQG

SEQ ID NO: 39719 - protein, 8 aa, Artificial Sequence
  Description of Artificial Sequence: Synthetic peptide
  XENP024217 vhCDR3
DYYGSSPY

SEQ ID NO: 39720 - protein, 16 aa, Artificial Sequence
  Description of Artificial Sequence: Synthetic peptide
  XENP024217 vlCDR1
KSSQSIVHSNGNTYLE

SEQ ID NO: 39721 - protein, 7 aa, Artificial Sequence
  Description of Artificial Sequence: Synthetic peptide
  XENP024217 vlCDR2
KVSNRFS

SEQ ID NO: 39722 - protein, 9 aa, Artificial Sequence
  Description of Artificial Sequence: Synthetic peptide
  XENP024217 vlCDR3
FQGSHVPNT

SEQ ID NO: 39723 - protein, 249 aa, Artificial Sequence
  Description of Artificial Sequence: Synthetic polypeptide
  XENP024218 1C11_H3.86_L3_scFv(GKPGS)4
EIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39724 - protein, 117 aa, Artificial Sequence; identical to SEQ ID NO: 34343
  Description of Artificial Sequence: Synthetic polypeptide
  VH of XENP024218

SEQ ID NO: 39725 - protein, 112 aa, Artificial Sequence; identical to SEQ ID NO: 33009
  Description of Artificial Sequence: Synthetic polypeptide
  VL of XENP024218

SEQ ID NO: 39726 - protein, 5 aa, Artificial Sequence
  Description of Artificial Sequence: Synthetic peptide
  XENP024218 vhCDR1
HYGMN

SEQ ID NO: 39727 - protein, 17 aa, Artificial Sequence
  Description of Artificial Sequence: Synthetic peptide
  XENP024218 vhCDR2
WINTYTGEPTYADGFTG

SEQ ID NO: 39728 - protein, 8 aa, Artificial Sequence
  Description of Artificial Sequence: Synthetic peptide
  XENP024218 vhCDR3
DYYGSSPY

SEQ ID NO: 39729 - protein, 16 aa, Artificial Sequence
  Description of Artificial Sequence: Synthetic peptide
  XENP024218 vlCDR1
KSSQSIVHSNGNTYLE

SEQ ID NO: 39730 - protein, 7 aa, Artificial Sequence
  Description of Artificial Sequence: Synthetic peptide
  XENP024218 vlCDR2
KVSNRFS

SEQ ID NO: 39731 - protein, 9 aa, Artificial Sequence
  Description of Artificial Sequence: Synthetic peptide
  XENP024218 vlCDR3
FQGSHVPNT

SEQ ID NO: 39732 - protein, 249 aa, Artificial Sequence
  Description of Artificial Sequence: Synthetic polypeptide
  XENP024221 1C11_H3.90_L3_scFv(GKPGS)4
QIQLVQSGSVLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39733 - protein, 117 aa, Artificial Sequence; identical to SEQ ID NO: 34370
  Description of Artificial Sequence: Synthetic polypeptide
  VH of XENP024221

SEQ ID NO: 39734 - protein, 112 aa, Artificial Sequence; identical to SEQ ID NO: 33009
  Description of Artificial Sequence: Synthetic polypeptide
  VL of XENP024221

SEQ ID NO: 39735 - protein, 5 aa, Artificial Sequence
  Description of Artificial Sequence: Synthetic peptide
  XENP024221 vhCDR1
HYGMN

SEQ ID NO: 39736 - protein, 17 aa, Artificial Sequence
  Description of Artificial Sequence: Synthetic peptide
  XENP024221 vhCDR2
WINTYTGEPTYADGFTG

SEQ ID NO: 39737 - protein, 8 aa, Artificial Sequence
  Description of Artificial Sequence: Synthetic peptide
  XENP024221 vhCDR3
DYYGSSPY

SEQ ID NO: 39738 - protein, 16 aa, Artificial Sequence
  Description of Artificial Sequence: Synthetic peptide
  XENP024221 vlCDR1
KSSQSIVHSNGNTYLE

SEQ ID NO: 39739 - protein, 7 aa, Artificial Sequence
  Description of Artificial Sequence: Synthetic peptide
  XENP024221 vlCDR2
KVSNRFS

SEQ ID NO: 39740 - protein, 9 aa, Artificial Sequence
  Description of Artificial Sequence: Synthetic peptide
  XENP024221 vlCDR3
FQGSHVPNT

SEQ ID NO: 39741 - protein, 249 aa, Artificial Sequence
  Description of Artificial Sequence: Synthetic polypeptide
  XENP024222 1C11_H3.91_L3_scFv(GKPGS)4
QIQLVQSGSELVKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39742 - protein, 117 aa, Artificial Sequence; identical to SEQ ID NO: 34379
  Description of Artificial Sequence: Synthetic polypeptide
  VH of XENP024222

SEQ ID NO: 39743 - protein, 112 aa, Artificial Sequence; identical to SEQ ID NO: 33009
  Description of Artificial Sequence: Synthetic polypeptide
  VL of XENP024222

SEQ ID NO: 39744 - protein, 5 aa, Artificial Sequence
  Description of Artificial Sequence: Synthetic peptide
  XENP024222 vhCDR1
HYGMN

SEQ ID NO: 39745 - protein, 17 aa, Artificial Sequence
  Description of Artificial Sequence: Synthetic peptide
  XENP024222 vhCDR2
WINTYTGEPTYADGFTG

SEQ ID NO: 39746 - protein, 8 aa, Artificial Sequence
  Description of Artificial Sequence: Synthetic peptide
  XENP024222 vhCDR3
DYYGSSPY

SEQ ID NO: 39747 - protein, 16 aa, Artificial Sequence
  Description of Artificial Sequence: Synthetic peptide
  XENP024222 vlCDR1
KSSQSIVHSNGNTYLE

SEQ ID NO: 39748 - protein, 7 aa, Artificial Sequence
  Description of Artificial Sequence: Synthetic peptide
  XENP024222 vlCDR2
KVSNRFS

SEQ ID NO: 39749 - protein, 9 aa, Artificial Sequence
  Description of Artificial Sequence: Synthetic peptide
  XENP024222 vlCDR3
FQGSHVPNT

SEQ ID NO: 39750 - protein, 249 aa, Artificial Sequence
  Description of Artificial Sequence: Synthetic polypeptide
  XENP024226 1C11_H3.95_L3_scFv(GKPGS)4
QIQLVQSGSELKKPGGSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39751 - protein, 117 aa, Artificial Sequence; identical to SEQ ID NO: 34415
  Description of Artificial Sequence: Synthetic polypeptide
  VH of XENP024226

SEQ ID NO: 39752 - protein, 112 aa, Artificial Sequence; identical to SEQ ID NO: 33009
  Description of Artificial Sequence: Synthetic polypeptide
  VL of XENP024226

SEQ ID NO: 39753 - protein, 5 aa, Artificial Sequence
  Description of Artificial Sequence: Synthetic peptide
  XENP024226 vhCDR1
HYGMN

SEQ ID NO: 39754 - protein, 17 aa, Artificial Sequence
  Description of Artificial Sequence: Synthetic peptide
  XENP024226 vhCDR2
WINTYTGEPTYADGFTG

SEQ ID NO: 39755 - protein, 8 aa, Artificial Sequence
  Description of Artificial Sequence: Synthetic peptide
  XENP024226 vhCDR3
DYYGSSPY

SEQ ID NO: 39756 - protein, 16 aa, Artificial Sequence
  Description of Artificial Sequence: Synthetic peptide
  XENP024226 vlCDR1
KSSQSIVHSNGNTYLE

SEQ ID NO: 39757 - protein, 7 aa, Artificial Sequence
  Description of Artificial Sequence: Synthetic peptide
  XENP024226 vlCDR2
KVSNRFS

SEQ ID NO: 39758 - protein, 9 aa, Artificial Sequence
  Description of Artificial Sequence: Synthetic peptide
  XENP024226 vlCDR3
FQGSHVPNT

SEQ ID NO: 39759 - protein, 249 aa, Artificial Sequence
  Description of Artificial Sequence: Synthetic polypeptide
  XENP024227 1C11_H3.96_L3_scFv(GKPGS)4
QIQLVQSGSELKKPGQSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39760 - protein, 117 aa, Artificial Sequence; identical to SEQ ID NO: 34424
  Description of Artificial Sequence: Synthetic polypeptide
  VH of XENP024227

SEQ ID NO: 39761 - protein, 112 aa, Artificial Sequence; identical to SEQ ID NO: 33009
  Description of Artificial Sequence: Synthetic polypeptide
  VL of XENP024227

SEQ ID NO: 39762 - protein, 5 aa, Artificial Sequence
  Description of Artificial Sequence: Synthetic peptide
  XENP024227 vhCDR1
HYGMN

SEQ ID NO: 39763 - protein, 17 aa, Artificial Sequence
  Description of Artificial Sequence: Synthetic peptide
  XENP024227 vhCDR2
WINTYTGEPTYADGFTG

SEQ ID NO: 39764 - protein, 8 aa, Artificial Sequence
  Description of Artificial Sequence: Synthetic peptide
  XENP024227 vhCDR3
DYYGSSPY

SEQ ID NO: 39765 - protein, 16 aa, Artificial Sequence
  Description of Artificial Sequence: Synthetic peptide
  XENP024227 vlCDR1
KSSQSIVHSNGNTYLE

SEQ ID NO: 39766 - protein, 7 aa, Artificial Sequence
  Description of Artificial Sequence: Synthetic peptide
  XENP024227 vlCDR2
KVSNRFS

SEQ ID NO: 39767 - protein, 9 aa, Artificial Sequence
  Description of Artificial Sequence: Synthetic peptide
  XENP024227 vlCDR3
FQGSHVPNT

SEQ ID NO: 39768 - protein, 249 aa, Artificial Sequence
  Description of Artificial Sequence: Synthetic polypeptide
  XENP024228 1C11_H3.97_L3_scFv(GKPGS)4
QIQLVQSGSELKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39769 - protein, 117 aa, Artificial Sequence; identical to SEQ ID NO: 34433
  Description of Artificial Sequence: Synthetic polypeptide
  VH of XENP024228

SEQ ID NO: 39770 - protein, 112 aa, Artificial Sequence; identical to SEQ ID NO: 33009
  Description of Artificial Sequence: Synthetic polypeptide
  VL of XENP024228

SEQ ID NO: 39771 - protein, 5 aa, Artificial Sequence
  Description of Artificial Sequence: Synthetic peptide
  XENP024228 vhCDR1
HYGMN

SEQ ID NO: 39772 - protein, 17 aa, Artificial Sequence
  Description of Artificial Sequence: Synthetic peptide
  XENP024228 vhCDR2
WINTYTGEPTYADGFTG

SEQ ID NO: 39773 - protein, 8 aa, Artificial Sequence
  Description of Artificial Sequence: Synthetic peptide
  XENP024228 vhCDR3
DYYGSSPY

SEQ ID NO: 39774 - protein, 16 aa, Artificial Sequence
  Description of Artificial Sequence: Synthetic peptide
  XENP024228 vlCDR1
KSSQSIVHSNGNTYLE

SEQ ID NO: 39775 - protein, 7 aa, Artificial Sequence
  Description of Artificial Sequence: Synthetic peptide
  XENP024228 vlCDR2
KVSNRFS

SEQ ID NO: 39776 - protein, 9 aa, Artificial Sequence
  Description of Artificial Sequence: Synthetic peptide
  XENP024228 vlCDR3
FQGSHVPNT

SEQ ID NO: 39777 - protein, 249 aa, Artificial Sequence
  Description of Artificial Sequence: Synthetic polypeptide
  XENP024247 1C11_H3.120_L3_scFv(GKPGS)4
QIQLVQSGSELKKPGASVKVSCKASGYTFTHYGINWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39778 - protein, 117 aa, Artificial Sequence; identical to SEQ ID NO: 34604
  Description of Artificial Sequence: Synthetic polypeptide
  VH of XENP024247

SEQ ID NO: 39779 - protein, 112 aa, Artificial Sequence; identical to SEQ ID NO: 33009
  Description of Artificial Sequence: Synthetic polypeptide
  VL of XENP024247

SEQ ID NO: 39780 - protein, 5 aa, Artificial Sequence
  Description of Artificial Sequence: Synthetic peptide
  XENP024247 vhCDR1
HYGIN

SEQ ID NO: 39781 - protein, 17 aa, Artificial Sequence
  Description of Artificial Sequence: Synthetic peptide
  XENP024247 vhCDR2
WINTYTGEPTYADGFTG

SEQ ID NO: 39782 - protein, 8 aa, Artificial Sequence
  Description of Artificial Sequence: Synthetic peptide
  XENP024247 vhCDR3
DYYGSSPY

SEQ ID NO: 39783 - protein, 16 aa, Artificial Sequence
  Description of Artificial Sequence: Synthetic peptide
  XENP024247 vlCDR1
KSSQSIVHSNGNTYLE

SEQ ID NO: 39784 - protein, 7 aa, Artificial Sequence
  Description of Artificial Sequence: Synthetic peptide
  XENP024247 vlCDR2
KVSNRFS

SEQ ID NO: 39785 - protein, 9 aa, Artificial Sequence
  Description of Artificial Sequence: Synthetic peptide
  XENP024247 vlCDR3
FQGSHVPNT

SEQ ID NO: 39786 - protein, 249 aa, Artificial Sequence
  Description of Artificial Sequence: Synthetic polypeptide
  XENP024250 1C11_H3.125_L3_scFv(GKPGS)4
QIQLVQSGSELKKPGASVKVSCKASGYTFTHYGMNWVRQPPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39787 - protein, 117 aa, Artificial Sequence; identical to SEQ ID NO: 34631
  Description of Artificial Sequence: Synthetic polypeptide
  VH of XENP024250

SEQ ID NO: 39788 - protein, 112 aa, Artificial Sequence; identical to SEQ ID NO: 33009
  Description of Artificial Sequence: Synthetic polypeptide
  VL of XENP024250

SEQ ID NO: 39789 - protein, 5 aa, Artificial Sequence
  Description of Artificial Sequence: Synthetic peptide
  XENP024250 vhCDR1
HYGMN

SEQ ID NO: 39790 - protein, 17 aa, Artificial Sequence
  Description of Artificial Sequence: Synthetic peptide
  XENP024250 vhCDR2
WINTYTGEPTYADGFTG

SEQ ID NO: 39791 - protein, 8 aa, Artificial Sequence
  Description of Artificial Sequence: Synthetic peptide
  XENP024250 vhCDR3
DYYGSSPY

SEQ ID NO: 39792 - protein, 16 aa, Artificial Sequence
  Description of Artificial Sequence: Synthetic peptide
  XENP024250 vlCDR1
KSSQSIVHSNGNTYLE

SEQ ID NO: 39793 - protein, 7 aa, Artificial Sequence
  Description of Artificial Sequence: Synthetic peptide
  XENP024250 vlCDR2
KVSNRFS

SEQ ID NO: 39794 - protein, 9 aa, Artificial Sequence
  Description of Artificial Sequence: Synthetic peptide
  XENP024250 vlCDR3
FQGSHVPNT

SEQ ID NO: 39795 - protein, 249 aa, Artificial Sequence
  Description of Artificial Sequence: Synthetic polypeptide
  XENP024254 1C11_H3.129_L3_scFv(GKPGS)4
QIQLVQSGSELKKPGASVKVSCKASGYTFTHYGMNWVRQAPGQGLEWIGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39796 - protein, 117 aa, Artificial Sequence; identical to SEQ ID NO: 34667
  Description of Artificial Sequence: Synthetic polypeptide
  VH of XENP024254

SEQ ID NO: 39797 - protein, 112 aa, Artificial Sequence; identical to SEQ ID NO: 33009
  Description of Artificial Sequence: Synthetic polypeptide
  VL of XENP024254

SEQ ID NO: 39798 - protein, 5 aa, Artificial Sequence
  Description of Artificial Sequence: Synthetic peptide
  XENP024254 vhCDR1
HYGMN

SEQ ID NO: 39799 - protein, 17 aa, Artificial Sequence
  Description of Artificial Sequence: Synthetic peptide
  XENP024254 vhCDR2
WINTYTGEPTYADGFTG

SEQ ID NO: 39800 - protein, 8 aa, Artificial Sequence
  Description of Artificial Sequence: Synthetic peptide
  XENP024254 vhCDR3
DYYGSSPY

SEQ ID NO: 39801 - protein, 16 aa, Artificial Sequence
  Description of Artificial Sequence: Synthetic peptide
  XENP024254 vlCDR1
KSSQSIVHSNGNTYLE

SEQ ID NO: 39802 - protein, 7 aa, Artificial Sequence
  Description of Artificial Sequence: Synthetic peptide
  XENP024254 vlCDR2
KVSNRFS

SEQ ID NO: 39803 - protein, 9 aa, Artificial Sequence
  Description of Artificial Sequence: Synthetic peptide
  XENP024254 vlCDR3
FQGSHVPNT

SEQ ID NO: 39804 - protein, 249 aa, Artificial Sequence
  Description of Artificial Sequence: Synthetic polypeptide
  XENP024256 1C11_H3.134_L3_scFv(GKPGS)4
QIQLVQSGSELKKPGASVKVSCKASGYTFTHYGMNWVRQAPGQGLEWMGWINTKTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39805 - protein, 117 aa, Artificial Sequence; identical to SEQ ID NO: 34685
  Description of Artificial Sequence: Synthetic polypeptide
  VH of XENP024256

SEQ ID NO: 39806 - protein, 112 aa, Artificial Sequence; identical to SEQ ID NO: 33009
  Description of Artificial Sequence: Synthetic polypeptide
  VL of XENP024256

SEQ ID NO: 39807 - protein, 5 aa, Artificial Sequence
  Description of Artificial Sequence: Synthetic peptide
  XENP024256 vhCDR1
HYGMN

SEQ ID NO: 39808 - protein, 17 aa, Artificial Sequence
  Description of Artificial Sequence: Synthetic peptide
  XENP024256 vhCDR2
WINTKTGEPTYADGFTG

SEQ ID NO: 39809 - protein, 8 aa, Artificial Sequence
  Description of Artificial Sequence: Synthetic peptide
  XENP024256 vhCDR3
DYYGSSPY

SEQ ID NO: 39810 - protein, 16 aa, Artificial Sequence
  Description of Artificial Sequence: Synthetic peptide
  XENP024256 vlCDR1
KSSQSIVHSNGNTYLE

SEQ ID NO: 39811 - protein, 7 aa, Artificial Sequence
  Description of Artificial Sequence: Synthetic peptide
  XENP024256 vlCDR2
KVSNRFS

SEQ ID NO: 39812 - protein, 9 aa, Artificial Sequence
  Description of Artificial Sequence: Synthetic peptide
  XENP024256 vlCDR3
FQGSHVPNT

SEQ ID NO: 39813 - protein, 249 aa, Artificial Sequence
  Description of Artificial Sequence: Synthetic polypeptide
  XENP024263 1C11_H3.143_L3_scFv(GKPGS)4
QIQLVQSGSELKKPGASVKVSCKASGYTFTHYGMNWVRQAPGQGLEWMGWINTYTGEPYYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39814 - protein, 117 aa, Artificial Sequence; identical to SEQ ID NO: 34748
  Description of Artificial Sequence: Synthetic polypeptide
  VH of XENP024263

SEQ ID NO: 39815 - protein, 112 aa, Artificial Sequence; identical to SEQ ID NO: 33009
  Description of Artificial Sequence: Synthetic polypeptide
  VL of XENP024263

SEQ ID NO: 39816 - protein, 5 aa, Artificial Sequence
  Description of Artificial Sequence: Synthetic peptide
  XENP024263 vhCDR1
HYGMN

SEQ ID NO: 39817 - protein, 17 aa, Artificial Sequence
  Description of Artificial Sequence: Synthetic peptide
  XENP024263 vhCDR2
WINTYTGEPYYADGFTG

SEQ ID NO: 39818 - protein, 8 aa, Artificial Sequence
  Description of Artificial Sequence: Synthetic peptide
  XENP024263 vhCDR3
DYYGSSPY

SEQ ID NO: 39819 - protein, 16 aa, Artificial Sequence
  Description of Artificial Sequence: Synthetic peptide
  XENP024263 vlCDR1
KSSQSIVHSNGNTYLE

SEQ ID NO: 39820 - protein, 7 aa, Artificial Sequence
  Description of Artificial Sequence: Synthetic peptide
  XENP024263 vlCDR2
KVSNRFS

SEQ ID NO: 39821 - protein, 9 aa, Artificial Sequence
  Description of Artificial Sequence: Synthetic peptide
  XENP024263 vlCDR3
FQGSHVPNT

SEQ ID NO: 39822 - protein, 249 aa, Artificial Sequence
  Description of Artificial Sequence: Synthetic polypeptide
  XENP024266 1C11_H3.146_L3_scFv(GKPGS)4
QIQLVQSGSELKKPGASVKVSCKASGYTFTHYGMNWVRQAPGQGLEWMGWINTYTGEPTYAPGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39823 - protein, 117 aa, Artificial Sequence; identical to SEQ ID NO: 34775
  Description of Artificial Sequence: Synthetic polypeptide
  VH of XENP024266

SEQ ID NO: 39824 - protein, 112 aa, Artificial Sequence; identical to SEQ ID NO: 33009
  Description of Artificial Sequence: Synthetic polypeptide
  VL of XENP024266

SEQ ID NO: 39825 - protein, 5 aa, Artificial Sequence
  Description of Artificial Sequence: Synthetic peptide
  XENP024266 vhCDR1
HYGMN

SEQ ID NO: 39826 - protein, 17 aa, Artificial Sequence
  Description of Artificial Sequence: Synthetic peptide
  XENP024266 vhCDR2
WINTYTGEPTYAPGFTG

SEQ ID NO: 39827 - protein, 8 aa, Artificial Sequence
  Description of Artificial Sequence: Synthetic peptide
  XENP024266 vhCDR3
DYYGSSPY

SEQ ID NO: 39828 - protein, 16 aa, Artificial Sequence
  Description of Artificial Sequence: Synthetic peptide
  XENP024266 vlCDR1
KSSQSIVHSNGNTYLE

SEQ ID NO: 39829 - protein, 7 aa, Artificial Sequence
  Description of Artificial Sequence: Synthetic peptide
  XENP024266 vlCDR2
KVSNRFS

SEQ ID NO: 39830 - protein, 9 aa, Artificial Sequence
  Description of Artificial Sequence: Synthetic peptide
  XENP024266 vlCDR3
FQGSHVPNT

SEQ ID NO: 39831 - protein, 249 aa, Artificial Sequence
  Description of Artificial Sequence: Synthetic polypeptide
  XENP024267 1C11_H3.147_L3_scFv(GKPGS)4
QIQLVQSGSELKKPGASVKVSCKASGYTFTHYGMNWVRQAPGQGLEWMGWINTYTGEPTYATGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39832 - protein, 117 aa, Artificial Sequence; identical to SEQ ID NO: 34784
  Description of Artificial Sequence: Synthetic polypeptide
  VH of XENP024267

SEQ ID NO: 39833 - protein, 112 aa, Artificial Sequence; identical to SEQ ID NO: 33009
  Description of Artificial Sequence: Synthetic polypeptide
  VL of XENP024267

SEQ ID NO: 39834 - protein, 5 aa, Artificial Sequence
  Description of Artificial Sequence: Synthetic peptide
  XENP024267 vhCDR1
HYGMN

SEQ ID NO: 39835 - protein, 17 aa, Artificial Sequence
  Description of Artificial Sequence: Synthetic peptide
  XENP024267 vhCDR2
WINTYTGEPTYATGFTG

SEQ ID NO: 39836 - protein, 8 aa, Artificial Sequence
  Description of Artificial Sequence: Synthetic peptide
  XENP024267 vhCDR3
DYYGSSPY

SEQ ID NO: 39837 - protein, 16 aa, Artificial Sequence
  Description of Artificial Sequence: Synthetic peptide
  XENP024267 vlCDR1
KSSQSIVHSNGNTYLE

SEQ ID NO: 39838 - protein, 7 aa, Artificial Sequence
  Description of Artificial Sequence: Synthetic peptide
  XENP024267 vlCDR2
KVSNRFS

SEQ ID NO: 39839 - protein, 9 aa, Artificial Sequence
  Description of Artificial Sequence: Synthetic peptide
  XENP024267 vlCDR3
FQGSHVPNT

SEQ ID NO: 39840 - protein, 249 aa, Artificial Sequence
  Description of Artificial Sequence: Synthetic polypeptide
  XENP024268 1C11_H3.148_L3_scFv(GKPGS)4
QIQLVQSGSELKKPGASVKVSCKASGYTFTHYGMNWVRQAPGQGLEWMGWINTYTGEPTYAQKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39841 - protein, 117 aa, Artificial Sequence; identical to SEQ ID NO: 34793
  Description of Artificial Sequence: Synthetic polypeptide
  VH of XENP024268

SEQ ID NO: 39842 - protein, 112 aa, Artificial Sequence; identical to SEQ ID NO: 33009
  Description of Artificial Sequence: Synthetic polypeptide
  VL of XENP024268

SEQ ID NO: 39843 - protein, 5 aa, Artificial Sequence
  Description of Artificial Sequence: Synthetic peptide
  XENP024268 vhCDR1
HYGMN

SEQ ID NO: 39844 - protein, 17 aa, Artificial Sequence
  Description of Artificial Sequence: Synthetic peptide
  XENP024268 vhCDR2
WINTYTGEPTYAQKFTG

SEQ ID NO: 39845 - protein, 8 aa, Artificial Sequence
  Description of Artificial Sequence: Synthetic peptide
  XENP024268 vhCDR3
DYYGSSPY

SEQ ID NO: 39846 - protein, 16 aa, Artificial Sequence
  Description of Artificial Sequence: Synthetic peptide
  XENP024268 vlCDR1
KSSQSIVHSNGNTYLE

SEQ ID NO: 39847 - protein, 7 aa, Artificial Sequence
  Description of Artificial Sequence: Synthetic peptide
  XENP024268 vlCDR2
KVSNRFS

SEQ ID NO: 39848 - protein, 9 aa, Artificial Sequence
  Description of Artificial Sequence: Synthetic peptide
  XENP024268 vlCDR3
FQGSHVPNT

SEQ ID NO: 39849 - protein, 249 aa, Artificial Sequence
  Description of Artificial Sequence: Synthetic polypeptide
  XENP024270 1C11_H3.150_L3_scFv(GKPGS)4
QIQLVQSGSELKKPGASVKVSCKASGYTFTHYGMNWVRQAPGQGLEWMGWINTYTGEPTYADGFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39850 - protein, 117 aa, Artificial Sequence; identical to SEQ ID NO: 34811
  Description of Artificial Sequence: Synthetic polypeptide
  VH of XENP024270

SEQ ID NO: 39851 - protein, 112 aa, Artificial Sequence; identical to SEQ ID NO: 33009
  Description of Artificial Sequence: Synthetic polypeptide
  VL of XENP024270

SEQ ID NO: 39852 - protein, 5 aa, Artificial Sequence
  Description of Artificial Sequence: Synthetic peptide
  XENP024270 vhCDR1
HYGMN

SEQ ID NO: 39853 - protein, 17 aa, Artificial Sequence
  Description of Artificial Sequence: Synthetic peptide
  XENP024270 vhCDR2
WINTYTGEPTYADGFTE

SEQ ID NO: 39854 - protein, 8 aa, Artificial Sequence
  Description of Artificial Sequence: Synthetic peptide
  XENP024270 vhCDR3
DYYGSSPY

SEQ ID NO: 39855 - protein, 16 aa, Artificial Sequence
  Description of Artificial Sequence: Synthetic peptide
  XENP024270 vlCDR1
KSSQSIVHSNGNTYLE

SEQ ID NO: 39856 - protein, 7 aa, Artificial Sequence
  Description of Artificial Sequence: Synthetic peptide
  XENP024270 vlCDR2
KVSNRFS

SEQ ID NO: 39857 - protein, 9 aa, Artificial Sequence
  Description of Artificial Sequence: Synthetic peptide
  XENP024270 vlCDR3
FQGSHVPNT

SEQ ID NO: 39858 - protein, 249 aa, Artificial Sequence
  Description of Artificial Sequence: Synthetic polypeptide
  XENP024274 1C11_H3.154_L3_scFv(GKPGS)4
QIQLVQSGSELKKPGASVKVSCKASGYTFTHYGMNWVRQAPGQGLEWMGWINTYTGEPTYADGFTGRFVFSIDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39859 - protein, 117 aa, Artificial Sequence; identical to SEQ ID NO: 34847
  Description of Artificial Sequence: Synthetic polypeptide
  VH of XENP024274

SEQ ID NO: 39860 - protein, 112 aa, Artificial Sequence; identical to SEQ ID NO: 33009
  Description of Artificial Sequence: Synthetic polypeptide
  VL of XENP024274

SEQ ID NO: 39861 - protein, 5 aa, Artificial Sequence
  Description of Artificial Sequence: Synthetic peptide
  XENP024274 vhCDR1
HYGMN

SEQ ID NO: 39862 - protein, 17 aa, Artificial Sequence
  Description of Artificial Sequence: Synthetic peptide
  XENP024274 vhCDR2
WINTYTGEPTYADGFTG

SEQ ID NO: 39863 - protein, 8 aa, Artificial Sequence
  Description of Artificial Sequence: Synthetic peptide
  XENP024274 vhCDR3
DYYGSSPY

SEQ ID NO: 39864 - protein, 16 aa, Artificial Sequence
  Description of Artificial Sequence: Synthetic peptide
  XENP024274 vlCDR1
KSSQSIVHSNGNTYLE

SEQ ID NO: 39865 - protein, 7 aa, Artificial Sequence
  Description of Artificial Sequence: Synthetic peptide
  XENP024274 vlCDR2
KVSNRFS

SEQ ID NO: 39866 - protein, 9 aa, Artificial Sequence
  Description of Artificial Sequence: Synthetic peptide
  XENP024274 vlCDR3
FQGSHVPNT

SEQ ID NO: 39867 - protein, 249 aa, Artificial Sequence
  Description of Artificial Sequence: Synthetic polypeptide
  XENP024278 1C11_H3.158_L3_scFv(GKPGS)4
QIQLVQSGSELKKPGASVKVSCKASGYTFTHYGMNWVRQAPGQGLEWMGWINTYTGEPTYADGFTGRFVFSLDTSVNTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39868 - protein, 117 aa, Artificial Sequence; identical to SEQ ID NO: 34883
  Description of Artificial Sequence: Synthetic polypeptide
  VH of XENP024278

SEQ ID NO: 39869 - protein, 112 aa, Artificial Sequence; identical to SEQ ID NO: 33009
  Description of Artificial Sequence: Synthetic polypeptide
  VL of XENP024278

SEQ ID NO: 39870 - protein, 5 aa, Artificial Sequence
  Description of Artificial Sequence: Synthetic peptide
  XENP024278 vhCDR1
HYGMN

SEQ ID NO: 39871 - protein, 17 aa, Artificial Sequence
  Description of Artificial Sequence: Synthetic peptide
  XENP024278 vhCDR2
WINTYTGEPTYADGFTG

SEQ ID NO: 39872 - protein, 8 aa, Artificial Sequence
  Description of Artificial Sequence: Synthetic peptide
  XENP024278 vhCDR3
DYYGSSPY

SEQ ID NO: 39873 - protein, 16 aa, Artificial Sequence
  Description of Artificial Sequence: Synthetic peptide
  XENP024278 vlCDR1
KSSQSIVHSNGNTYLE

SEQ ID NO: 39874 - protein, 7 aa, Artificial Sequence
  Description of Artificial Sequence: Synthetic peptide
  XENP024278 vlCDR2
KVSNRFS

SEQ ID NO: 39875 - protein, 9 aa, Artificial Sequence
  Description of Artificial Sequence: Synthetic peptide
  XENP024278 vlCDR3
FQGSHVPNT

SEQ ID NO: 39876 - protein, 249 aa, Artificial Sequence
  Description of Artificial Sequence: Synthetic polypeptide
  XENP024279 1C11_H3.159_L3_scFv(GKPGS)4
QIQLVQSGSELKKPGASVKVSCKASGYTFTHYGMNWVRQAPGQGLEWMGWINTYTGEPTYADGFTGRFVFSLDTSVDTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39877 - protein, 117 aa, Artificial Sequence; identical to SEQ ID NO: 34892
  Description of Artificial Sequence: Synthetic polypeptide
  VH of XENP024279

SEQ ID NO: 39878 - protein, 112 aa, Artificial Sequence; identical to SEQ ID NO: 33009
  Description of Artificial Sequence: Synthetic polypeptide
  VL of XENP024279

SEQ ID NO: 39879 - protein, 5 aa, Artificial Sequence
  Description of Artificial Sequence: Synthetic peptide
  XENP024279 vhCDR1
HYGMN

SEQ ID NO: 39880 - protein, 17 aa, Artificial Sequence
  Description of Artificial Sequence: Synthetic peptide
  XENP024279 vhCDR2
WINTYTGEPTYADGFTG

SEQ ID NO: 39881 - protein, 8 aa, Artificial Sequence
  Description of Artificial Sequence: Synthetic peptide
  XENP024279 vhCDR3
DYYGSSPY

SEQ ID NO: 39882 - protein, 16 aa, Artificial Sequence
  Description of Artificial Sequence: Synthetic peptide
  XENP024279 vlCDR1
KSSQSIVHSNGNTYLE

SEQ ID NO: 39883 - protein, 7 aa, Artificial Sequence
  Description of Artificial Sequence: Synthetic peptide
  XENP024279 vlCDR2
KVSNRFS

SEQ ID NO: 39884 - protein, 9 aa, Artificial Sequence
  Description of Artificial Sequence: Synthetic peptide
  XENP024279 vlCDR3
FQGSHVPNT

SEQ ID NO: 39885 - protein, 249 aa, Artificial Sequence
  Description of Artificial Sequence: Synthetic polypeptide
  XENP024287 1C11_H3.168_L3_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39886 - protein, 117 aa, Artificial Sequence; identical to SEQ ID NO: 34964
  Description of Artificial Sequence: Synthetic polypeptide
  VH of XENP024287

SEQ ID NO: 39887 - protein, 112 aa, Artificial Sequence; identical to SEQ ID NO: 33009
  Description of Artificial Sequence: Synthetic polypeptide
  VL of XENP024287

SEQ ID NO: 39888 - protein, 5 aa, Artificial Sequence
  Description of Artificial Sequence: Synthetic peptide
  XENP024287 vhCDR1
HYGMN

SEQ ID NO: 39889 - protein, 17 aa, Artificial Sequence
  Description of Artificial Sequence: Synthetic peptide
  XENP024287 vhCDR2
WINTYTGEPTYADGFTG

SEQ ID NO: 39890 - protein, 8 aa, Artificial Sequence
  Description of Artificial Sequence: Synthetic peptide
  XENP024287 vhCDR3
DYYGSSPY

SEQ ID NO: 39891 - protein, 16 aa, Artificial Sequence
  Description of Artificial Sequence: Synthetic peptide
  XENP024287 vlCDR1
KSSQSIVHSNGNTYLE

SEQ ID NO: 39892 - protein, 7 aa, Artificial Sequence
  Description of Artificial Sequence: Synthetic peptide
  XENP024287 vlCDR2
KVSNRFS

SEQ ID NO: 39893 - protein, 9 aa, Artificial Sequence
  Description of Artificial Sequence: Synthetic peptide
  XENP024287 vlCDR3
FQGSHVPNT

SEQ ID NO: 39894 - protein, 249 aa, Artificial Sequence
  Description of Artificial Sequence: Synthetic polypeptide
  XENP024291 1C11_H3.172_L3_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKPEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39895 - protein, 117 aa, Artificial Sequence; identical to SEQ ID NO: 35000
  Description of Artificial Sequence: Synthetic polypeptide
  VH of XENP024291

SEQ ID NO: 39896 - protein, 112 aa, Artificial Sequence; identical to SEQ ID NO: 33009
  Description of Artificial Sequence: Synthetic polypeptide
  VL of XENP024291

SEQ ID NO: 39897 - protein, 5 aa, Artificial Sequence
  Description of Artificial Sequence: Synthetic peptide
  XENP024291 vhCDR1
HYGMN

SEQ ID NO: 39898 - protein, 17 aa, Artificial Sequence
  Description of Artificial Sequence: Synthetic peptide
  XENP024291 vhCDR2
WINTYTGEPTYADGFTG

SEQ ID NO: 39899 - protein, 8 aa, Artificial Sequence
  Description of Artificial Sequence: Synthetic peptide
  XENP024291 vhCDR3
DYYGSSPY

SEQ ID NO: 39900 - protein, 16 aa, Artificial Sequence
  Description of Artificial Sequence: Synthetic peptide
  XENP024291 vlCDR1
KSSQSIVHSNGNTYLE

SEQ ID NO: 39901 - protein, 7 aa, Artificial Sequence
  Description of Artificial Sequence: Synthetic peptide
  XENP024291 vlCDR2
KVSNRFS

SEQ ID NO: 39902 - protein, 9 aa, Artificial Sequence
  Description of Artificial Sequence: Synthetic peptide
  XENP024291 vlCDR3
FQGSHVPNT

SEQ ID NO: 39903 - protein, 249 aa, Artificial Sequence
  Description of Artificial Sequence: Synthetic polypeptide
  XENP024372 1C11_H3_L3.86_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFTGVPDRFSGSGSGTDFTLTISSVQAEDVATYYCFQGSHVPNTFGQGTKVEIK

SEQ ID NO: 39904 - protein, 117 aa, Artificial Sequence; identical to SEQ ID NO: 33034
  Description of Artificial Sequence: Synthetic polypeptide
  VH of XENP024372

SEQ ID NO: 39905 - protein, 112 aa, Artificial Sequence
  Description of Artificial Sequence: Synthetic polypeptide
  VL of XENP024372
DVLMTQSPDSLAVSLGERATINCKSSQSIVHSNGNTYLEWYQQKPGQSPKLLIYKVSNRFTGVPDRFSGSGSGTDFTLTISSVQAEDVATYYCFQGSHVPNTFGQGTKVEIK

SEQ ID NO: 39906 - protein, 5 aa, Artificial Sequence
  Description of Artificial Sequence: Synthetic peptide
  XENP024372 vhCDR1
HYGMN

SEQ ID NO: 39907 - protein, 17 aa, Artificial Sequence
  Description of Artificial Sequence: Synthetic peptide
  XENP024372 vhCDR2
WINTYTGEPTYADGFTG

SEQ ID NO: 39908 - protein, 8 aa, Artificial Sequence
  Description of Artificial Sequence: Synthetic peptide
  XENP024372 vhCDR3
DYYGSSPY

SEQ ID NO: 39909 - protein, 16 aa, Artificial Sequence
  Description of Artificial Sequence: Synthetic peptide
  XENP024372 vlCDR1
KSSQSIVHSNGNTYLE

SEQ ID NO: 39910 - protein, 7 aa, Artificial Sequence
  Description of Artificial Sequence: Synthetic peptide
  XENP024372 vlCDR2
KVSNRFT

SEQ ID NO: 39911 - protein, 9 aa, Artificial Sequence
  Description of Artificial Sequence: Synthetic peptide
  XENP024372 vlCDR3
FQGSHVPNT

SEQ ID NO: 39912 - protein, 249 aa, Artificial Sequence
  Description of Artificial Sequence: Synthetic polypeptide
  XENP024373 1C11_H3_L3.87_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSLQAEDVAVYYCFQGSHVPNTFGGGTKVEIK

SEQ ID NO: 39913 - protein, 117 aa, Artificial Sequence; identical to SEQ ID NO: 33034
  Description of Artificial Sequence: Synthetic polypeptide
  VH of XENP024373

SEQ ID NO: 39914 - protein, 112 aa, Artificial Sequence
  Description of Artificial Sequence: Synthetic polypeptide
  VL of XENP024373
DVVMTQSPDSLAVSLGERVTINCKASQSIVHSNGNTYLEWYQQKPGQPPKLLIYKVSNRFSGVPDRFSGSGSGTDFTLTISSLQAEDVAVYYCFQGSHVPNTFGGGTKVEIK

SEQ ID NO: 39915 - protein, 5 aa, Artificial Sequence
  Description of Artificial Sequence: Synthetic peptide
  XENP024373 vhCDR1
HYGMN

SEQ ID NO: 39916 - protein, 17 aa, Artificial Sequence
  Description of Artificial Sequence: Synthetic peptide
  XENP024373 vhCDR2
WINTYTGEPTYADGFTG

SEQ ID NO: 39917 - protein, 8 aa, Artificial Sequence
  Description of Artificial Sequence: Synthetic peptide
  XENP024373 vhCDR3
DYYGSSPY

SEQ ID NO: 39918 - protein, 16 aa, Artificial Sequence
  Description of Artificial Sequence: Synthetic peptide
  XENP024373 vlCDR1
KASQSIVHSNGNTYLE

SEQ ID NO: 39919 - protein, 7 aa, Artificial Sequence
  Description of Artificial Sequence: Synthetic peptide
  XENP024373 vlCDR2
KVSNRFS

SEQ ID NO: 39920 - protein, 9 aa, Artificial Sequence
  Description of Artificial Sequence: Synthetic peptide
  XENP024373 vlCDR3
FQGSHVPNT

SEQ ID NO: 39921 - protein, 249 aa, Artificial Sequence
  Description of Artificial Sequence: Synthetic polypeptide
  XENP024374 1C11_H3_L3.90_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGVPDRFSGSGSGTDFTLTISSVQAEDAATYYCFQGSHVPNTFGQGTKVEIK

SEQ ID NO: 39922 - protein, 117 aa, Artificial Sequence; identical to SEQ ID NO: 33034
  Description of Artificial Sequence: Synthetic polypeptide
  VH of XENP024374

SEQ ID NO: 39923 - protein, 112 aa, Artificial Sequence
  Description of Artificial Sequence: Synthetic polypeptide
  VL of XENP024374
DVVMTQSPDSLAVSLGERATINCKASQSIVHSNGNTYLEWYQQKPGQPPKLLIYKVSNRFSGVPDRFSGSGSGTDFTLTISSVQAEDAATYYCFQGSHVPNTFGQGTKVEIK

SEQ ID NO: 39924 - protein, 5 aa, Artificial Sequence
  Description of Artificial Sequence: Synthetic peptide
  XENP024374 vhCDR1
HYGMN

SEQ ID NO: 39925 - protein, 17 aa, Artificial Sequence
  Description of Artificial Sequence: Synthetic peptide
  XENP024374 vhCDR2
WINTYTGEPTYADGFTG

SEQ ID NO: 39926 - protein, 8 aa, Artificial Sequence
  Description of Artificial Sequence: Synthetic peptide
  XENP024374 vhCDR3
DYYGSSPY

SEQ ID NO: 39927 - protein, 16 aa, Artificial Sequence
  Description of Artificial Sequence: Synthetic peptide
  XENP024374 vlCDR1
KASQSIVHSNGNTYLE

SEQ ID NO: 39928 - protein, 7 aa, Artificial Sequence
  Description of Artificial Sequence: Synthetic peptide
  XENP024374 vlCDR2
KVSNRFS

SEQ ID NO: 39929 - protein, 9 aa, Artificial Sequence
  Description of Artificial Sequence: Synthetic peptide
  XENP024374 vlCDR3
FQGSHVPNT

SEQ ID NO: 39930 - protein, 249 aa, Artificial Sequence
  Description of Artificial Sequence: Synthetic polypeptide
  XENP024375 1C11_H3_L3.92_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 39931 - protein, 117 aa, Artificial Sequence; identical to SEQ ID NO: 33034
  Description of Artificial Sequence: Synthetic polypeptide
  VH of XENP024375

SEQ ID NO: 39932 - protein, 112 aa, Artificial Sequence
  Description of Artificial Sequence: Synthetic polypeptide
  VL of XENP024375
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 39933 - protein, 5 aa, Artificial Sequence
  Description of Artificial Sequence: Synthetic peptide
  XENP024375 vhCDR1
HYGMN

SEQ ID NO: 39934 - protein, 17 aa, Artificial Sequence
  Description of Artificial Sequence: Synthetic peptide
  XENP024375 vhCDR2
WINTYTGEPTYADGFTG

SEQ ID NO: 39935 - protein, 8 aa, Artificial Sequence
  Description of Artificial Sequence: Synthetic peptide
  XENP024375 vhCDR3
DYYGSSPY

SEQ ID NO: 39936 - protein, 16 aa, Artificial Sequence
  Description of Artificial Sequence: Synthetic peptide
  XENP024375 vlCDR1
KASQSIVHSNGNTYLE

SEQ ID NO: 39937 - protein, 7 aa, Artificial Sequence
  Description of Artificial Sequence: Synthetic peptide
  XENP024375 vlCDR2
KVSNRFT

SEQ ID NO: 39938 - protein, 9 aa, Artificial Sequence
  Description of Artificial Sequence: Synthetic peptide
  XENP024375 vlCDR3
FQGSHVPNT

SEQ ID NO: 39939 - protein, 249 aa, Artificial Sequence
  Description of Artificial Sequence: Synthetic polypeptide
  XENP024376 1C11_H3_L3.94_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIK

SEQ ID NO: 39940 - protein, 117 aa, Artificial Sequence; identical to SEQ ID NO: 33034
  Description of Artificial Sequence: Synthetic polypeptide
  VH of XENP024376

SEQ ID NO: 39941 - protein, 112 aa, Artificial Sequence
  Description of Artificial Sequence: Synthetic polypeptide
  VL of XENP024376
DILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIK

SEQ ID NO: 39942 - protein, 5 aa, Artificial Sequence
  Description of Artificial Sequence: Synthetic peptide
  XENP024376 vhCDR1
HYGMN

SEQ ID NO: 39943 - protein, 17 aa, Artificial Sequence
  Description of Artificial Sequence: Synthetic peptide
  XENP024376 vhCDR2
WINTYTGEPTYADGFTG

SEQ ID NO: 39944 - protein, 8 aa, Artificial Sequence
  Description of Artificial Sequence: Synthetic peptide
  XENP024376 vhCDR3
DYYGSSPY

SEQ ID NO: 39945 - protein, 16 aa, Artificial Sequence
  Description of Artificial Sequence: Synthetic peptide
  XENP024376 vlCDR1
KSSQSIVHSNGNTYLE

SEQ ID NO: 39946 - protein, 7 aa, Artificial Sequence
  Description of Artificial Sequence: Synthetic peptide
  XENP024376 vlCDR2
KVSNRFT

SEQ ID NO: 39947 - protein, 9 aa, Artificial Sequence
  Description of Artificial Sequence: Synthetic peptide
  XENP024376 vlCDR3
FQGSHVPNT

SEQ ID NO: 39948 - protein, 249 aa, Artificial Sequence
  Description of Artificial Sequence: Synthetic polypeptide
  XENP024377 1C11_H3_L3.96_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIK

SEQ ID NO: 39949 - protein, 117 aa, Artificial Sequence; identical to SEQ ID NO: 33034
  Description of Artificial Sequence: Synthetic polypeptide
  VH of XENP024377

SEQ ID NO: 39950 - protein, 112 aa, Artificial Sequence
  Description of Artificial Sequence: Synthetic polypeptide
  VL of XENP024377
DIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIK

SEQ ID NO: 39951 - protein, 5 aa, Artificial Sequence
  Description of Artificial Sequence: Synthetic peptide
  XENP024377 vhCDR1
HYGMN

SEQ ID NO: 39952 - protein, 17 aa, Artificial Sequence
  Description of Artificial Sequence: Synthetic peptide
  XENP024377 vhCDR2
WINTYTGEPTYADGFTG

SEQ ID NO: 39953 - protein, 8 aa, Artificial Sequence
  Description of Artificial Sequence: Synthetic peptide
  XENP024377 vhCDR3
DYYGSSPY

SEQ ID NO: 39954 - protein, 16 aa, Artificial Sequence
  Description of Artificial Sequence: Synthetic peptide
  XENP024377 vlCDR1
KASQSIVHSNGNTYLE

SEQ ID NO: 39955 - protein, 7 aa, Artificial Sequence
  Description of Artificial Sequence: Synthetic peptide
  XENP024377 vlCDR2
KVSNRFT

SEQ ID NO: 39956 - protein, 9 aa, Artificial Sequence
  Description of Artificial Sequence: Synthetic peptide
  XENP024377 vlCDR3
FQGSHVPNT

SEQ ID NO: 39957 - protein, 249 aa, Artificial Sequence
  Description of Artificial Sequence: Synthetic polypeptide
  XENP024378 1C11_H3_L3.105_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLPVTPGEPATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39958 - protein, 117 aa, Artificial Sequence; identical to SEQ ID NO: 33034
  Description of Artificial Sequence: Synthetic polypeptide
  VH of XENP024378

SEQ ID NO: 39959 - protein, 112 aa, Artificial Sequence
  Description of Artificial Sequence: Synthetic polypeptide
  VL of XENP024378
DVLMTQSPDSLPVTPGEPATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 39960 - protein, 5 aa, Artificial Sequence
  Description of Artificial Sequence: Synthetic peptide
  XENP024378 vhCDR1
HYGMN

SEQ ID NO: 39961 - protein, 17 aa, Artificial Sequence
  Description of Artificial Sequence: Synthetic peptide
  XENP024378 vhCDR2
WINTYTGEPTYADGFTG

SEQ ID NO: 39962 - protein, 8 aa, Artificial Sequence
  Description of Artificial Sequence: Synthetic peptide
  XENP024378 vhCDR3
DYYGSSPY

SEQ ID NO: 39963 - protein, 16 aa, Artificial Sequence
  Description of Artificial Sequence: Synthetic peptide
  XENP024378 vlCDR1
KSSQSIVHSNGNTYLE

SEQ ID NO: 39964 - protein, 7 aa, Artificial Sequence
  Description of Artificial Sequence: Synthetic peptide
  XENP024378 vlCDR2
KVSNRFS

SEQ ID NO: 39965 - protein, 9 aa, Artificial Sequence
  Description of Artificial Sequence: Synthetic peptide
  XENP024378 vlCDR3
FQGSHVPNT

SEQ ID NO: 39966 - protein, 249 aa, Artificial Sequence
  Description of Artificial Sequence: Synthetic polypeptide
  XENP024379 1C11_H3_L3.129_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTINSLQAEDAATYYCHQGSHVPNTFGGGTKVEIK

SEQ ID NO: 39967 - protein, 117 aa, Artificial Sequence; identical to SEQ ID NO: 33034
  Description of Artificial Sequence: Synthetic polypeptide
  VH of XENP024379

SEQ ID NO: 39968 - protein, 112 aa, Artificial Sequence
  Description of Artificial Sequence: Synthetic polypeptide
  VL of XENP024379
DVLMTQSPDSLAVSLGERATINCKSSQSIVHSNGNTYLEWYQQKPGQSPKLLIYKVSNRFSGVPDRFSGSGSGTDFTLTINSLQAEDAATYYCHQGSHVPNTFGGGTKVEIK

SEQ ID NO: 39969 - protein, 5 aa, Artificial Sequence
  Description of Artificial Sequence: Synthetic peptide
  XENP024379 vhCDR1
HYGMN

SEQ ID NO: 39970 - protein, 17 aa, Artificial Sequence
  Description of Artificial Sequence: Synthetic peptide
  XENP024379 vhCDR2
WINTYTGEPTYADGFTG

SEQ ID NO: 39971 - protein, 8 aa, Artificial Sequence
  Description of Artificial Sequence: Synthetic peptide
  XENP024379 vhCDR3
DYYGSSPY

SEQ ID NO: 39972 - protein, 16 aa, Artificial Sequence
  Description of Artificial Sequence: Synthetic peptide
  XENP024379 vlCDR1
KSSQSIVHSNGNTYLE

SEQ ID NO: 39973 - protein, 7 aa, Artificial Sequence
  Description of Artificial Sequence: Synthetic peptide
  XENP024379 vlCDR2
KVSNRFS

SEQ ID NO: 39974 - protein, 9 aa, Artificial Sequence
  Description of Artificial Sequence: Synthetic peptide
  XENP024379 vlCDR3
HQGSHVPNT

SEQ ID NO: 39975 - protein, 249 aa, Artificial Sequence
  Description of Artificial Sequence: Synthetic polypeptide
  XENP024380 1C11_H3.176_L3.92_scFv(GKPGS)4
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 39976 - protein, 117 aa, Artificial Sequence; identical to SEQ ID NO: 35099
  Description of Artificial Sequence: Synthetic polypeptide
  VH of XENP024380

SEQ ID NO: 39977 - protein, 112 aa, Artificial Sequence; identical to SEQ ID NO: 39932
  Description of Artificial Sequence: Synthetic polypeptide
  VL of XENP024380

SEQ ID NO: 39978 - protein, 5 aa, Artificial Sequence
  Description of Artificial Sequence: Synthetic peptide
  XENP024380 vhCDR1
HYGMN

SEQ ID NO: 39979 - protein, 17 aa, Artificial Sequence
  Description of Artificial Sequence: Synthetic peptide
  XENP024380 vhCDR2
WINTNTGEPTYADKFTG

SEQ ID NO: 39980 - protein, 8 aa, Artificial Sequence
  Description of Artificial Sequence: Synthetic peptide
  XENP024380 vhCDR3
DYYGSSPY

SEQ ID NO: 39981 - protein, 16 aa, Artificial Sequence
  Description of Artificial Sequence: Synthetic peptide
  XENP024380 vlCDR1
KASQSIVHSNGNTYLE

SEQ ID NO: 39982 - protein, 7 aa, Artificial Sequence
  Description of Artificial Sequence: Synthetic peptide
  XENP024380 vlCDR2
KVSNRFT

SEQ ID NO: 39983 - protein, 9 aa, Artificial Sequence
  Description of Artificial Sequence: Synthetic peptide
  XENP024380 vlCDR3
FQGSHVPNT

SEQ ID NO: 39984 - protein, 249 aa, Artificial Sequence
  Description of Artificial Sequence: Synthetic polypeptide
  XENP024381 1C11_H3.176_L3.94_scFv(GKPGS)4
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIK

SEQ ID NO: 39985 - protein, 117 aa, Artificial Sequence; identical to SEQ ID NO: 35099
  Description of Artificial Sequence: Synthetic polypeptide
  VH of XENP024381

SEQ ID NO: 39986 - protein, 112 aa, Artificial Sequence; identical to SEQ ID NO: 39941
  Description of Artificial Sequence: Synthetic polypeptide
  VL of XENP024381

SEQ ID NO: 39987 - protein, 5 aa, Artificial Sequence
  Description of Artificial Sequence: Synthetic peptide
  XENP024381 vhCDR1
HYGMN

SEQ ID NO: 39988 - protein, 17 aa, Artificial Sequence
  Description of Artificial Sequence: Synthetic peptide
  XENP024381 vhCDR2
WINTNTGEPTYADKFTG

SEQ ID NO: 39989 - protein, 8 aa, Artificial Sequence
  Description of Artificial Sequence: Synthetic peptide
  XENP024381 vhCDR3
DYYGSSPY

SEQ ID NO: 39990 - protein, 16 aa, Artificial Sequence
  Description of Artificial Sequence: Synthetic peptide
  XENP024381 vlCDR1
KSSQSIVHSNGNTYLE

SEQ ID NO: 39991 - protein, 7 aa, Artificial Sequence
  Description of Artificial Sequence: Synthetic peptide
  XENP024381 vlCDR2
KVSNRFT

SEQ ID NO: 39992 - protein, 9 aa, Artificial Sequence
  Description of Artificial Sequence: Synthetic peptide
  XENP024381 vlCDR3
FQGSHVPNT

SEQ ID NO: 39993 - protein, 249 aa, Artificial Sequence
  Description of Artificial Sequence: Synthetic polypeptide
  XENP024382 1C11_H3.176_L3.96_scFv(GKPGS)4
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIK

SEQ ID NO: 39994 - protein, 117 aa, Artificial Sequence; identical to SEQ ID NO: 35099
  Description of Artificial Sequence: Synthetic polypeptide
  VH of XENP024382

SEQ ID NO: 39995 - protein, 112 aa, Artificial Sequence; identical to SEQ ID NO: 39950
  Description of Artificial Sequence: Synthetic polypeptide
  VL of XENP024382

SEQ ID NO: 39996 - protein, 5 aa, Artificial Sequence
  Description of Artificial Sequence: Synthetic peptide
  XENP024382 vhCDR1
HYGMN

SEQ ID NO: 39997 - protein, 17 aa, Artificial Sequence
  Description of Artificial Sequence: Synthetic peptide
  XENP024382 vhCDR2
WINTNTGEPTYADKFTG

SEQ ID NO: 39998 - protein, 8 aa, Artificial Sequence
  Description of Artificial Sequence: Synthetic peptide
  XENP024382 vhCDR3
DYYGSSPY

SEQ ID NO: 39999 - protein, 16 aa, Artificial Sequence
  Description of Artificial Sequence: Synthetic peptide
  XENP024382 vlCDR1
KASQSIVHSNGNTYLE

SEQ ID NO: 40000 - protein, 7 aa, Artificial Sequence
  Description of Artificial Sequence: Synthetic peptide
  XENP024382 vlCDR2
KVSNRFT

SEQ ID NO: 40001 - protein, 9 aa, Artificial Sequence
  Description of Artificial Sequence: Synthetic peptide
  XENP024382 vlCDR3
FQGSHVPNT

SEQ ID NO: 40002 - protein, 249 aa, Artificial Sequence
  Description of Artificial Sequence: Synthetic polypeptide
  XENP024414 1C11[PD-1]_H3_L3.133_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSVQAEDAATYYCFQGSHVPNTFGQGTKVEIK

SEQ ID NO: 40003 - protein, 117 aa, Artificial Sequence; identical to SEQ ID NO: 33034
  Description of Artificial Sequence: Synthetic polypeptide
  VH of XENP024414

SEQ ID NO: 40004 - protein, 112 aa, Artificial Sequence
  Description of Artificial Sequence: Synthetic polypeptide
  VL of XENP024414
DVVMTQSPDSLAVSLGERVTINCKASQSIVHSNGNTYLEWYQQKPGQPPKLLIYKVSNRFSGVPDRFSGSGSGTDFTLTISSVQAEDAATYYCFQGSHVPNTFGQGTKVEIK

SEQ ID NO: 40005 - protein, 5 aa, Artificial Sequence
  Description of Artificial Sequence: Synthetic peptide
  XENP024414 vhCDR1
HYGMN

SEQ ID NO: 40006 - protein, 17 aa, Artificial Sequence
  Description of Artificial Sequence: Synthetic peptide
  XENP024414 vhCDR2
WINTYTGEPTYADGFTG

SEQ ID NO: 40007 - protein, 8 aa, Artificial Sequence
  Description of Artificial Sequence: Synthetic peptide
  XENP024414 vhCDR3
DYYGSSPY

SEQ ID NO: 40008 - protein, 16 aa, Artificial Sequence
  Description of Artificial Sequence: Synthetic peptide
  XENP024414 vlCDR1
KASQSIVHSNGNTYLE

SEQ ID NO: 40009 - protein, 7 aa, Artificial Sequence
  Description of Artificial Sequence: Synthetic peptide
  XENP024414 vlCDR2
KVSNRFS

SEQ ID NO: 40010 - protein, 9 aa, Artificial Sequence
  Description of Artificial Sequence: Synthetic peptide
  XENP024414 vlCDR3
FQGSHVPNT

SEQ ID NO: 40011 - protein, 249 aa, Artificial Sequence
  Description of Artificial Sequence: Synthetic polypeptide
  XENP024415 1C11[PD-1]_H3_L3.134_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40012 - protein, 117 aa, Artificial Sequence; identical to SEQ ID NO: 33034
  Description of Artificial Sequence: Synthetic polypeptide
  VH of XENP024415

SEQ ID NO: 40013 - protein, 112 aa, Artificial Sequence
  Description of Artificial Sequence: Synthetic polypeptide
  VL of XENP024415
DVVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40014 - protein, 5 aa, Artificial Sequence
  Description of Artificial Sequence: Synthetic peptide
  XENP024415 vhCDR1
HYGMN

SEQ ID NO: 40015 - protein, 17 aa, Artificial Sequence
  Description of Artificial Sequence: Synthetic peptide
  XENP024415 vhCDR2
WINTYTGEPTYADGFTG

SEQ ID NO: 40016 - protein, 8 aa, Artificial Sequence
  Description of Artificial Sequence: Synthetic peptide
  XENP024415 vhCDR3
DYYGSSPY

SEQ ID NO: 40017 - protein, 16 aa, Artificial Sequence
  Description of Artificial Sequence: Synthetic peptide
  XENP024415 vlCDR1
KASQSIVHSNGNTYLE

SEQ ID NO: 40018 - protein, 7 aa, Artificial Sequence
  Description of Artificial Sequence: Synthetic peptide
  XENP024415 vlCDR2
KVSNRFS

SEQ ID NO: 40019 - protein, 9 aa, Artificial Sequence
  Description of Artificial Sequence: Synthetic peptide
  XENP024415 vlCDR3
FQGSHVPNT

SEQ ID NO: 40020 - protein, 249 aa, Artificial Sequence
  Description of Artificial Sequence: Synthetic polypeptide
  XENP024416 1C11[PD-1]_H3_L3.135_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSMQAEDAATYYCFQGSHVPNTFGQGTKVEIK

SEQ ID NO: 40021 - protein, 117 aa, Artificial Sequence; identical to SEQ ID NO: 33034
  Description of Artificial Sequence: Synthetic polypeptide
  VH of XENP024416

SEQ ID NO: 40022 - protein, 112 aa, Artificial Sequence
  Description of Artificial Sequence: Synthetic polypeptide
  VL of XENP024416
DVVMTQSPDSLAVSLGERVTINCKASQSIVHSNGNTYLEWYQQKPGQPPKLLIYKVSNRFSGVPDRFSGSGSGTDFTLTISSMQAEDAATYYCFQGSHVPNTFGQGTKVEIK

SEQ ID NO: 40023 - protein, 5 aa, Artificial Sequence
  Description of Artificial Sequence: Synthetic peptide
  XENP024416 vhCDR1
HYGMN

SEQ ID NO: 40024 - protein, 17 aa, Artificial Sequence
  Description of Artificial Sequence: Synthetic peptide
  XENP024416 vhCDR2
WINTYTGEPTYADGFTG

SEQ ID NO: 40025 - protein, 8 aa, Artificial Sequence
  Description of Artificial Sequence: Synthetic peptide
  XENP024416 vhCDR3
DYYGSSPY

SEQ ID NO: 40026 - protein, 16 aa, Artificial Sequence
  Description of Artificial Sequence: Synthetic peptide
  XENP024416 vlCDR1
KASQSIVHSNGNTYLE

SEQ ID NO: 40027 - protein, 7 aa, Artificial Sequence
  Description of Artificial Sequence: Synthetic peptide
  XENP024416 vlCDR2
KVSNRFS

SEQ ID NO: 40028 - protein, 9 aa, Artificial Sequence
  Description of Artificial Sequence: Synthetic peptide
  XENP024416 vlCDR3
FQGSHVPNT

SEQ ID NO: 40029 - protein, 249 aa, Artificial Sequence
  Description of Artificial Sequence: Synthetic polypeptide
  XENP024417 1C11[PD-1]_H3_L3.136_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSMQAEDAATYYCFQGSHVPNTFGQGTKVEIK

SEQ ID NO: 40030 - protein, 117 aa, Artificial Sequence; identical to SEQ ID NO: 33034
  Description of Artificial Sequence: Synthetic polypeptide
  VH of XENP024417

SEQ ID NO: 40031 - protein, 112 aa, Artificial Sequence
  Description of Artificial Sequence: Synthetic polypeptide
  VL of XENP024417
DVVMTQSPDSLAVSLGERITINCKASQSIVHSNGNTYLEWYQQKPGQPPKLLIYKVSNRFSGVPDRFSGSGSGTDFTLTISSMQAEDAATYYCFQGSHVPNTFGQGTKVEIK

SEQ ID NO: 40032 - protein, 5 aa, Artificial Sequence
  Description of Artificial Sequence: Synthetic peptide
  XENP024417 vhCDR1
HYGMN

SEQ ID NO: 40033 - protein, 17 aa, Artificial Sequence
  Description of Artificial Sequence: Synthetic peptide
  XENP024417 vhCDR2
WINTYTGEPTYADGFTG

SEQ ID NO: 40034 - protein, 8 aa, Artificial Sequence
  Description of Artificial Sequence: Synthetic peptide
  XENP024417 vhCDR3
DYYGSSPY

SEQ ID NO: 40035 - protein, 16 aa, Artificial Sequence
  Description of Artificial Sequence: Synthetic peptide
  XENP024417 vlCDR1
KASQSIVHSNGNTYLE

SEQ ID NO: 40036 - protein, 7 aa, Artificial Sequence
  Description of Artificial Sequence: Synthetic peptide
  XENP024417 vlCDR2
KVSNRFS

SEQ ID NO: 40037 - protein, 9 aa, Artificial Sequence
  Description of Artificial Sequence: Synthetic peptide
  XENP024417 vlCDR3
FQGSHVPNT

SEQ ID NO: 40038 - protein, 249 aa, Artificial Sequence
  Description of Artificial Sequence: Synthetic polypeptide
  XENP024418 1C11[PD-1]_H3_L3.137_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSVQAEDAATYYCFQGSHVPNTFGQGTKVEIK

SEQ ID NO: 40039 - protein, 117 aa, Artificial Sequence; identical to SEQ ID NO: 33034
  Description of Artificial Sequence: Synthetic polypeptide
  VH of XENP024418

SEQ ID NO: 40040 - protein, 112 aa, Artificial Sequence
  Description of Artificial Sequence: Synthetic polypeptide
  VL of XENP024418
DVVMTQSPDSLAVSLGERITINCKASQSIVHSNGNTYLEWYQQKPGQPPKLLIYKVSNRFSGVPDRFSGSGSGTDFTLTISSVQAEDAATYYCFQGSHVPNTFGQGTKVEIK

SEQ ID NO: 40041 - protein, 5 aa, Artificial Sequence
  Description of Artificial Sequence: Synthetic peptide
  XENP024418 vhCDR1
HYGMN

SEQ ID NO: 40042 - protein, 17 aa, Artificial Sequence
  Description of Artificial Sequence: Synthetic peptide
  XENP024418 vhCDR2
WINTYTGEPTYADGFTG

SEQ ID NO: 40043 - protein, 8 aa, Artificial Sequence
  Description of Artificial Sequence: Synthetic peptide
  XENP024418 vhCDR3
DYYGSSPY

SEQ ID NO: 40044 - protein, 16 aa, Artificial Sequence
  Description of Artificial Sequence: Synthetic peptide
  XENP024418 vlCDR1
KASQSIVHSNGNTYLE

SEQ ID NO: 40045 - protein, 7 aa, Artificial Sequence
  Description of Artificial Sequence: Synthetic peptide
  XENP024418 vlCDR2
KVSNRFS

SEQ ID NO: 40046 - protein, 9 aa, Artificial Sequence
  Description of Artificial Sequence: Synthetic peptide
  XENP024418 vlCDR3
FQGSHVPNT

SEQ ID NO: 40047 - protein, 249 aa, Artificial Sequence
  Description of Artificial Sequence: Synthetic polypeptide
  XENP024419 1C11[PD-1]_H3_L3.138_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40048 - protein, 117 aa, Artificial Sequence; identical to SEQ ID NO: 33034
  Description of Artificial Sequence: Synthetic polypeptide
  VH of XENP024419

SEQ ID NO: 40049 - protein, 112 aa, Artificial Sequence
  Description of Artificial Sequence: Synthetic polypeptide
  VL of XENP024419
DVVMTQSPDSLAVSLGERITINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40050 - protein, 5 aa, Artificial Sequence
  Description of Artificial Sequence: Synthetic peptide
  XENP024419 vhCDR1
HYGMN

SEQ ID NO: 40051 - protein, 17 aa, Artificial Sequence
  Description of Artificial Sequence: Synthetic peptide
  XENP024419 vhCDR2
WINTYTGEPTYADGFTG

SEQ ID NO: 40052 - protein, 8 aa, Artificial Sequence
  Description of Artificial Sequence: Synthetic peptide
  XENP024419 vhCDR3
DYYGSSPY

SEQ ID NO: 40053 - protein, 16 aa, Artificial Sequence
  Description of Artificial Sequence: Synthetic peptide
  XENP024419 vlCDR1
KASQSIVHSNGNTYLE

SEQ ID NO: 40054 - protein, 7 aa, Artificial Sequence
  Description of Artificial Sequence: Synthetic peptide
  XENP024419 vlCDR2
KVSNRFS

SEQ ID NO: 40055 - protein, 9 aa, Artificial Sequence
  Description of Artificial Sequence: Synthetic peptide
  XENP024419 vlCDR3
FQGSHVPNT

SEQ ID NO: 40056 - protein, 249 aa, Artificial Sequence
  Description of Artificial Sequence: Synthetic polypeptide
  XENP024420 1C11[PD-1]_H3_L3.139_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGIPDRFSGSGSGTDFTLTISSVQAEDAATYYCFQGSHVPNTFGQGTKVEIK

SEQ ID NO: 40057 - protein, 117 aa, Artificial Sequence; identical to SEQ ID NO: 33034
  Description of Artificial Sequence: Synthetic polypeptide
  VH of XENP024420

SEQ ID NO: 40058 - protein, 112 aa, Artificial Sequence
  Description of Artificial Sequence: Synthetic polypeptide
  VL of XENP024420
DVVMTQSPDSLAVSLGERATINCKASQSIVHSNGNTYLEWYQQKPGQPPKLLIYKVSNRFSGIPDRFSGSGSGTDFTLTISSVQAEDAATYYCFQGSHVPNTFGQGTKVEIK

SEQ ID NO: 40059 - protein, 5 aa, Artificial Sequence
  Description of Artificial Sequence: Synthetic peptide
  XENP024420 vhCDR1
HYGMN

SEQ ID NO: 40060 - protein, 17 aa, Artificial Sequence
  Description of Artificial Sequence: Synthetic peptide
  XENP024420 vhCDR2
WINTYTGEPTYADGFTG

SEQ ID NO: 40061 - protein, 8 aa, Artificial Sequence
  Description of Artificial Sequence: Synthetic peptide
  XENP024420 vhCDR3
DYYGSSPY

SEQ ID NO: 40062 - protein, 16 aa, Artificial Sequence
  Description of Artificial Sequence: Synthetic peptide
  XENP024420 vlCDR1
KASQSIVHSNGNTYLE

SEQ ID NO: 40063 - protein, 7 aa, Artificial Sequence
  Description of Artificial Sequence: Synthetic peptide
  XENP024420 vlCDR2
KVSNRFS

SEQ ID NO: 40064 - protein, 9 aa, Artificial Sequence
  Description of Artificial Sequence: Synthetic peptide
  XENP024420 vlCDR3
FQGSHVPNT

SEQ ID NO: 40065 - protein, 249 aa, Artificial Sequence
  Description of Artificial Sequence: Synthetic polypeptide
  XENP024421 1C11[PD-1]_H3_L3.140_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQSPKLLIYKVSNRFSGVPDRFSGSGSGTDFTLTISSVEAEDVATYYCFQGSHVPNTFGQGTKVEIK

SEQ ID NO: 40066 - protein, 117 aa, Artificial Sequence; identical to SEQ ID NO: 33034
  Description of Artificial Sequence: Synthetic polypeptide
  VH of XENP024421

SEQ ID NO: 40067 - protein, 112 aa, Artificial Sequence
  Description of Artificial Sequence: Synthetic polypeptide
  VL of XENP024421
DIVMTQSPDSLAVSLGERATINCKASQSIVHSNGNTYLEWYQQKPGQSPKLLIYKVSNRFSGVPDRFSGSGSGTDFTLTISSVEAEDVATYYCFQGSHVPNTFGQGTKVEIK

SEQ ID NO: 40068 - protein, 5 aa, Artificial Sequence
  Description of Artificial Sequence: Synthetic peptide
  XENP024421 vhCDR1
HYGMN

SEQ ID NO: 40069 - protein, 17 aa, Artificial Sequence
  Description of Artificial Sequence: Synthetic peptide
  XENP024421 vhCDR2
WINTYTGEPTYADGFTG

SEQ ID NO: 40070 - protein, 8 aa, Artificial Sequence
  Description of Artificial Sequence: Synthetic peptide
  XENP024421 vhCDR3
DYYGSSPY

SEQ ID NO: 40071 - protein, 16 aa, Artificial Sequence
  Description of Artificial Sequence: Synthetic peptide
  XENP024421 vlCDR1
KASQSIVHSNGNTYLE

SEQ ID NO: 40072 - protein, 7 aa, Artificial Sequence
  Description of Artificial Sequence: Synthetic peptide
  XENP024421 vlCDR2
KVSNRFS

SEQ ID NO: 40073 - protein, 9 aa, Artificial Sequence
  Description of Artificial Sequence: Synthetic peptide
  XENP024421 vlCDR3
FQGSHVPNT

SEQ ID NO: 40074 - protein, 249 aa, Artificial Sequence
  Description of Artificial Sequence: Synthetic polypeptide
  XENP024422 1C11[PD-1]_H3_L3.141_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFSGVPDRFSGSGSGTDFTLTISSVEAEDVATYYCFQGSHVPNTFGQGTKVEIK

SEQ ID NO: 40075 - protein, 117 aa, Artificial Sequence; identical to SEQ ID NO: 33034
  Description of Artificial Sequence: Synthetic polypeptide
  VH of XENP024422

SEQ ID NO: 40076 - protein, 112 aa, Artificial Sequence
  Description of Artificial Sequence: Synthetic polypeptide
  VL of XENP024422
DIVMTQSPDSLAVSLGERATINCKASQSIVHSNGNTYLEWYQQKPGQPPKLLIYKVSNRFSGVPDRFSGSGSGTDFTLTISSVEAEDVATYYCFQGSHVPNTFGQGTKVEIK

SEQ ID NO: 40077 - protein, 5 aa, Artificial Sequence
  Description of Artificial Sequence: Synthetic peptide
  XENP024422 vhCDR1
HYGMN

SEQ ID NO: 40078 - protein, 17 aa, Artificial Sequence
  Description of Artificial Sequence: Synthetic peptide
  XENP024422 vhCDR2
WINTYTGEPTYADGFTG

SEQ ID NO: 40079 - protein, 8 aa, Artificial Sequence
  Description of Artificial Sequence: Synthetic peptide
  XENP024422 vhCDR3
DYYGSSPY

SEQ ID NO: 40080 - protein, 16 aa, Artificial Sequence
  Description of Artificial Sequence: Synthetic peptide
  XENP024422 vlCDR1
KASQSIVHSNGNTYLE

SEQ ID NO: 40081 - protein, 7 aa, Artificial Sequence
  Description of Artificial Sequence: Synthetic peptide
  XENP024422 vlCDR2
KVSNRFS

SEQ ID NO: 40082 - protein, 9 aa, Artificial Sequence
  Description of Artificial Sequence: Synthetic peptide
  XENP024422 vlCDR3
FQGSHVPNT

SEQ ID NO: 40083 - protein, 249 aa, Artificial Sequence
  Description of Artificial Sequence: Synthetic polypeptide
  XENP024423 1C11[PD-1]_H3_L3.142_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQAPKLLIYKVSNRFSGVPDRFSGSGSGTDFTLTISSVEAEDVATYYCFQGSHVPNTFGQGTKVEIK

SEQ ID NO: 40084 - protein, 117 aa, Artificial Sequence; identical to SEQ ID NO: 33034
  Description of Artificial Sequence: Synthetic polypeptide
  VH of XENP024423

SEQ ID NO: 40085 - protein, 112 aa, Artificial Sequence
  Description of Artificial Sequence: Synthetic polypeptide
  VL of XENP024423
DIVMTQSPDSLAVSLGERATINCKASQSIVHSNGNTYLEWYQQKPGQAPKLLIYKVSNRFSGVPDRFSGSGSGTDFTLTISSVEAEDVATYYCFQGSHVPNTFGQGTKVEIK

SEQ ID NO: 40086 - protein, 5 aa, Artificial Sequence
  Description of Artificial Sequence: Synthetic peptide
  XENP024423 vhCDR1
HYGMN

SEQ ID NO: 40087 - protein, 17 aa, Artificial Sequence
  Description of Artificial Sequence: Synthetic peptide
  XENP024423 vhCDR2
WINTYTGEPTYADGFTG

SEQ ID NO: 40088 - protein, 8 aa, Artificial Sequence
  Description of Artificial Sequence: Synthetic peptide
  XENP024423 vhCDR3
DYYGSSPY

SEQ ID NO: 40089 - protein, 16 aa, Artificial Sequence
  Description of Artificial Sequence: Synthetic peptide
  XENP024423 vlCDR1
KASQSIVHSNGNTYLE

SEQ ID NO: 40090 - protein, 7 aa, Artificial Sequence
  Description of Artificial Sequence: Synthetic peptide
  XENP024423 vlCDR2
KVSNRFS

SEQ ID NO: 40091 - protein, 9 aa, Artificial Sequence
  Description of Artificial Sequence: Synthetic peptide
  XENP024423 vlCDR3
FQGSHVPNT

SEQ ID NO: 40092 - protein, 249 aa, Artificial Sequence
  Description of Artificial Sequence: Synthetic polypeptide
  XENP024424 1C11[PD-1]_H3.176_L3_scFv(GKPGS)4
QIQLVQSGSELKKPGASVKVSCKASGYTFTHYGMNWVRQAPGQGLEWMGWINTYTGEPTYAPGFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40093 - protein, 117 aa, Artificial Sequence; identical to SEQ ID NO: 35216
  Description of Artificial Sequence: Synthetic polypeptide
  VH of XENP024424

SEQ ID NO: 40094 - protein, 112 aa, Artificial Sequence; identical to SEQ ID NO: 33009
  Description of Artificial Sequence: Synthetic polypeptide
  VL of XENP024424

SEQ ID NO: 40095 - protein, 5 aa, Artificial Sequence
  Description of Artificial Sequence: Synthetic peptide
  XENP024424 vhCDR1
HYGMN

SEQ ID NO: 40096 - protein, 17 aa, Artificial Sequence
  Description of Artificial Sequence: Synthetic peptide
  XENP024424 vhCDR2
WINTYTGEPTYAPGFKG

SEQ ID NO: 40097 - protein, 8 aa, Artificial Sequence
  Description of Artificial Sequence: Synthetic peptide
  XENP024424 vhCDR3
DYYGSSPY

SEQ ID NO: 40098 - protein, 16 aa, Artificial Sequence
  Description of Artificial Sequence: Synthetic peptide
  XENP024424 vlCDR1
KSSQSIVHSNGNTYLE

SEQ ID NO: 40099 - protein, 7 aa, Artificial Sequence
  Description of Artificial Sequence: Synthetic peptide
  XENP024424 vlCDR2
KVSNRFS

SEQ ID NO: 40100 - protein, 9 aa, Artificial Sequence
  Description of Artificial Sequence: Synthetic peptide
  XENP024424 vlCDR3
FQGSHVPNT

SEQ ID NO: 40101 - protein, 249 aa, Artificial Sequence
  Description of Artificial Sequence: Synthetic polypeptide
  XENP024425 1C11[PD-1]_H3.177_L3_scFv(GKPGS)4
QIQLVQSGSELKKPGASVKVSCKASGYTFTHYGMNWVRQAPGQGLEWMGWINTYTGEPTYAPKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40102 - protein, 117 aa, Artificial Sequence; identical to SEQ ID NO: 35225
  Description of Artificial Sequence: Synthetic polypeptide
  VH of XENP024425

SEQ ID NO: 40103 - protein, 112 aa, Artificial Sequence; identical to SEQ ID NO: 33009
  Description of Artificial Sequence: Synthetic polypeptide
  VL of XENP024425

SEQ ID NO: 40104 - protein, 5 aa, Artificial Sequence
  Description of Artificial Sequence: Synthetic peptide
  XENP024425 vhCDR1
HYGMN

SEQ ID NO: 40105 - protein, 17 aa, Artificial Sequence
  Description of Artificial Sequence: Synthetic peptide
  XENP024425 vhCDR2
WINTYTGEPTYAPKFTG

SEQ ID NO: 40106 - protein, 8 aa, Artificial Sequence
  Description of Artificial Sequence: Synthetic peptide
  XENP024425 vhCDR3
DYYGSSPY

SEQ ID NO: 40107 - protein, 16 aa, Artificial Sequence
  Description of Artificial Sequence: Synthetic peptide
  XENP024425 vlCDR1
KSSQSIVHSNGNTYLE

SEQ ID NO: 40108 - protein, 7 aa, Artificial Sequence
  Description of Artificial Sequence: Synthetic peptide
  XENP024425 vlCDR2
KVSNRFS

SEQ ID NO: 40109 - protein, 9 aa, Artificial Sequence
  Description of Artificial Sequence: Synthetic peptide
  XENP024425 vlCDR3
FQGSHVPNT

SEQ ID NO: 40110 - protein, 249 aa, Artificial Sequence
  Description of Artificial Sequence: Synthetic polypeptide
  XENP024426 1C11[PD-1]_H3.178_L3_scFv(GKPGS)4
QIQLVQSGSELKKPGASVKVSCKASGYTFTHYGMNWVRQAPGQGLEWMGWINTYTGEPTYAPGFKERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40111 - protein, 117 aa, Artificial Sequence; identical to SEQ ID NO: 35234
  Description of Artificial Sequence: Synthetic polypeptide
  VH of XENP024426

SEQ ID NO: 40112 - protein, 112 aa, Artificial Sequence; identical to SEQ ID NO: 33009
  Description of Artificial Sequence: Synthetic polypeptide
  VL of XENP024426

SEQ ID NO: 40113 - protein, 5 aa, Artificial Sequence
  Description of Artificial Sequence: Synthetic peptide
  XENP024426 vhCDR1
HYGMN

SEQ ID NO: 40114 - protein, 17 aa, Artificial Sequence
  Description of Artificial Sequence: Synthetic peptide
  XENP024426 vhCDR2
WINTYTGEPTYAPGFKE

SEQ ID NO: 40115 - protein, 8 aa, Artificial Sequence
  Description of Artificial Sequence: Synthetic peptide
  XENP024426 vhCDR3
DYYGSSPY

SEQ ID NO: 40116 - protein, 16 aa, Artificial Sequence
  Description of Artificial Sequence: Synthetic peptide
  XENP024426 vlCDR1
KSSQSIVHSNGNTYLE

SEQ ID NO: 40117 - protein, 7 aa, Artificial Sequence
  Description of Artificial Sequence: Synthetic peptide
  XENP024426 vlCDR2
KVSNRFS

SEQ ID NO: 40118 - protein, 9 aa, Artificial Sequence
  Description of Artificial Sequence: Synthetic peptide
  XENP024426 vlCDR3
FQGSHVPNT

SEQ ID NO: 40119 - protein, 249 aa, Artificial Sequence
  Description of Artificial Sequence: Synthetic polypeptide
  XENP024427 1C11[PD-1]_H3.179_L3_scFv(GKPGS)4
QIQLVQSGSELKKPGASVKVSCKASGYTFTHYGMNWVRQAPGQGLEWMGWINTYTGEPTYAPKFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40120 - protein, 117 aa, Artificial Sequence; identical to SEQ ID NO: 35243
  Description of Artificial Sequence: Synthetic polypeptide
  VH of XENP024427

SEQ ID NO: 40121 - protein, 112 aa, Artificial Sequence; identical to SEQ ID NO: 33009
  Description of Artificial Sequence: Synthetic polypeptide
  VL of XENP024427

SEQ ID NO: 40122 - protein, 5 aa, Artificial Sequence
  Description of Artificial Sequence: Synthetic peptide
  XENP024427 vhCDR1
HYGMN

SEQ ID NO: 40123 - protein, 17 aa, Artificial Sequence
  Description of Artificial Sequence: Synthetic peptide
  XENP024427 vhCDR2
WINTYTGEPTYAPKFTE

SEQ ID NO: 40124 - protein, 8 aa, Artificial Sequence
  Description of Artificial Sequence: Synthetic peptide
  XENP024427 vhCDR3
DYYGSSPY

SEQ ID NO: 40125 - protein, 16 aa, Artificial Sequence
  Description of Artificial Sequence: Synthetic peptide
  XENP024427 vlCDR1
KSSQSIVHSNGNTYLE

SEQ ID NO: 40126 - protein, 7 aa, Artificial Sequence
  Description of Artificial Sequence: Synthetic peptide
  XENP024427 vlCDR2
KVSNRFS

SEQ ID NO: 40127 - protein, 9 aa, Artificial Sequence
  Description of Artificial Sequence: Synthetic peptide
  XENP024427 vlCDR3
FQGSHVPNT

SEQ ID NO: 40128 - protein, 249 aa, Artificial Sequence
  Description of Artificial Sequence: Synthetic polypeptide
  XENP024428 1C11[PD-1]_H3.180_L3_scFv(GKPGS)4
QIQLVQSGSELKKPGASVKVSCKASGYTFTHYGINWVRQAPGQGLEWMGWINTYTGEPTYADGFTGRFVFSVDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40129 - protein, 117 aa, Artificial Sequence; identical to SEQ ID NO: 35252
  Description of Artificial Sequence: Synthetic polypeptide
  VH of XENP024428

SEQ ID NO: 40130 - protein, 112 aa, Artificial Sequence; identical to SEQ ID NO: 33009
  Description of Artificial Sequence: Synthetic polypeptide
  VL of XENP024428

SEQ ID NO: 40131 - protein, 5 aa, Artificial Sequence
  Description of Artificial Sequence: Synthetic peptide
  XENP024428 vhCDR1
HYGIN

SEQ ID NO: 40132 - protein, 17 aa, Artificial Sequence
  Description of Artificial Sequence: Synthetic peptide
  XENP024428 vhCDR2
WINTYTGEPTYADGFTG

SEQ ID NO: 40133 - protein, 8 aa, Artificial Sequence
  Description of Artificial Sequence: Synthetic peptide
  XENP024428 vhCDR3
DYYGSSPY

SEQ ID NO: 40134 - protein, 16 aa, Artificial Sequence
  Description of Artificial Sequence: Synthetic peptide
  XENP024428 vlCDR1
KSSQSIVHSNGNTYLE

SEQ ID NO: 40135 - protein, 7 aa, Artificial Sequence
  Description of Artificial Sequence: Synthetic peptide
  XENP024428 vlCDR2
KVSNRFS

SEQ ID NO: 40136 - protein, 9 aa, Artificial Sequence
  Description of Artificial Sequence: Synthetic peptide
  XENP024428 vlCDR3
FQGSHVPNT

SEQ ID NO: 40137 - protein, 249 aa, Artificial Sequence
  Description of Artificial Sequence: Synthetic polypeptide
  XENP024429 1C11[PD-1]_H3.181_L3_scFv(GKPGS)4
QIQLVQSGSELKKPGASVKVSCKASGYTFTHYGINWVRQAPGQGLEWMGWINTYTGEPTYADGFTGRFVFSIDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40138 - protein, 117 aa, Artificial Sequence; identical to SEQ ID NO: 35261
  Description of Artificial Sequence: Synthetic polypeptide
  VH of XENP024429

SEQ ID NO: 40139 - protein, 112 aa, Artificial Sequence; identical to SEQ ID NO: 33009
  Description of Artificial Sequence: Synthetic polypeptide
  VL of XENP024429

SEQ ID NO: 40140 - protein, 5 aa, Artificial Sequence
  Description of Artificial Sequence: Synthetic peptide
  XENP024429 vhCDR1
HYGIN

SEQ ID NO: 40141 - protein, 17 aa, Artificial Sequence
  Description of Artificial Sequence: Synthetic peptide
  XENP024429 vhCDR2
WINTYTGEPTYADGFTG

SEQ ID NO: 40142 - protein, 8 aa, Artificial Sequence
  Description of Artificial Sequence: Synthetic peptide
  XENP024429 vhCDR3
DYYGSSPY

SEQ ID NO: 40143 - protein, 16 aa, Artificial Sequence
  Description of Artificial Sequence: Synthetic peptide
  XENP024429 vlCDR1
KSSQSIVHSNGNTYLE

SEQ ID NO: 40144 - protein, 7 aa, Artificial Sequence
  Description of Artificial Sequence: Synthetic peptide
  XENP024429 vlCDR2
KVSNRFS

SEQ ID NO: 40145 - protein, 9 aa, Artificial Sequence
  Description of Artificial Sequence: Synthetic peptide
  XENP024429 vlCDR3
FQGSHVPNT

SEQ ID NO: 40146 - protein, 249 aa, Artificial Sequence
  Description of Artificial Sequence: Synthetic polypeptide
  XENP024430 1C11[PD-1]_H3.182_L3_scFv(GKPGS)4
QIQLVQSGSELVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40147 - protein, 117 aa, Artificial Sequence; identical to SEQ ID NO: 35270
  Description of Artificial Sequence: Synthetic polypeptide
  VH of XENP024430

SEQ ID NO: 40148 - protein, 112 aa, Artificial Sequence; identical to SEQ ID NO: 33009
  Description of Artificial Sequence: Synthetic polypeptide
  VL of XENP024430

SEQ ID NO: 40149 - protein, 5 aa, Artificial Sequence
  Description of Artificial Sequence: Synthetic peptide
  XENP024430 vhCDR1
HYGMN

SEQ ID NO: 40150 - protein, 17 aa, Artificial Sequence
  Description of Artificial Sequence: Synthetic peptide
  XENP024430 vhCDR2
WINTYTGEPTYADGFTG

SEQ ID NO: 40151 - protein, 8 aa, Artificial Sequence
  Description of Artificial Sequence: Synthetic peptide
  XENP024430 vhCDR3
DYYGSSPY

SEQ ID NO: 40152 - protein, 16 aa, Artificial Sequence
  Description of Artificial Sequence: Synthetic peptide
  XENP024430 vlCDR1
KSSQSIVHSNGNTYLE

SEQ ID NO: 40153 - protein, 7 aa, Artificial Sequence
  Description of Artificial Sequence: Synthetic peptide
  XENP024430 vlCDR2
KVSNRFS

SEQ ID NO: 40154 - protein, 9 aa, Artificial Sequence
  Description of Artificial Sequence: Synthetic peptide
  XENP024430 vlCDR3
FQGSHVPNT

SEQ ID NO: 40155 - protein, 249 aa, Artificial Sequence
  Description of Artificial Sequence: Synthetic polypeptide
  XENP024431 1C11[PD-1]_H3.183_L3_scFv(GKPGS)4
QIQLVQSGSVLKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40156 - protein, 117 aa, Artificial Sequence; identical to SEQ ID NO: 35279
  Description of Artificial Sequence: Synthetic polypeptide
  VH of XENP024431

SEQ ID NO: 40157 - protein, 112 aa, Artificial Sequence; identical to SEQ ID NO: 33009
  Description of Artificial Sequence: Synthetic polypeptide
  VL of XENP024431

SEQ ID NO: 40158 - protein, 5 aa, Artificial Sequence
  Description of Artificial Sequence: Synthetic peptide
  XENP024431 vhCDR1
HYGMN

SEQ ID NO: 40159 - protein, 17 aa, Artificial Sequence
  Description of Artificial Sequence: Synthetic peptide
  XENP024431 vhCDR2
WINTYTGEPTYADGFTG

SEQ ID NO: 40160 - protein, 8 aa, Artificial Sequence
  Description of Artificial Sequence: Synthetic peptide
  XENP024431 vhCDR3
DYYGSSPY

SEQ ID NO: 40161 - protein, 16 aa, Artificial Sequence
  Description of Artificial Sequence: Synthetic peptide
  XENP024431 vlCDR1
KSSQSIVHSNGNTYLE

SEQ ID NO: 40162 - protein, 7 aa, Artificial Sequence
  Description of Artificial Sequence: Synthetic peptide
  XENP024431 vlCDR2
KVSNRFS

SEQ ID NO: 40163 - protein, 9 aa, Artificial Sequence
  Description of Artificial Sequence: Synthetic peptide
  XENP024431 vlCDR3
FQGSHVPNT

SEQ ID NO: 40164 - protein, 249 aa, Artificial Sequence
  Description of Artificial Sequence: Synthetic polypeptide
  XENP024432 1C11[PD-1]_H3.184_L3_scFv(GKPGS)4
QIQLVQSGSVLVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40165 - protein, 117 aa, Artificial Sequence; identical to SEQ ID NO: 35288
  Description of Artificial Sequence: Synthetic polypeptide
  VH of XENP024432

SEQ ID NO: 40166 - protein, 112 aa, Artificial Sequence; identical to SEQ ID NO: 33009
  Description of Artificial Sequence: Synthetic polypeptide
  VL of XENP024432

SEQ ID NO: 40167 - protein, 5 aa, Artificial Sequence
  Description of Artificial Sequence: Synthetic peptide
  XENP024432 vhCDR1
HYGMN

SEQ ID NO: 40168 - protein, 17 aa, Artificial Sequence
  Description of Artificial Sequence: Synthetic peptide
  XENP024432 vhCDR2
WINTYTGEPTYADGFTG

SEQ ID NO: 40169 - protein, 8 aa, Artificial Sequence
  Description of Artificial Sequence: Synthetic peptide
  XENP024432 vhCDR3
DYYGSSPY

SEQ ID NO: 40170 - protein, 16 aa, Artificial Sequence
  Description of Artificial Sequence: Synthetic peptide
  XENP024432 vlCDR1
KSSQSIVHSNGNTYLE

SEQ ID NO: 40171 - protein, 7 aa, Artificial Sequence
  Description of Artificial Sequence: Synthetic peptide
  XENP024432 vlCDR2
KVSNRFS

SEQ ID NO: 40172 - protein, 9 aa, Artificial Sequence
  Description of Artificial Sequence: Synthetic peptide
  XENP024432 vlCDR3
FQGSHVPNT

SEQ ID NO: 40173 - protein, 249 aa, Artificial Sequence
  Description of Artificial Sequence: Synthetic polypeptide
  XENP024433 1C11[PD-1]_H3.185_L3_scFv(GKPGS)4
EVQLVQSGSELVKPGESVKVSCKASGYTFTHYGINWVRQPPGQGLEWIGWINTYTGEPYYAPKFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40174 - protein, 117 aa, Artificial Sequence; identical to SEQ ID NO: 35297
  Description of Artificial Sequence: Synthetic polypeptide
  VH of XENP024433

SEQ ID NO: 40175 - protein, 112 aa, Artificial Sequence; identical to SEQ ID NO: 33009
  Description of Artificial Sequence: Synthetic polypeptide
  VL of XENP024433

SEQ ID NO: 40176 - protein, 5 aa, Artificial Sequence
  Description of Artificial Sequence: Synthetic peptide
  XENP024433 vhCDR1
HYGIN

SEQ ID NO: 40177 - protein, 17 aa, Artificial Sequence
  Description of Artificial Sequence: Synthetic peptide
  XENP024433 vhCDR2
WINTYTGEPYYAPKFTE

SEQ ID NO: 40178 - protein, 8 aa, Artificial Sequence
  Description of Artificial Sequence: Synthetic peptide
  XENP024433 vhCDR3
DYYGSSPY

SEQ ID NO: 40179 - protein, 16 aa, Artificial Sequence
  Description of Artificial Sequence: Synthetic peptide
  XENP024433 vlCDR1
KSSQSIVHSNGNTYLE

SEQ ID NO: 40180 - protein, 7 aa, Artificial Sequence
  Description of Artificial Sequence: Synthetic peptide
  XENP024433 vlCDR2
KVSNRFS

SEQ ID NO: 40181 - protein, 9 aa, Artificial Sequence
  Description of Artificial Sequence: Synthetic peptide
  XENP024433 vlCDR3
FQGSHVPNT

SEQ ID NO: 40182 - protein, 249 aa, Artificial Sequence
  Description of Artificial Sequence: Synthetic polypeptide
  XENP024434 1C11[PD-1]_H3.186_L3_scFv(GKPGS)4
EVQLVQSGSELVKPGESVKVSCKASGYTFTHYGINWVRQPPGQGLEWMGWINTYTGEPYYAPGFTERFVFSLDTSVDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40183 - protein, 117 aa, Artificial Sequence; identical to SEQ ID NO: 35306
  Description of Artificial Sequence: Synthetic polypeptide
  VH of XENP024434

SEQ ID NO: 40184 - protein, 112 aa, Artificial Sequence; identical to SEQ ID NO: 33009
  Description of Artificial Sequence: Synthetic polypeptide
  VL of XENP024434

SEQ ID NO: 40185 - protein, 5 aa, Artificial Sequence
  Description of Artificial Sequence: Synthetic peptide
  XENP024434 vhCDR1
HYGIN

SEQ ID NO: 40186 - protein, 17 aa, Artificial Sequence
  Description of Artificial Sequence: Synthetic peptide
  XENP024434 vhCDR2
WINTYTGEPYYAPGFTE

SEQ ID NO: 40187 - protein, 8 aa, Artificial Sequence
  Description of Artificial Sequence: Synthetic peptide
  XENP024434 vhCDR3
DYYGSSPY

SEQ ID NO: 40188 - protein, 16 aa, Artificial Sequence
  Description of Artificial Sequence: Synthetic peptide
  XENP024434 vlCDR1
KSSQSIVHSNGNTYLE

SEQ ID NO: 40189 - protein, 7 aa, Artificial Sequence
  Description of Artificial Sequence: Synthetic peptide
  XENP024434 vlCDR2
KVSNRFS

SEQ ID NO: 40190 - protein, 9 aa, Artificial Sequence
  Description of Artificial Sequence: Synthetic peptide
  XENP024434 vlCDR3
FQGSHVPNT

SEQ ID NO: 40191 - protein, 249 aa, Artificial Sequence
  Description of Artificial Sequence: Synthetic polypeptide
  XENP024435 1C11[PD-1]_H3.187_L3_scFv(GKPGS)4
QVQLVQSGSELVKPGESVKVSCKASGYTFTHYGINWVRQPPGQGLEWMGWINTYTGEPYYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40192 - protein, 117 aa, Artificial Sequence; identical to SEQ ID NO: 35315
  Description of Artificial Sequence: Synthetic polypeptide
  VH of XENP024435

SEQ ID NO: 40193 - protein, 112 aa, Artificial Sequence; identical to SEQ ID NO: 33009
  Description of Artificial Sequence: Synthetic polypeptide
  VL of XENP024435

SEQ ID NO: 40194 - protein, 5 aa, Artificial Sequence
  Description of Artificial Sequence: Synthetic peptide
  XENP024435 vhCDR1
HYGIN

SEQ ID NO: 40195 - protein, 17 aa, Artificial Sequence
  Description of Artificial Sequence: Synthetic peptide
  XENP024435 vhCDR2
WINTYTGEPYYAPGFTE

SEQ ID NO: 40196 - protein, 8 aa, Artificial Sequence
  Description of Artificial Sequence: Synthetic peptide
  XENP024435 vhCDR3
DYYGSSPY

SEQ ID NO: 40197 - protein, 16 aa, Artificial Sequence
  Description of Artificial Sequence: Synthetic peptide
  XENP024435 vlCDR1
KSSQSIVHSNGNTYLE

SEQ ID NO: 40198 - protein, 7 aa, Artificial Sequence
  Description of Artificial Sequence: Synthetic peptide
  XENP024435 vlCDR2
KVSNRFS

SEQ ID NO: 40199 - protein, 9 aa, Artificial Sequence
  Description of Artificial Sequence: Synthetic peptide
  XENP024435 vlCDR3
FQGSHVPNT

SEQ ID NO: 40200 - protein, 249 aa, Artificial Sequence
  Description of Artificial Sequence: Synthetic polypeptide
  XENP024436 1C11[PD-1]_H3.188_L3_scFv(GKPGS)4
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40201 - protein, 117 aa, Artificial Sequence; identical to SEQ ID NO: 35324
  Description of Artificial Sequence: Synthetic polypeptide
  VH of XENP024436

SEQ ID NO: 40202 - protein, 112 aa, Artificial Sequence; identical to SEQ ID NO: 33009
  Description of Artificial Sequence: Synthetic polypeptide
  VL of XENP024436

SEQ ID NO: 40203 - protein, 5 aa, Artificial Sequence
  Description of Artificial Sequence: Synthetic peptide
  XENP024436 vhCDR1
HYGIN

SEQ ID NO: 40204 - protein, 17 aa, Artificial Sequence
  Description of Artificial Sequence: Synthetic peptide
  XENP024436 vhCDR2
WINTYTGEPYYAPGFTG

SEQ ID NO: 40205 - protein, 8 aa, Artificial Sequence
  Description of Artificial Sequence: Synthetic peptide
  XENP024436 vhCDR3
DYYGSSPY

SEQ ID NO: 40206 - protein, 16 aa, Artificial Sequence
  Description of Artificial Sequence: Synthetic peptide
  XENP024436 vlCDR1
KSSQSIVHSNGNTYLE

SEQ ID NO: 40207 - protein, 7 aa, Artificial Sequence
  Description of Artificial Sequence: Synthetic peptide
  XENP024436 vlCDR2
KVSNRFS

SEQ ID NO: 40208 - protein, 9 aa, Artificial Sequence
  Description of Artificial Sequence: Synthetic peptide
  XENP024436 vlCDR3
FQGSHVPNT

SEQ ID NO: 40209 - protein, 249 aa, Artificial Sequence
  Description of Artificial Sequence: Synthetic polypeptide
  XENP024437 1C11[PD-1]_H3.189_L3_scFv(GKPGS)4
QVQLVQSGSELKKPGASVKVSCKASGYTFTHYGINWVRQPPGQGLEWIGWINTYTGEPYYAPKFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40210 - protein, 117 aa, Artificial Sequence; identical to SEQ ID NO: 35333
  Description of Artificial Sequence: Synthetic polypeptide
  VH of XENP024437

SEQ ID NO: 40211 - protein, 112 aa, Artificial Sequence; identical to SEQ ID NO: 33009
  Description of Artificial Sequence: Synthetic polypeptide
  VL of XENP024437

SEQ ID NO: 40212 - protein, 5 aa, Artificial Sequence
  Description of Artificial Sequence: Synthetic peptide
  XENP024437 vhCDR1
HYGIN

SEQ ID NO: 40213 - protein, 17 aa, Artificial Sequence
  Description of Artificial Sequence: Synthetic peptide
  XENP024437 vhCDR2
WINTYTGEPYYAPKFTG

SEQ ID NO: 40214 - protein, 8 aa, Artificial Sequence
  Description of Artificial Sequence: Synthetic peptide
  XENP024437 vhCDR3
DYYGSSPY

SEQ ID NO: 40215 - protein, 16 aa, Artificial Sequence
  Description of Artificial Sequence: Synthetic peptide
  XENP024437 vlCDR1
KSSQSIVHSNGNTYLE

SEQ ID NO: 40216 - protein, 7 aa, Artificial Sequence
  Description of Artificial Sequence: Synthetic peptide
  XENP024437 vlCDR2
KVSNRFS

SEQ ID NO: 40217 - protein, 9 aa, Artificial Sequence
  Description of Artificial Sequence: Synthetic peptide
  XENP024437 vlCDR3
FQGSHVPNT

SEQ ID NO: 40218 - protein, 249 aa, Artificial Sequence
  Description of Artificial Sequence: Synthetic polypeptide
  XENP024438 1C11[PD-1]_H3.190_L3_scFv(GKPGS)4
QVQLVQSGSVLKKPGGSVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40219 - protein, 117 aa, Artificial Sequence; identical to SEQ ID NO: 35342
  Description of Artificial Sequence: Synthetic polypeptide
  VH of XENP024438

SEQ ID NO: 40220 - protein, 112 aa, Artificial Sequence; identical to SEQ ID NO: 33009
  Description of Artificial Sequence: Synthetic polypeptide
  VL of XENP024438

SEQ ID NO: 40221 - protein, 5 aa, Artificial Sequence
  Description of Artificial Sequence: Synthetic peptide
  XENP024438 vhCDR1
HYGIN

SEQ ID NO: 40222 - protein, 17 aa, Artificial Sequence
  Description of Artificial Sequence: Synthetic peptide
  XENP024438 vhCDR2
WINTYTGEPYYAPGFTG

SEQ ID NO: 40223 - protein, 8 aa, Artificial Sequence
  Description of Artificial Sequence: Synthetic peptide
  XENP024438 vhCDR3
DYYGSSPY

SEQ ID NO: 40224 - protein, 16 aa, Artificial Sequence
  Description of Artificial Sequence: Synthetic peptide
  XENP024438 vlCDR1
KSSQSIVHSNGNTYLE

SEQ ID NO: 40225 - protein, 7 aa, Artificial Sequence
  Description of Artificial Sequence: Synthetic peptide
  XENP024438 vlCDR2
KVSNRFS

SEQ ID NO: 40226 - protein, 9 aa, Artificial Sequence
  Description of Artificial Sequence: Synthetic peptide
  XENP024438 vlCDR3
FQGSHVPNT

SEQ ID NO: 40227 - protein, 249 aa, Artificial Sequence
  Description of Artificial Sequence: Synthetic polypeptide
  XENP024439 1C11[PD-1]_H3.191_L3_scFv(GKPGS)4
QVQLVQSGSELVKPGESVKVSCKASGYTFTHYGMNWVRQAPGQGLEWMGWINTYTGEPTYAPGFTGRFVFSLDTSQSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40228 - protein, 117 aa, Artificial Sequence; identical to SEQ ID NO: 35351
  Description of Artificial Sequence: Synthetic polypeptide
  VH of XENP024439

SEQ ID NO: 40229 - protein, 112 aa, Artificial Sequence; identical to SEQ ID NO: 33009
  Description of Artificial Sequence: Synthetic polypeptide
  VL of XENP024439

SEQ ID NO: 40230 - protein, 5 aa, Artificial Sequence
  Description of Artificial Sequence: Synthetic peptide
  XENP024439 vhCDR1
HYGMN

SEQ ID NO: 40231 - protein, 17 aa, Artificial Sequence
  Description of Artificial Sequence: Synthetic peptide
  XENP024439 vhCDR2
WINTYTGEPTYAPGFTG

SEQ ID NO: 40232 - protein, 8 aa, Artificial Sequence
  Description of Artificial Sequence: Synthetic peptide
  XENP024439 vhCDR3
DYYGSSPY

SEQ ID NO: 40233 - protein, 16 aa, Artificial Sequence
  Description of Artificial Sequence: Synthetic peptide
  XENP024439 vlCDR1
KSSQSIVHSNGNTYLE

SEQ ID NO: 40234 - protein, 7 aa, Artificial Sequence
  Description of Artificial Sequence: Synthetic peptide
  XENP024439 vlCDR2
KVSNRFS

SEQ ID NO: 40235 - protein, 9 aa, Artificial Sequence
  Description of Artificial Sequence: Synthetic peptide
  XENP024439 vlCDR3
FQGSHVPNT

SEQ ID NO: 40236 - protein, 249 aa, Artificial Sequence
  Description of Artificial Sequence: Synthetic polypeptide
  XENP024440 1C11[PD-1]_H3.192_L3_scFv(GKPGS)4
EVQLVQSGSVLKKPGESVKVSCKASGYTFTHYGINWVRQAPGQGLEWMGWINTYTGEPTYADGFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40237 - protein, 117 aa, Artificial Sequence; identical to SEQ ID NO: 35360
  Description of Artificial Sequence: Synthetic polypeptide
  VH of XENP024440

SEQ ID NO: 40238 - protein, 112 aa, Artificial Sequence; identical to SEQ ID NO: 33009
  Description of Artificial Sequence: Synthetic polypeptide
  VL of XENP024440

SEQ ID NO: 40239 - protein, 5 aa, Artificial Sequence
  Description of Artificial Sequence: Synthetic peptide
  XENP024440 vhCDR1
HYGIN

SEQ ID NO: 40240 - protein, 17 aa, Artificial Sequence
  Description of Artificial Sequence: Synthetic peptide
  XENP024440 vhCDR2
WINTYTGEPTYADGFTE

SEQ ID NO: 40241 - protein, 8 aa, Artificial Sequence
  Description of Artificial Sequence: Synthetic peptide
  XENP024440 vhCDR3
DYYGSSPY

SEQ ID NO: 40242 - protein, 16 aa, Artificial Sequence
  Description of Artificial Sequence: Synthetic peptide
  XENP024440 vlCDR1
KSSQSIVHSNGNTYLE

SEQ ID NO: 40243 - protein, 7 aa, Artificial Sequence
  Description of Artificial Sequence: Synthetic peptide
  XENP024440 vlCDR2
KVSNRFS

SEQ ID NO: 40244 - protein, 9 aa, Artificial Sequence
  Description of Artificial Sequence: Synthetic peptide
  XENP024440 vlCDR3
FQGSHVPNT

SEQ ID NO: 40245 - protein, 249 aa, Artificial Sequence
  Description of Artificial Sequence: Synthetic polypeptide
  XENP024441 1C11[PD-1]_H3.193_L3_scFv(GKPGS)4
QIQLVQSGSELKKPGASVKVSCKASGYTFTHYGMNWVRQPPGQGLEWIGWINTYTGEPTYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40246 - protein, 117 aa, Artificial Sequence; identical to SEQ ID NO: 35369
  Description of Artificial Sequence: Synthetic polypeptide
  VH of XENP024441

SEQ ID NO: 40247 - protein, 112 aa, Artificial Sequence; identical to SEQ ID NO: 33009
  Description of Artificial Sequence: Synthetic polypeptide
  VL of XENP024441

SEQ ID NO: 40248 - protein, 5 aa, Artificial Sequence
  Description of Artificial Sequence: Synthetic peptide
  XENP024441 vhCDR1
HYGMN

SEQ ID NO: 40249 - protein, 17 aa, Artificial Sequence
  Description of Artificial Sequence: Synthetic peptide
  XENP024441 vhCDR2
WINTYTGEPTYAPGFTE

SEQ ID NO: 40250 - protein, 8 aa, Artificial Sequence
  Description of Artificial Sequence: Synthetic peptide
  XENP024441 vhCDR3
DYYGSSPY

SEQ ID NO: 40251 - protein, 16 aa, Artificial Sequence
  Description of Artificial Sequence: Synthetic peptide
  XENP024441 vlCDR1
KSSQSIVHSNGNTYLE

SEQ ID NO: 40252 - protein, 7 aa, Artificial Sequence
  Description of Artificial Sequence: Synthetic peptide
  XENP024441 vlCDR2
KVSNRFS

SEQ ID NO: 40253 - protein, 9 aa, Artificial Sequence
  Description of Artificial Sequence: Synthetic peptide
  XENP024441 vlCDR3
FQGSHVPNT

SEQ ID NO: 40254 - protein, 249 aa, Artificial Sequence
  Description of Artificial Sequence: Synthetic polypeptide
  XENP024442 1C11[PD-1]_H3.194_L3_scFv(GKPGS)4
EIQLVQSGSVLKKPGASVKVSCKASGYTFTHYGINWVRQAPGQGLEWIGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40255 - protein, 117 aa, Artificial Sequence; identical to SEQ ID NO: 35378
  Description of Artificial Sequence: Synthetic polypeptide
  VH of XENP024442

SEQ ID NO: 40256 - protein, 112 aa, Artificial Sequence; identical to SEQ ID NO: 33009
  Description of Artificial Sequence: Synthetic polypeptide
  VL of XENP024442

SEQ ID NO: 40257 - protein, 5 aa, Artificial Sequence
  Description of Artificial Sequence: Synthetic peptide
  XENP024442 vhCDR1
HYGIN

SEQ ID NO: 40258 - protein, 17 aa, Artificial Sequence
  Description of Artificial Sequence: Synthetic peptide
  XENP024442 vhCDR2
WINTYTGEPTYADGFTG

SEQ ID NO: 40259 - protein, 8 aa, Artificial Sequence
  Description of Artificial Sequence: Synthetic peptide
  XENP024442 vhCDR3
DYYGSSPY

SEQ ID NO: 40260 - protein, 16 aa, Artificial Sequence
  Description of Artificial Sequence: Synthetic peptide
  XENP024442 vlCDR1
KSSQSIVHSNGNTYLE

SEQ ID NO: 40261 - protein, 7 aa, Artificial Sequence
  Description of Artificial Sequence: Synthetic peptide
  XENP024442 vlCDR2
KVSNRFS

SEQ ID NO: 40262 - protein, 9 aa, Artificial Sequence
  Description of Artificial Sequence: Synthetic peptide
  XENP024442 vlCDR3
FQGSHVPNT

SEQ ID NO: 40263 - protein, 249 aa, Artificial Sequence
  Description of Artificial Sequence: Synthetic polypeptide
  XENP024443 1C11[PD-1]_H3.195_L3_scFv(GKPGS)4
QIQLVQSGSELKKPGASVKVSCKASGYTFTHYGMNWVRQPPGQGLEWMGWINTYTGEPYYADGFTGRFVFSLDTSVDTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40264 - protein, 117 aa, Artificial Sequence; identical to SEQ ID NO: 35387
  Description of Artificial Sequence: Synthetic polypeptide
  VH of XENP024443

SEQ ID NO: 40265 - protein, 112 aa, Artificial Sequence; identical to SEQ ID NO: 33009
  Description of Artificial Sequence: Synthetic polypeptide
  VL of XENP024443

SEQ ID NO: 40266 - protein, 5 aa, Artificial Sequence
  Description of Artificial Sequence: Synthetic peptide
  XENP024443 vhCDR1
HYGMN

SEQ ID NO: 40267 - protein, 17 aa, Artificial Sequence
  Description of Artificial Sequence: Synthetic peptide
  XENP024443 vhCDR2
WINTYTGEPYYADGFTG

SEQ ID NO: 40268 - protein, 8 aa, Artificial Sequence
  Description of Artificial Sequence: Synthetic peptide
  XENP024443 vhCDR3
DYYGSSPY

SEQ ID NO: 40269 - protein, 16 aa, Artificial Sequence
  Description of Artificial Sequence: Synthetic peptide
  XENP024443 vlCDR1
KSSQSIVHSNGNTYLE

SEQ ID NO: 40270 - protein, 7 aa, Artificial Sequence
  Description of Artificial Sequence: Synthetic peptide
  XENP024443 vlCDR2
KVSNRFS

SEQ ID NO: 40271 - protein, 9 aa, Artificial Sequence
  Description of Artificial Sequence: Synthetic peptide
  XENP024443 vlCDR3
FQGSHVPNT

SEQ ID NO: 40272 - protein, 249 aa, Artificial Sequence
  Description of Artificial Sequence: Synthetic polypeptide
  XENP024827 1C11_H3.196_L3_scFv(GKPGS)4
EVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40273 - protein, 117 aa, Artificial Sequence
  Description of Artificial Sequence: Synthetic polypeptide
  VH of XENP024827
EVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 40274 - protein, 112 aa, Artificial Sequence; identical to SEQ ID NO: 33009
  Description of Artificial Sequence: Synthetic polypeptide
  VL of XENP024827

SEQ ID NO: 40275 - protein, 5 aa, Artificial Sequence
  Description of Artificial Sequence: Synthetic peptide
  XENP024827 vhCDR1
HYGIN

SEQ ID NO: 40276 - protein, 17 aa, Artificial Sequence
  Description of Artificial Sequence: Synthetic peptide
  XENP024827 vhCDR2
WINTYTGEPYYAPGFTG

SEQ ID NO: 40277 - protein, 8 aa, Artificial Sequence
  Description of Artificial Sequence: Synthetic peptide
  XENP024827 vhCDR3
DYYGSSPY

SEQ ID NO: 40278 - protein, 16 aa, Artificial Sequence
  Description of Artificial Sequence: Synthetic peptide
  XENP024827 vlCDR1
KSSQSIVHSNGNTYLE

SEQ ID NO: 40279 - protein, 7 aa, Artificial Sequence
  Description of Artificial Sequence: Synthetic peptide
  XENP024827 vlCDR2
KVSNRFS

SEQ ID NO: 40280 - protein, 9 aa, Artificial Sequence
  Description of Artificial Sequence: Synthetic peptide
  XENP024827 vlCDR3
FQGSHVPNT

SEQ ID NO: 40281 - protein, 249 aa, Artificial Sequence
  Description of Artificial Sequence: Synthetic polypeptide
  XENP024828 1C11_H3.197_L3_scFv(GKPGS)4
QVQLVQSGSELKKPGASVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40282 - protein, 117 aa, Artificial Sequence
  Description of Artificial Sequence: Synthetic polypeptide
  VH of XENP024828
QVQLVQSGSELKKPGASVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 40283 - protein, 112 aa, Artificial Sequence; identical to SEQ ID NO: 33009
  Description of Artificial Sequence: Synthetic polypeptide
  VL of XENP024828

SEQ ID NO: 40284 - protein, 5 aa, Artificial Sequence
  Description of Artificial Sequence: Synthetic peptide
  XENP024828 vhCDR1
HYGIN

SEQ ID NO: 40285 - protein, 17 aa, Artificial Sequence
  Description of Artificial Sequence: Synthetic peptide
  XENP024828 vhCDR2
WINTYTGEPYYAPGFTG

SEQ ID NO: 40286 - protein, 8 aa, Artificial Sequence
  Description of Artificial Sequence: Synthetic peptide
  XENP024828 vhCDR3
DYYGSSPY

SEQ ID NO: 40287 - protein, 16 aa, Artificial Sequence
  Description of Artificial Sequence: Synthetic peptide
  XENP024828 vlCDR1
KSSQSIVHSNGNTYLE

SEQ ID NO: 40288 - protein, 7 aa, Artificial Sequence
  Description of Artificial Sequence: Synthetic peptide
  XENP024828 vlCDR2
KVSNRFS

SEQ ID NO: 40289 - protein, 9 aa, Artificial Sequence
  Description of Artificial Sequence: Synthetic peptide
  XENP024828 vlCDR3
FQGSHVPNT

SEQ ID NO: 40290 - protein, 249 aa, Artificial Sequence
  Description of Artificial Sequence: Synthetic polypeptide
  XENP024829 1C11_H3.198_L3_scFv(GKPGS)4
QVQLVQSGSELKKPGESVKVSCKASGYTFTHYGINWVRQPPGQGLEWIGWINTYTGEPYYADGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40291 - protein, 117 aa, Artificial Sequence
  Description of Artificial Sequence: Synthetic polypeptide
  VH of XENP024829
QVQLVQSGSELKKPGESVKVSCKASGYTFTHYGINWVRQPPGQGLEWIGWINTYTGEPYYADGFTGRFVFSLDTSQSTAYLQINSLKAEDTAVYYCARDYYGSSPYWGQGTLVTVSS

SEQ ID NO: 40292 - protein, 112 aa, Artificial Sequence; identical to SEQ ID NO: 33009
  Description of Artificial Sequence: Synthetic polypeptide
  VL of XENP024829

SEQ ID NO: 40293 - protein, 5 aa, Artificial Sequence
  Description of Artificial Sequence: Synthetic peptide
  XENP024829 vhCDR1
HYGIN

SEQ ID NO: 40294 - protein, 17 aa, Artificial Sequence
  Description of Artificial Sequence: Synthetic peptide
  XENP024829 vhCDR2
WINTYTGEPYYADGFTG

SEQ ID NO: 40295 - protein, 8 aa, Artificial Sequence
  Description of Artificial Sequence: Synthetic peptide
  XENP024829 vhCDR3
DYYGSSPY

SEQ ID NO: 40296 - protein, 16 aa, Artificial Sequence
  Description of Artificial Sequence: Synthetic peptide
  XENP024829 vlCDR1
KSSQSIVHSNGNTYLE

SEQ ID NO: 40297 - protein, 7 aa, Artificial Sequence
  Description of Artificial Sequence: Synthetic peptide
  XENP024829 vlCDR2
KVSNRFS

SEQ ID NO: 40298 - protein, 9 aa, Artificial Sequence
  Description of Artificial Sequence: Synthetic peptide
  XENP024829 vlCDR3
FQGSHVPNT

SEQ ID NO: 40299 - protein, 249 aa, Artificial Sequence
  Description of Artificial Sequence: Synthetic polypeptide
  XENP024830 1C11_H3.199_L3_scFv(GKPGS)4
QVQLVQSGSELKKPGESVKVSCKASGYTFTHYGMNWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40300 - protein, 117 aa, Artificial Sequence
  Description of Artificial Sequence: Synthetic polypeptide
  VH of XENP024830
QVQLVQSGSELKKPGESVKVSCKASGYTFTHYGMNWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 40301 - protein, 112 aa, Artificial Sequence; identical to SEQ ID NO: 33009
  Description of Artificial Sequence: Synthetic polypeptide
  VL of XENP024830

SEQ ID NO: 40302 - protein, 5 aa, Artificial Sequence
  Description of Artificial Sequence: Synthetic peptide
  XENP024830 vhCDR1
HYGMN

SEQ ID NO: 40303 - protein, 17 aa, Artificial Sequence
  Description of Artificial Sequence: Synthetic peptide
  XENP024830 vhCDR2
WINTYTGEPYYAPGFTG

SEQ ID NO: 40304 - protein, 8 aa, Artificial Sequence
  Description of Artificial Sequence: Synthetic peptide
  XENP024830 vhCDR3
DYYGSSPY

SEQ ID NO: 40305 - protein, 16 aa, Artificial Sequence
  Description of Artificial Sequence: Synthetic peptide
  XENP024830 vlCDR1
KSSQSIVHSNGNTYLE

SEQ ID NO: 40306 - protein, 7 aa, Artificial Sequence
  Description of Artificial Sequence: Synthetic peptide
  XENP024830 vlCDR2
KVSNRFS

SEQ ID NO: 40307 - protein, 9 aa, Artificial Sequence
  Description of Artificial Sequence: Synthetic peptide
  XENP024830 vlCDR3
FQGSHVPNT

SEQ ID NO: 40308 - protein, 249 aa, Artificial Sequence
  Description of Artificial Sequence: Synthetic polypeptide
  XENP024831 1C11_H3.200_L3_scFv(GKPGS)4
QVQLVQSGSELKKPGESVKVSCKASGYTFTHYGINWVRQPPGQGLEWIGWINTYTGEPYYAPGFTGRFVFSLDTSQSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40309 - protein, 117 aa, Artificial Sequence
  Description of Artificial Sequence: Synthetic polypeptide
  VH of XENP024831
QVQLVQSGSELKKPGESVKVSCKASGYTFTHYGINWVRQPPGQGLEWIGWINTYTGEPYYAPGFTGRFVFSLDTSQSTAYLQINSLKAEDTAVYFCARDYYGSSPYWGQGTLVTVSS

SEQ ID NO: 40310 - protein, 112 aa, Artificial Sequence; identical to SEQ ID NO: 33009
  Description of Artificial Sequence: Synthetic polypeptide
  VL of XENP024831

SEQ ID NO: 40311 - protein, 5 aa, Artificial Sequence
  Description of Artificial Sequence: Synthetic peptide
  XENP024831 vhCDR1
HYGIN

SEQ ID NO: 40312 - protein, 17 aa, Artificial Sequence
  Description of Artificial Sequence: Synthetic peptide
  XENP024831 vhCDR2
WINTYTGEPYYAPGFTG

SEQ ID NO: 40313 - protein, 8 aa, Artificial Sequence
  Description of Artificial Sequence: Synthetic peptide
  XENP024831 vhCDR3
DYYGSSPY

SEQ ID NO: 40314 - protein, 16 aa, Artificial Sequence
  Description of Artificial Sequence: Synthetic peptide
  XENP024831 vlCDR1
KSSQSIVHSNGNTYLE

SEQ ID NO: 40315 - protein, 7 aa, Artificial Sequence
  Description of Artificial Sequence: Synthetic peptide
  XENP024831 vlCDR2
KVSNRFS

SEQ ID NO: 40316 - protein, 9 aa, Artificial Sequence
  Description of Artificial Sequence: Synthetic peptide
  XENP024831 vlCDR3
FQGSHVPNT

SEQ ID NO: 40317 - protein, 249 aa, Artificial Sequence
  Description of Artificial Sequence: Synthetic polypeptide
  XENP024832 1C11_H3.201_L3_scFv(GKPGS)4
QVQLVQSGSELKKPGESVKVSCKASGYTFTHYGINWVRQPPGQGLEWIGWINTYTGEPYYAPGFTGRFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40318 - protein, 117 aa, Artificial Sequence
  Description of Artificial Sequence: Synthetic polypeptide
  VH of XENP024832
QVQLVQSGSELKKPGESVKVSCKASGYTFTHYGINWVRQPPGQGLEWIGWINTYTGEPYYAPGFTGRFVFSIDTSQSTAYLQINSLKAEDTAVYYCARDYYGSSPYWGQGTLVTVSS

SEQ ID NO: 40319 - protein, 112 aa, Artificial Sequence; identical to SEQ ID NO: 33009
  Description of Artificial Sequence: Synthetic polypeptide
  VL of XENP024832

SEQ ID NO: 40320 - protein, 5 aa, Artificial Sequence
  Description of Artificial Sequence: Synthetic peptide
  XENP024832 vhCDR1
HYGIN

SEQ ID NO: 40321 - protein, 17 aa, Artificial Sequence
  Description of Artificial Sequence: Synthetic peptide
  XENP024832 vhCDR2
WINTYTGEPYYAPGFTG

SEQ ID NO: 40322 - protein, 8 aa, Artificial Sequence
  Description of Artificial Sequence: Synthetic peptide
  XENP024832 vhCDR3
DYYGSSPY

SEQ ID NO: 40323 - protein, 16 aa, Artificial Sequence
  Description of Artificial Sequence: Synthetic peptide
  XENP024832 vlCDR1
KSSQSIVHSNGNTYLE

SEQ ID NO: 40324 - protein, 7 aa, Artificial Sequence
  Description of Artificial Sequence: Synthetic peptide
  XENP024832 vlCDR2
KVSNRFS

SEQ ID NO: 40325 - protein, 9 aa, Artificial Sequence
  Description of Artificial Sequence: Synthetic peptide
  XENP024832 vlCDR3
FQGSHVPNT

SEQ ID NO: 40326 - protein, 249 aa, Artificial Sequence
  Description of Artificial Sequence: Synthetic polypeptide
  XENP024833 1C11_H3.202_L3_scFv(GKPGS)4
QVQLVQSGSELKKPGESVKVSCKASGYTFTHYGINWVRQAPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40327 - protein, 117 aa, Artificial Sequence
  Description of Artificial Sequence: Synthetic polypeptide
  VH of XENP024833
QVQLVQSGSELKKPGESVKVSCKASGYTFTHYGINWVRQAPGQGLEWIGWINTYTGEPYYAPGFTGRFVFSLDTSQSTAYLQINSLKAEDTAVYYCARDYYGSSPYWGQGTLVTVSS

SEQ ID NO: 40328 - protein, 112 aa, Artificial Sequence; identical to SEQ ID NO: 33009
  Description of Artificial Sequence: Synthetic polypeptide
  VL of XENP024833

SEQ ID NO: 40329 - protein, 5 aa, Artificial Sequence
  Description of Artificial Sequence: Synthetic peptide
  XENP024833 vhCDR1
HYGIN

SEQ ID NO: 40330 - protein, 17 aa, Artificial Sequence
  Description of Artificial Sequence: Synthetic peptide
  XENP024833 vhCDR2
WINTYTGEPYYAPGFTG

SEQ ID NO: 40331 - protein, 8 aa, Artificial Sequence
  Description of Artificial Sequence: Synthetic peptide
  XENP024833 vhCDR3
DYYGSSPY

SEQ ID NO: 40332 - protein, 16 aa, Artificial Sequence
  Description of Artificial Sequence: Synthetic peptide
  XENP024833 vlCDR1
KSSQSIVHSNGNTYLE

SEQ ID NO: 40333 - protein, 7 aa, Artificial Sequence
  Description of Artificial Sequence: Synthetic peptide
  XENP024833 vlCDR2
KVSNRFS

SEQ ID NO: 40334 - protein, 9 aa, Artificial Sequence
  Description of Artificial Sequence: Synthetic peptide
  XENP024833 vlCDR3
FQGSHVPNT

SEQ ID NO: 40335 - protein, 249 aa, Artificial Sequence
  Description of Artificial Sequence: Synthetic polypeptide
  XENP024834 1C11_H3.203_L3_scFv(GKPGS)4
QVQLVQSGSELKKPGESVKVSCKASGYTFTHYGINWVRQPPGQGLEWIGWINTYTGEPYYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40336 - protein, 117 aa, Artificial Sequence
  Description of Artificial Sequence: Synthetic polypeptide
  VH of XENP024834
QVQLVQSGSELKKPGESVKVSCKASGYTFTHYGINWVRQPPGQGLEWIGWINTYTGEPYYAPGFTERFVFSLDTSQSTAYLQINSLKAEDTAVYYCARDYYGSSPYWGQGTLVTVSS

SEQ ID NO: 40337 - protein, 112 aa, Artificial Sequence; identical to SEQ ID NO: 33009
  Description of Artificial Sequence: Synthetic polypeptide
  VL of XENP024834

SEQ ID NO: 40338 - protein, 5 aa, Artificial Sequence
  Description of Artificial Sequence: Synthetic peptide
  XENP024834 vhCDR1
HYGIN

SEQ ID NO: 40339 - protein, 17 aa, Artificial Sequence
  Description of Artificial Sequence: Synthetic peptide
  XENP024834 vhCDR2
WINTYTGEPYYAPGFTE

SEQ ID NO: 40340 - protein, 8 aa, Artificial Sequence
  Description of Artificial Sequence: Synthetic peptide
  XENP024834 vhCDR3
DYYGSSPY

SEQ ID NO: 40341 - protein, 16 aa, Artificial Sequence
  Description of Artificial Sequence: Synthetic peptide
  XENP024834 vlCDR1
KSSQSIVHSNGNTYLE

SEQ ID NO: 40342 - protein, 7 aa, Artificial Sequence
  Description of Artificial Sequence: Synthetic peptide
  XENP024834 vlCDR2
KVSNRFS

SEQ ID NO: 40343 - protein, 9 aa, Artificial Sequence
  Description of Artificial Sequence: Synthetic peptide
  XENP024834 vlCDR3
FQGSHVPNT

SEQ ID NO: 40344 - protein, 249 aa, Artificial Sequence
  Description of Artificial Sequence: Synthetic polypeptide
  XENP024835 1C11_H3.204_L3_scFv(GKPGS)4
QVQLVQSGSELKKPGESVKVSCKASGYTFTHYGINWVRQPPGQGLEWIGWINTYTGEPYYAPGFQGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40345 - protein, 117 aa, Artificial Sequence
  Description of Artificial Sequence: Synthetic polypeptide
  VH of XENP024835
QVQLVQSGSELKKPGESVKVSCKASGYTFTHYGINWVRQPPGQGLEWIGWINTYTGEPYYAPGFQGRFVFSLDTSQSTAYLQINSLKAEDTAVYYCARDYYGSSPYWGQGTLVTVSS

SEQ ID NO: 40346 - protein, 112 aa, Artificial Sequence; identical to SEQ ID NO: 33009
  Description of Artificial Sequence: Synthetic polypeptide
  VL of XENP024835

SEQ ID NO: 40347 - protein, 5 aa, Artificial Sequence
  Description of Artificial Sequence: Synthetic peptide
  XENP024835 vhCDR1
HYGIN

SEQ ID NO: 40348 - protein, 17 aa, Artificial Sequence
  Description of Artificial Sequence: Synthetic peptide
  XENP024835 vhCDR2
WINTYTGEPYYAPGFQG

SEQ ID NO: 40349 - protein, 8 aa, Artificial Sequence
  Description of Artificial Sequence: Synthetic peptide
  XENP024835 vhCDR3
DYYGSSPY

SEQ ID NO: 40350 - protein, 16 aa, Artificial Sequence
  Description of Artificial Sequence: Synthetic peptide
  XENP024835 vlCDR1
KSSQSIVHSNGNTYLE

SEQ ID NO: 40351 - protein, 7 aa, Artificial Sequence
  Description of Artificial Sequence: Synthetic peptide
  XENP024835 vlCDR2
KVSNRFS

SEQ ID NO: 40352 - protein, 9 aa, Artificial Sequence
  Description of Artificial Sequence: Synthetic peptide
  XENP024835 vlCDR3
FQGSHVPNT

SEQ ID NO: 40353 - protein, 249 aa, Artificial Sequence
  Description of Artificial Sequence: Synthetic polypeptide
  XENP024836 1C11_H3.205_L3_scFv(GKPGS)4
QVQLVQSGSELKKPGESVKVSCKASGYTFTHYGINWVRQPPGQGLEWIGWINTYTGEPYYAPGFKGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40354 - protein, 117 aa, Artificial Sequence
  Description of Artificial Sequence: Synthetic polypeptide
  VH of XENP024836
QVQLVQSGSELKKPGESVKVSCKASGYTFTHYGINWVRQPPGQGLEWIGWINTYTGEPYYAPGFKGRFVFSLDTSQSTAYLQINSLKAEDTAVYYCARDYYGSSPYWGQGTLVTVSS

SEQ ID NO: 40355 - protein, 112 aa, Artificial Sequence; identical to SEQ ID NO: 33009
  Description of Artificial Sequence: Synthetic polypeptide
  VL of XENP024836

SEQ ID NO: 40356 - protein, 5 aa, Artificial Sequence
  Description of Artificial Sequence: Synthetic peptide
  XENP024836 vhCDR1
HYGIN

SEQ ID NO: 40357 - protein, 17 aa, Artificial Sequence
  Description of Artificial Sequence: Synthetic peptide
  XENP024836 vhCDR2
WINTYTGEPYYAPGFKG

SEQ ID NO: 40358 - protein, 8 aa, Artificial Sequence
  Description of Artificial Sequence: Synthetic peptide
  XENP024836 vhCDR3
DYYGSSPY

SEQ ID NO: 40359 - protein, 16 aa, Artificial Sequence
  Description of Artificial Sequence: Synthetic peptide
  XENP024836 vlCDR1
KSSQSIVHSNGNTYLE

SEQ ID NO: 40360 - protein, 7 aa, Artificial Sequence
  Description of Artificial Sequence: Synthetic peptide
  XENP024836 vlCDR2
KVSNRFS

SEQ ID NO: 40361 - protein, 9 aa, Artificial Sequence
  Description of Artificial Sequence: Synthetic peptide
  XENP024836 vlCDR3
FQGSHVPNT

SEQ ID NO: 40362 - protein, 249 aa, Artificial Sequence
  Description of Artificial Sequence: Synthetic polypeptide
  XENP024837 1C11_H3.206_L3_scFv(GKPGS)4
QVQLVQSGSELKKPGESVKVSCKASGYTFTHYGINWVRQPPGQGLEWIGWINTYTGEPTYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40363 - protein, 117 aa, Artificial Sequence
  Description of Artificial Sequence: Synthetic polypeptide
  VH of XENP024837
QVQLVQSGSELKKPGESVKVSCKASGYTFTHYGINWVRQPPGQGLEWIGWINTYTGEPTYAPGFTGRFVFSLDTSQSTAYLQINSLKAEDTAVYYCARDYYGSSPYWGQGTLVTVSS

SEQ ID NO: 40364 - protein, 112 aa, Artificial Sequence; identical to SEQ ID NO: 33009
  Description of Artificial Sequence: Synthetic polypeptide
  VL of XENP024837

SEQ ID NO: 40365 - protein, 5 aa, Artificial Sequence
  Description of Artificial Sequence: Synthetic peptide
  XENP024837 vhCDR1
HYGIN

SEQ ID NO: 40366 - protein, 17 aa, Artificial Sequence
  Description of Artificial Sequence: Synthetic peptide
  XENP024837 vhCDR2
WINTYTGEPTYAPGFTG

SEQ ID NO: 40367 - protein, 8 aa, Artificial Sequence
  Description of Artificial Sequence: Synthetic peptide
  XENP024837 vhCDR3
DYYGSSPY

SEQ ID NO: 40368 - protein, 16 aa, Artificial Sequence
  Description of Artificial Sequence: Synthetic peptide
  XENP024837 vlCDR1
KSSQSIVHSNGNTYLE

SEQ ID NO: 40369 - protein, 7 aa, Artificial Sequence
  Description of Artificial Sequence: Synthetic peptide
  XENP024837 vlCDR2
KVSNRFS

SEQ ID NO: 40370 - protein, 9 aa, Artificial Sequence
  Description of Artificial Sequence: Synthetic peptide
  XENP024837 vlCDR3
FQGSHVPNT

SEQ ID NO: 40371 - protein, 249 aa, Artificial Sequence
  Description of Artificial Sequence: Synthetic polypeptide
  XENP024838 1C11_H3.207_L3_scFv(GKPGS)4
QVQLVQSGSELKKPGESVKVSCKASGYTFTHYGINWVRQPPGQGLEWIGWINTYTGEPYYAPGFTGRFVFSLDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40372 - protein, 117 aa, Artificial Sequence
  Description of Artificial Sequence: Synthetic polypeptide
  VH of XENP024838
QVQLVQSGSELKKPGESVKVSCKASGYTFTHYGINWVRQPPGQGLEWIGWINTYTGEPYYAPGFTGRFVFSLDTSQSTAYLQISSLKAEDTAVYYCARDYYGSSPYWGQGTLVTVSS

SEQ ID NO: 40373 - protein, 112 aa, Artificial Sequence; identical to SEQ ID NO: 33009
  Description of Artificial Sequence: Synthetic polypeptide
  VL of XENP024838

SEQ ID NO: 40374 - protein, 5 aa, Artificial Sequence
  Description of Artificial Sequence: Synthetic peptide
  XENP024838 vhCDR1
HYGIN

SEQ ID NO: 40375 - protein, 17 aa, Artificial Sequence
  Description of Artificial Sequence: Synthetic peptide
  XENP024838 vhCDR2
WINTYTGEPYYAPGFTG

SEQ ID NO: 40376 - protein, 8 aa, Artificial Sequence
  Description of Artificial Sequence: Synthetic peptide
  XENP024838 vhCDR3
DYYGSSPY

SEQ ID NO: 40377 - protein, 16 aa, Artificial Sequence
  Description of Artificial Sequence: Synthetic peptide
  XENP024838 vlCDR1
KSSQSIVHSNGNTYLE

SEQ ID NO: 40378 - protein, 7 aa, Artificial Sequence
  Description of Artificial Sequence: Synthetic peptide
  XENP024838 vlCDR2
KVSNRFS

SEQ ID NO: 40379 - protein, 9 aa, Artificial Sequence
  Description of Artificial Sequence: Synthetic peptide
  XENP024838 vlCDR3
FQGSHVPNT

SEQ ID NO: 40380 - protein, 249 aa, Artificial Sequence
  Description of Artificial Sequence: Synthetic polypeptide
  XENP024839 1C11_H3.208_L3_scFv(GKPGS)4
QVQLVQSGSELKKPGESVKVSCKASGYTFTHYGINWVRQPPGQGLEWIGWINTYTGEPYYAPGFTGRFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40381 - protein, 117 aa, Artificial Sequence
  Description of Artificial Sequence: Synthetic polypeptide
  VH of XENP024839
QVQLVQSGSELKKPGESVKVSCKASGYTFTHYGINWVRQPPGQGLEWIGWINTYTGEPYYAPGFTGRFVFSLDTSQDTAYLQINSLKAEDTAVYYCARDYYGSSPYWGQGTLVTVSS

SEQ ID NO: 40382 - protein, 112 aa, Artificial Sequence; identical to SEQ ID NO: 33009
  Description of Artificial Sequence: Synthetic polypeptide
  VL of XENP024839

SEQ ID NO: 40383 - protein, 5 aa, Artificial Sequence
  Description of Artificial Sequence: Synthetic peptide
  XENP024839 vhCDR1
HYGIN

SEQ ID NO: 40384 - protein, 17 aa, Artificial Sequence
  Description of Artificial Sequence: Synthetic peptide
  XENP024839 vhCDR2
WINTYTGEPYYAPGFTG

SEQ ID NO: 40385 - protein, 8 aa, Artificial Sequence
  Description of Artificial Sequence: Synthetic peptide
  XENP024839 vhCDR3
DYYGSSPY

SEQ ID NO: 40386 - protein, 16 aa, Artificial Sequence
  Description of Artificial Sequence: Synthetic peptide
  XENP024839 vlCDR1
KSSQSIVHSNGNTYLE

SEQ ID NO: 40387 - protein, 7 aa, Artificial Sequence
  Description of Artificial Sequence: Synthetic peptide
  XENP024839 vlCDR2
KVSNRFS

SEQ ID NO: 40388 - protein, 9 aa, Artificial Sequence
  Description of Artificial Sequence: Synthetic peptide
  XENP024839 vlCDR3
FQGSHVPNT

SEQ ID NO: 40389 - protein, 249 aa, Artificial Sequence
  Description of Artificial Sequence: Synthetic polypeptide
  XENP024840 1C11_H3.209_L3_scFv(GKPGS)4
QVQLVQSGSELKKPGESVKVSCKASGYTFTHYGINWVRQPPGQGLEWMGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40390 - protein, 117 aa, Artificial Sequence
  Description of Artificial Sequence: Synthetic polypeptide
  VH of XENP024840
QVQLVQSGSELKKPGESVKVSCKASGYTFTHYGINWVRQPPGQGLEWMGWINTYTGEPYYAPGFTGRFVFSLDTSQSTAYLQINSLKAEDTAVYYCARDYYGSSPYWGQGTLVTVSS

SEQ ID NO: 40391 - protein, 112 aa, Artificial Sequence; identical to SEQ ID NO: 33009
  Description of Artificial Sequence: Synthetic polypeptide
  VL of XENP024840

SEQ ID NO: 40392 - protein, 5 aa, Artificial Sequence
  Description of Artificial Sequence: Synthetic peptide
  XENP024840 vhCDR1
HYGIN

SEQ ID NO: 40393 - protein, 17 aa, Artificial Sequence
  Description of Artificial Sequence: Synthetic peptide
  XENP024840 vhCDR2
WINTYTGEPYYAPGFTG

SEQ ID NO: 40394 - protein, 8 aa, Artificial Sequence
  Description of Artificial Sequence: Synthetic peptide
  XENP024840 vhCDR3
DYYGSSPY

SEQ ID NO: 40395 - protein, 16 aa, Artificial Sequence
  Description of Artificial Sequence: Synthetic peptide
  XENP024840 vlCDR1
KSSQSIVHSNGNTYLE

SEQ ID NO: 40396 - protein, 7 aa, Artificial Sequence
  Description of Artificial Sequence: Synthetic peptide
  XENP024840 vlCDR2
KVSNRFS

SEQ ID NO: 40397 - protein, 9 aa, Artificial Sequence
  Description of Artificial Sequence: Synthetic peptide
  XENP024840 vlCDR3
FQGSHVPNT

SEQ ID NO: 40398 - protein, 249 aa, Artificial Sequence
  Description of Artificial Sequence: Synthetic polypeptide
  XENP024841 1C11_H3.210_L3_scFv(GKPGS)4
QVQLVQSGSELKKPGESVKVSCKASGYTFTHYGINWVRQPPGQGLEWIGWINTYTGEPYYAPGFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40399 - protein, 117 aa, Artificial Sequence
  Description of Artificial Sequence: Synthetic polypeptide
  VH of XENP024841
QVQLVQSGSELKKPGESVKVSCKASGYTFTHYGINWVRQPPGQGLEWIGWINTYTGEPYYAPGFTGRFVFSLDTSVSTAYLQINSLKAEDTAVYYCARDYYGSSPYWGQGTLVTVSS

SEQ ID NO: 40400 - protein, 112 aa, Artificial Sequence; identical to SEQ ID NO: 33009
  Description of Artificial Sequence: Synthetic polypeptide
  VL of XENP024841

SEQ ID NO: 40401 - protein, 5 aa, Artificial Sequence
  Description of Artificial Sequence: Synthetic peptide
  XENP024841 vhCDR1
HYGIN

SEQ ID NO: 40402 - protein, 17 aa, Artificial Sequence
  Description of Artificial Sequence: Synthetic peptide
  XENP024841 vhCDR2
WINTYTGEPYYAPGFTG

SEQ ID NO: 40403 - protein, 8 aa, Artificial Sequence
  Description of Artificial Sequence: Synthetic peptide
  XENP024841 vhCDR3
DYYGSSPY

SEQ ID NO: 40404 - protein, 16 aa, Artificial Sequence
  Description of Artificial Sequence: Synthetic peptide
  XENP024841 vlCDR1
KSSQSIVHSNGNTYLE

SEQ ID NO: 40405 - protein, 7 aa, Artificial Sequence
  Description of Artificial Sequence: Synthetic peptide
  XENP024841 vlCDR2
KVSNRFS

SEQ ID NO: 40406 - protein, 9 aa, Artificial Sequence
  Description of Artificial Sequence: Synthetic peptide
  XENP024841 vlCDR3
FQGSHVPNT

SEQ ID NO: 40407 - protein, 249 aa, Artificial Sequence
  Description of Artificial Sequence: Synthetic polypeptide
  XENP024842 1C11_H3.211_L3_scFv(GKPGS)4
QVQLVQSGPELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40408 - protein, 117 aa, Artificial Sequence
  Description of Artificial Sequence: Synthetic polypeptide
  VH of XENP024842
QVQLVQSGPELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 40409 - protein, 112 aa, Artificial Sequence; identical to SEQ ID NO: 33009
  Description of Artificial Sequence: Synthetic polypeptide
  VL of XENP024842

SEQ ID NO: 40410 - protein, 5 aa, Artificial Sequence
  Description of Artificial Sequence: Synthetic peptide
  XENP024842 vhCDR1
HYGIN

SEQ ID NO: 40411 - protein, 17 aa, Artificial Sequence
  Description of Artificial Sequence: Synthetic peptide
  XENP024842 vhCDR2
WINTYTGEPYYAPGFTG

SEQ ID NO: 40412 - protein, 8 aa, Artificial Sequence
  Description of Artificial Sequence: Synthetic peptide
  XENP024842 vhCDR3
DYYGSSPY

SEQ ID NO: 40413 - protein, 16 aa, Artificial Sequence
  Description of Artificial Sequence: Synthetic peptide
  XENP024842 vlCDR1
KSSQSIVHSNGNTYLE

SEQ ID NO: 40414 - protein, 7 aa, Artificial Sequence
  Description of Artificial Sequence: Synthetic peptide
  XENP024842 vlCDR2
KVSNRFS

SEQ ID NO: 40415 - protein, 9 aa, Artificial Sequence
  Description of Artificial Sequence: Synthetic peptide
  XENP024842 vlCDR3
FQGSHVPNT

SEQ ID NO: 40416 - protein, 249 aa, Artificial Sequence
  Description of Artificial Sequence: Synthetic polypeptide
  XENP024843 1C11_H3.212_L3_scFv(GKPGS)4
QVQLVQSGSELKKPGESVKVSCKASGYTFTHYGINWVRQPPGQGLEWIGWINTYTGEPYYAPGFTGRFVFSLDTSVDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40417 - protein, 117 aa, Artificial Sequence
  Description of Artificial Sequence: Synthetic polypeptide
  VH of XENP024843
QVQLVQSGSELKKPGESVKVSCKASGYTFTHYGINWVRQPPGQGLEWIGWINTYTGEPYYAPGFTGRFVFSLDTSVDTAYLQINSLKAEDTAVYYCARDYYGSSPYWGQGTLVTVSS

SEQ ID NO: 40418 - protein, 112 aa, Artificial Sequence; identical to SEQ ID NO: 33009
  Description of Artificial Sequence: Synthetic polypeptide
  VL of XENP024843

SEQ ID NO: 40419 - protein, 5 aa, Artificial Sequence
  Description of Artificial Sequence: Synthetic peptide
  XENP024843 vhCDR1
HYGIN

SEQ ID NO: 40420 - protein, 17 aa, Artificial Sequence
  Description of Artificial Sequence: Synthetic peptide
  XENP024843 vhCDR2
WINTYTGEPYYAPGFTG

SEQ ID NO: 40421 - protein, 8 aa, Artificial Sequence
  Description of Artificial Sequence: Synthetic peptide
  XENP024843 vhCDR3
DYYGSSPY

SEQ ID NO: 40422 - protein, 16 aa, Artificial Sequence
  Description of Artificial Sequence: Synthetic peptide
  XENP024843 vlCDR1
KSSQSIVHSNGNTYLE

SEQ ID NO: 40423 - protein, 7 aa, Artificial Sequence
  Description of Artificial Sequence: Synthetic peptide
  XENP024843 vlCDR2
KVSNRFS

SEQ ID NO: 40424 - protein, 9 aa, Artificial Sequence
  Description of Artificial Sequence: Synthetic peptide
  XENP024843 vlCDR3
FQGSHVPNT

SEQ ID NO: 40425 - protein, 249 aa, Artificial Sequence
  Description of Artificial Sequence: Synthetic polypeptide
  XENP024844 1C11_H3.213_L3_scFv(GKPGS)4
QVQLVQSGPELKKPGESVKVSCKASGYTFTHYGINWVRQAPGQGLEWIGWINTYTGEPYYAPGFTGRFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40426 - protein, 117 aa, Artificial Sequence
  Description of Artificial Sequence: Synthetic polypeptide
  VH of XENP024844
QVQLVQSGPELKKPGESVKVSCKASGYTFTHYGINWVRQAPGQGLEWIGWINTYTGEPYYAPGFTGRFVFSLDTSQDTAYLQINSLKAEDTAVYYCARDYYGSSPYWGQGTLVTVSS

SEQ ID NO: 40427 - protein, 112 aa, Artificial Sequence; identical to SEQ ID NO: 33009
  Description of Artificial Sequence: Synthetic polypeptide
  VL of XENP024844

SEQ ID NO: 40428 - protein, 5 aa, Artificial Sequence
  Description of Artificial Sequence: Synthetic peptide
  XENP024844 vhCDR1
HYGIN

SEQ ID NO: 40429 - protein, 17 aa, Artificial Sequence
  Description of Artificial Sequence: Synthetic peptide
  XENP024844 vhCDR2
WINTYTGEPYYAPGFTG

SEQ ID NO: 40430 - protein, 8 aa, Artificial Sequence
  Description of Artificial Sequence: Synthetic peptide
  XENP024844 vhCDR3
DYYGSSPY

SEQ ID NO: 40431 - protein, 16 aa, Artificial Sequence
  Description of Artificial Sequence: Synthetic peptide
  XENP024844 vlCDR1
KSSQSIVHSNGNTYLE

SEQ ID NO: 40432 - protein, 7 aa, Artificial Sequence
  Description of Artificial Sequence: Synthetic peptide
  XENP024844 vlCDR2
KVSNRFS

SEQ ID NO: 40433 - protein, 9 aa, Artificial Sequence
  Description of Artificial Sequence: Synthetic peptide
  XENP024844 vlCDR3
FQGSHVPNT

SEQ ID NO: 40434 - protein, 249 aa, Artificial Sequence
  Description of Artificial Sequence: Synthetic polypeptide
  XENP024845 1C11_H3.214_L3_scFv(GKPGS)4
QVQLVQSGPELKKPGESVKVSCKASGYTFTHYGINWVRQAPGQGLEWIGWINTYTGEPYYAPGFTGRFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40435 - protein, 117 aa, Artificial Sequence
  Description of Artificial Sequence: Synthetic polypeptide
  VH of XENP024845
QVQLVQSGPELKKPGESVKVSCKASGYTFTHYGINWVRQAPGQGLEWIGWINTYTGEPYYAPGFTGRFVFSIDTSQSTAYLQINSLKAEDTAVYYCARDYYGSSPYWGQGTLVTVSS

SEQ ID NO: 40436 - protein, 112 aa, Artificial Sequence; identical to SEQ ID NO: 33009
  Description of Artificial Sequence: Synthetic polypeptide
  VL of XENP024845

SEQ ID NO: 40437 - protein, 5 aa, Artificial Sequence
  Description of Artificial Sequence: Synthetic peptide
  XENP024845 vhCDR1
HYGIN

SEQ ID NO: 40438 - protein, 17 aa, Artificial Sequence
  Description of Artificial Sequence: Synthetic peptide
  XENP024845 vhCDR2
WINTYTGEPYYAPGFTG

SEQ ID NO: 40439 - protein, 8 aa, Artificial Sequence
  Description of Artificial Sequence: Synthetic peptide
  XENP024845 vhCDR3
DYYGSSPY

SEQ ID NO: 40440 - protein, 16 aa, Artificial Sequence
  Description of Artificial Sequence: Synthetic peptide
  XENP024845 vlCDR1
KSSQSIVHSNGNTYLE

SEQ ID NO: 40441 - protein, 7 aa, Artificial Sequence
  Description of Artificial Sequence: Synthetic peptide
  XENP024845 vlCDR2
KVSNRFS

SEQ ID NO: 40442 - protein, 9 aa, Artificial Sequence
  Description of Artificial Sequence: Synthetic peptide
  XENP024845 vlCDR3
FQGSHVPNT

SEQ ID NO: 40443 - protein, 249 aa, Artificial Sequence
  Description of Artificial Sequence: Synthetic polypeptide
  XENP024846 1C11_H3.215_L3_scFv(GKPGS)4
QVQLVQSGPELKKPGESVKVSCKASGYTFTHYGINWVRQAPGQGLEWIGWINTYTGEPYYAPGFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40444 - protein, 117 aa, Artificial Sequence
  Description of Artificial Sequence: Synthetic polypeptide
  VH of XENP024846
QVQLVQSGPELKKPGESVKVSCKASGYTFTHYGINWVRQAPGQGLEWIGWINTYTGEPYYAPGFTGRFVFSLDTSVSTAYLQINSLKAEDTAVYYCARDYYGSSPYWGQGTLVTVSS

SEQ ID NO: 40445 - protein, 112 aa, Artificial Sequence; identical to SEQ ID NO: 33009
  Description of Artificial Sequence: Synthetic polypeptide
  VL of XENP024846

SEQ ID NO: 40446 - protein, 5 aa, Artificial Sequence
  Description of Artificial Sequence: Synthetic peptide
  XENP024846 vhCDR1
HYGIN

SEQ ID NO: 40447 - protein, 17 aa, Artificial Sequence
  Description of Artificial Sequence: Synthetic peptide
  XENP024846 vhCDR2
WINTYTGEPYYAPGFTG

SEQ ID NO: 40448 - protein, 8 aa, Artificial Sequence
  Description of Artificial Sequence: Synthetic peptide
  XENP024846 vhCDR3
DYYGSSPY

SEQ ID NO: 40449 - protein, 16 aa, Artificial Sequence
  Description of Artificial Sequence: Synthetic peptide
  XENP024846 vlCDR1
KSSQSIVHSNGNTYLE

SEQ ID NO: 40450 - protein, 7 aa, Artificial Sequence
  Description of Artificial Sequence: Synthetic peptide
  XENP024846 vlCDR2
KVSNRFS

SEQ ID NO: 40451 - protein, 9 aa, Artificial Sequence
  Description of Artificial Sequence: Synthetic peptide
  XENP024846 vlCDR3
FQGSHVPNT

SEQ ID NO: 40452 - protein, 249 aa, Artificial Sequence
  Description of Artificial Sequence: Synthetic polypeptide
  XENP024847 1C11_H3.216_L3_scFv(GKPGS)4
QVQLVQSGPELKKPGESVKVSCKASGYTFTHYGINWVRQPPGQGLEWMGWINTYTGEPYYAPGFTGRFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40453 - protein, 117 aa, Artificial Sequence
  Description of Artificial Sequence: Synthetic polypeptide
  VH of XENP024847
QVQLVQSGPELKKPGESVKVSCKASGYTFTHYGINWVRQPPGQGLEWMGWINTYTGEPYYAPGFTGRFVFSIDTSQSTAYLQINSLKAEDTAVYYCARDYYGSSPYWGQGTLVTVSS

SEQ ID NO: 40454 - protein, 112 aa, Artificial Sequence; identical to SEQ ID NO: 33009
  Description of Artificial Sequence: Synthetic polypeptide
  VL of XENP024847

SEQ ID NO: 40455 - protein, 5 aa, Artificial Sequence
  Description of Artificial Sequence: Synthetic peptide
  XENP024847 vhCDR1
HYGIN

SEQ ID NO: 40456 - protein, 17 aa, Artificial Sequence
  Description of Artificial Sequence: Synthetic peptide
  XENP024847 vhCDR2
WINTYTGEPYYAPGFTG

SEQ ID NO: 40457 - protein, 8 aa, Artificial Sequence
  Description of Artificial Sequence: Synthetic peptide
  XENP024847 vhCDR3
DYYGSSPY

SEQ ID NO: 40458 - protein, 16 aa, Artificial Sequence
  Description of Artificial Sequence: Synthetic peptide
  XENP024847 vlCDR1
KSSQSIVHSNGNTYLE

SEQ ID NO: 40459 - protein, 7 aa, Artificial Sequence
  Description of Artificial Sequence: Synthetic peptide
  XENP024847 vlCDR2
KVSNRFS

SEQ ID NO: 40460 - protein, 9 aa, Artificial Sequence
  Description of Artificial Sequence: Synthetic peptide
  XENP024847 vlCDR3
FQGSHVPNT

SEQ ID NO: 40461 - protein, 249 aa, Artificial Sequence
  Description of Artificial Sequence: Synthetic polypeptide
  XENP024848 1C11_H3.217_L3_scFv(GKPGS)4
QVQLVQSGPELKKPGESVKVSCKASGYTFTHYGINWVRQPPGQGLEWMGWINTYTGEPYYAPGFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40462 - protein, 117 aa, Artificial Sequence
  Description of Artificial Sequence: Synthetic polypeptide
  VH of XENP024848
QVQLVQSGPELKKPGESVKVSCKASGYTFTHYGINWVRQPPGQGLEWMGWINTYTGEPYYAPGFTGRFVFSLDTSVSTAYLQINSLKAEDTAVYYCARDYYGSSPYWGQGTLVTVSS

SEQ ID NO: 40463 - protein, 112 aa, Artificial Sequence; identical to SEQ ID NO: 33009
  Description of Artificial Sequence: Synthetic polypeptide
  VL of XENP024848

SEQ ID NO: 40464 - protein, 5 aa, Artificial Sequence
  Description of Artificial Sequence: Synthetic peptide
  XENP024848 vhCDR1
HYGIN

SEQ ID NO: 40465 - protein, 17 aa, Artificial Sequence
  Description of Artificial Sequence: Synthetic peptide
  XENP024848 vhCDR2
WINTYTGEPYYAPGFTG

SEQ ID NO: 40466 - protein, 8 aa, Artificial Sequence
  Description of Artificial Sequence: Synthetic peptide
  XENP024848 vhCDR3
DYYGSSPY

SEQ ID NO: 40467 - protein, 16 aa, Artificial Sequence
  Description of Artificial Sequence: Synthetic peptide
  XENP024848 vlCDR1
KSSQSIVHSNGNTYLE

SEQ ID NO: 40468 - protein, 7 aa, Artificial Sequence
  Description of Artificial Sequence: Synthetic peptide
  XENP024848 vlCDR2
KVSNRFS

SEQ ID NO: 40469 - protein, 9 aa, Artificial Sequence
  Description of Artificial Sequence: Synthetic peptide
  XENP024848 vlCDR3
FQGSHVPNT

SEQ ID NO: 40470 - protein, 249 aa, Artificial Sequence
  Description of Artificial Sequence: Synthetic polypeptide
  XENP024849 1C11_H3.218_L3_scFv(GKPGS)4
QVQLVQSGPELKKPGESVKVSCKASGYTFTHYGINWVRQPPGQGLEWMGWINTYTGEPYYAPGFTGRFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40471 - protein, 117 aa, Artificial Sequence
  Description of Artificial Sequence: Synthetic polypeptide
  VH of XENP024849
QVQLVQSGPELKKPGESVKVSCKASGYTFTHYGINWVRQPPGQGLEWMGWINTYTGEPYYAPGFTGRFVFSLDTSQDTAYLQINSLKAEDTAVYYCARDYYGSSPYWGQGTLVTVSS

SEQ ID NO: 40472 - protein, 112 aa, Artificial Sequence; identical to SEQ ID NO: 33009
  Description of Artificial Sequence: Synthetic polypeptide
  VL of XENP024849

SEQ ID NO: 40473 - protein, 5 aa, Artificial Sequence
  Description of Artificial Sequence: Synthetic peptide
  XENP024849 vhCDR1
HYGIN

SEQ ID NO: 40474 - protein, 17 aa, Artificial Sequence
  Description of Artificial Sequence: Synthetic peptide
  XENP024849 vhCDR2
WINTYTGEPYYAPGFTG

SEQ ID NO: 40475 - protein, 8 aa, Artificial Sequence
  Description of Artificial Sequence: Synthetic peptide
  XENP024849 vhCDR3
DYYGSSPY

SEQ ID NO: 40476 - protein, 16 aa, Artificial Sequence
  Description of Artificial Sequence: Synthetic peptide
  XENP024849 vlCDR1
KSSQSIVHSNGNTYLE

SEQ ID NO: 40477 - protein, 7 aa, Artificial Sequence
  Description of Artificial Sequence: Synthetic peptide
  XENP024849 vlCDR2
KVSNRFS

SEQ ID NO: 40478 - protein, 9 aa, Artificial Sequence
  Description of Artificial Sequence: Synthetic peptide
  XENP024849 vlCDR3
FQGSHVPNT

SEQ ID NO: 40479 - protein, 249 aa, Artificial Sequence
  Description of Artificial Sequence: Synthetic polypeptide
  XENP024850 1C11_H3.219_L3_scFv(GKPGS)4
QVQLVQSGSELKKPGESVKVSCKASGYTFTHYGINWVRQPPGQGLEWIGWINTYTGEPYYAPGFQERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40480 - protein, 117 aa, Artificial Sequence
  Description of Artificial Sequence: Synthetic polypeptide
  VH of XENP024850
QVQLVQSGSELKKPGESVKVSCKASGYTFTHYGINWVRQPPGQGLEWIGWINTYTGEPYYAPGFQERFVFSLDTSQSTAYLQINSLKAEDTAVYYCARDYYGSSPYWGQGTLVTVSS

SEQ ID NO: 40481 - protein, 112 aa, Artificial Sequence; identical to SEQ ID NO: 33009
  Description of Artificial Sequence: Synthetic polypeptide
  VL of XENP024850

SEQ ID NO: 40482 - protein, 5 aa, Artificial Sequence
  Description of Artificial Sequence: Synthetic peptide
  XENP024850 vhCDR1
HYGIN

SEQ ID NO: 40483 - protein, 17 aa, Artificial Sequence
  Description of Artificial Sequence: Synthetic peptide
  XENP024850 vhCDR2
WINTYTGEPYYAPGFQE

SEQ ID NO: 40484 - protein, 8 aa, Artificial Sequence
  Description of Artificial Sequence: Synthetic peptide
  XENP024850 vhCDR3
DYYGSSPY

SEQ ID NO: 40485 - protein, 16 aa, Artificial Sequence
  Description of Artificial Sequence: Synthetic peptide
  XENP024850 vlCDR1
KSSQSIVHSNGNTYLE

SEQ ID NO: 40486 - protein, 7 aa, Artificial Sequence
  Description of Artificial Sequence: Synthetic peptide
  XENP024850 vlCDR2
KVSNRFS

SEQ ID NO: 40487 - protein, 9 aa, Artificial Sequence
  Description of Artificial Sequence: Synthetic peptide
  XENP024850 vlCDR3
FQGSHVPNT

SEQ ID NO: 40488 - protein, 249 aa, Artificial Sequence
  Description of Artificial Sequence: Synthetic polypeptide
  XENP024851 1C11_H3.220_L3_scFv(GKPGS)4
QVQLVQSGSELKKPGESVKVSCKASGYTFTHYGINWVRQPPGQGLEWIGWINTYTGEPYYAPGFKERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40489 - protein, 117 aa, Artificial Sequence
  Description of Artificial Sequence: Synthetic polypeptide
  VH of XENP024851
QVQLVQSGSELKKPGESVKVSCKASGYTFTHYGINWVRQPPGQGLEWIGWINTYTGEPYYAPGFKERFVFSLDTSQSTAYLQINSLKAEDTAVYYCARDYYGSSPYWGQGTLVTVSS

SEQ ID NO: 40490 - protein, 112 aa, Artificial Sequence; identical to SEQ ID NO: 33009
  Description of Artificial Sequence: Synthetic polypeptide
  VL of XENP024851

SEQ ID NO: 40491 - protein, 5 aa, Artificial Sequence
  Description of Artificial Sequence: Synthetic peptide
  XENP024851 vhCDR1
HYGIN

SEQ ID NO: 40492 - protein, 17 aa, Artificial Sequence
  Description of Artificial Sequence: Synthetic peptide
  XENP024851 vhCDR2
WINTYTGEPYYAPGFKE

SEQ ID NO: 40493 - protein, 8 aa, Artificial Sequence
  Description of Artificial Sequence: Synthetic peptide
  XENP024851 vhCDR3
DYYGSSPY

SEQ ID NO: 40494 - protein, 16 aa, Artificial Sequence
  Description of Artificial Sequence: Synthetic peptide
  XENP024851 vlCDR1
KSSQSIVHSNGNTYLE

SEQ ID NO: 40495 - protein, 7 aa, Artificial Sequence
  Description of Artificial Sequence: Synthetic peptide
  XENP024851 vlCDR2
KVSNRFS

SEQ ID NO: 40496 - protein, 9 aa, Artificial Sequence
  Description of Artificial Sequence: Synthetic peptide
  XENP024851 vlCDR3
FQGSHVPNT

SEQ ID NO: 40497 - protein, 249 aa, Artificial Sequence
  Description of Artificial Sequence: Synthetic polypeptide
  XENP024852 1C11_H3.221_L3_scFv(GKPGS)4
EIQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40498 - protein, 117 aa, Artificial Sequence
  Description of Artificial Sequence: Synthetic polypeptide
  VH of XENP024852
EIQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 40499 - protein, 112 aa, Artificial Sequence; identical to SEQ ID NO: 33009
  Description of Artificial Sequence: Synthetic polypeptide
  VL of XENP024852

SEQ ID NO: 40500 - protein, 5 aa, Artificial Sequence
  Description of Artificial Sequence: Synthetic peptide
  XENP024852 vhCDR1
HYGIN

SEQ ID NO: 40501 - protein, 17 aa, Artificial Sequence
  Description of Artificial Sequence: Synthetic peptide
  XENP024852 vhCDR2
WINTYTGEPYYAPGFTG

SEQ ID NO: 40502 - protein, 8 aa, Artificial Sequence
  Description of Artificial Sequence: Synthetic peptide
  XENP024852 vhCDR3
DYYGSSPY

SEQ ID NO: 40503 - protein, 16 aa, Artificial Sequence
  Description of Artificial Sequence: Synthetic peptide
  XENP024852 vlCDR1
KSSQSIVHSNGNTYLE

SEQ ID NO: 40504 - protein, 7 aa, Artificial Sequence
  Description of Artificial Sequence: Synthetic peptide
  XENP024852 vlCDR2
KVSNRFS

SEQ ID NO: 40505 - protein, 9 aa, Artificial Sequence
  Description of Artificial Sequence: Synthetic peptide
  XENP024852 vlCDR3
FQGSHVPNT

SEQ ID NO: 40506 - protein, 249 aa, Artificial Sequence
  Description of Artificial Sequence: Synthetic polypeptide
  XENP024853 1C11[PD-1]_H3_L3.143_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDVATYYCFQGSHVPNTFGQGTKVEIK

SEQ ID NO: 40507 - protein, 117 aa, Artificial Sequence; identical to SEQ ID NO: 33034
  Description of Artificial Sequence: Synthetic polypeptide
  VH of XENP024853

SEQ ID NO: 40508 - protein, 112 aa, Artificial Sequence
  Description of Artificial Sequence: Synthetic polypeptide
  VL of XENP024853
DIVMTQSPDSLAVSLGERVTINCKASQSIVHSNGNTYLEWYQQKPGQPPKLLIYKVSNRFSGVPDRFSGSGSGTDFTLTISSVEAEDVATYYCFQGSHVPNTFGQGTKVEIK

SEQ ID NO: 40509 - protein, 5 aa, Artificial Sequence
  Description of Artificial Sequence: Synthetic peptide
  XENP024853 vhCDR1
HYGMN

SEQ ID NO: 40510 - protein, 17 aa, Artificial Sequence
  Description of Artificial Sequence: Synthetic peptide
  XENP024853 vhCDR2
WINTYTGEPTYADGFTG

SEQ ID NO: 40511 - protein, 8 aa, Artificial Sequence
  Description of Artificial Sequence: Synthetic peptide
  XENP024853 vhCDR3
DYYGSSPY

SEQ ID NO: 40512 - protein, 16 aa, Artificial Sequence
  Description of Artificial Sequence: Synthetic peptide
  XENP024853 vlCDR1
KASQSIVHSNGNTYLE

SEQ ID NO: 40513 - protein, 7 aa, Artificial Sequence
  Description of Artificial Sequence: Synthetic peptide
  XENP024853 vlCDR2
KVSNRFS

SEQ ID NO: 40514 - protein, 9 aa, Artificial Sequence
  Description of Artificial Sequence: Synthetic peptide
  XENP024853 vlCDR3
FQGSHVPNT

SEQ ID NO: 40515 - protein, 249 aa, Artificial Sequence
  Description of Artificial Sequence: Synthetic polypeptide
  XENP024854 1C11[PD-1]_H3_L3.144_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40516 - protein, 117 aa, Artificial Sequence; identical to SEQ ID NO: 33034
  Description of Artificial Sequence: Synthetic polypeptide
  VH of XENP024854

SEQ ID NO: 40517 - protein, 112 aa, Artificial Sequence
  Description of Artificial Sequence: Synthetic polypeptide
  VL of XENP024854
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40518 - protein, 5 aa, Artificial Sequence
  Description of Artificial Sequence: Synthetic peptide
  XENP024854 vhCDR1
HYGMN

SEQ ID NO: 40519 - protein, 17 aa, Artificial Sequence
  Description of Artificial Sequence: Synthetic peptide
  XENP024854 vhCDR2
WINTYTGEPTYADGFTG

SEQ ID NO: 40520 - protein, 8 aa, Artificial Sequence
  Description of Artificial Sequence: Synthetic peptide
  XENP024854 vhCDR3
DYYGSSPY

SEQ ID NO: 40521 - protein, 16 aa, Artificial Sequence
  Description of Artificial Sequence: Synthetic peptide
  XENP024854 vlCDR1
KASQSIVHSNGNTYLE

SEQ ID NO: 40522 - protein, 7 aa, Artificial Sequence
  Description of Artificial Sequence: Synthetic peptide
  XENP024854 vlCDR2
KVSNRFS

SEQ ID NO: 40523 - protein, 9 aa, Artificial Sequence
  Description of Artificial Sequence: Synthetic peptide
  XENP024854 vlCDR3
FQGSHVPNT

SEQ ID NO: 40524 - protein, 249 aa, Artificial Sequence
  Description of Artificial Sequence: Synthetic polypeptide
  XENP024855 1C11[PD-1]_H3_L3.145_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQSPKLLIYKVSNRFSGVPDRFSGSGSGTDFTLTISSVEAEDVATYYCFQGSHVPNTFGQGTKVEIK

SEQ ID NO: 40525 - protein, 117 aa, Artificial Sequence; identical to SEQ ID NO: 33034
  Description of Artificial Sequence: Synthetic polypeptide
  VH of XENP024855

SEQ ID NO: 40526 - protein, 112 aa, Artificial Sequence
  Description of Artificial Sequence: Synthetic polypeptide
  VL of XENP024855
DIVMTQSPDSLAVSLGERVTINCKASQSIVHSNGNTYLEWYQQKPGQSPKLLIYKVSNRFSGVPDRFSGSGSGTDFTLTISSVEAEDVATYYCFQGSHVPNTFGQGTKVEIK

SEQ ID NO: 40527 - protein, 5 aa, Artificial Sequence
  Description of Artificial Sequence: Synthetic peptide
  XENP024855 vhCDR1
HYGMN

SEQ ID NO: 40528 - protein, 17 aa, Artificial Sequence
  Description of Artificial Sequence: Synthetic peptide
  XENP024855 vhCDR2
WINTYTGEPTYADGFTG

SEQ ID NO: 40529 - protein, 8 aa, Artificial Sequence
  Description of Artificial Sequence: Synthetic peptide
  XENP024855 vhCDR3
DYYGSSPY

SEQ ID NO: 40530 - protein, 16 aa, Artificial Sequence
  Description of Artificial Sequence: Synthetic peptide
  XENP024855 vlCDR1
KASQSIVHSNGNTYLE

SEQ ID NO: 40531 - protein, 7 aa, Artificial Sequence
  Description of Artificial Sequence: Synthetic peptide
  XENP024855 vlCDR2
KVSNRFS

SEQ ID NO: 40532 - protein, 9 aa, Artificial Sequence
  Description of Artificial Sequence: Synthetic peptide
  XENP024855 vlCDR3
FQGSHVPNT

SEQ ID NO: 40533 - protein, 249 aa, Artificial Sequence
  Description of Artificial Sequence: Synthetic polypeptide
  XENP024856 1C11[PD-1]_H3_L3.146_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQSPKLLIYKVSNRFSGVPDRFSGSGSGTDFTLTISSVEAEDAATYYCFQGSHVPNTFGQGTKVEIK

SEQ ID NO: 40534 - protein, 117 aa, Artificial Sequence; identical to SEQ ID NO: 33034
  Description of Artificial Sequence: Synthetic polypeptide
  VH of XENP024856

SEQ ID NO: 40535 - protein, 112 aa, Artificial Sequence
  Description of Artificial Sequence: Synthetic polypeptide
  VL of XENP024856
DIVMTQSPDSLAVSLGERVTINCKASQSIVHSNGNTYLEWYQQKPGQSPKLLIYKVSNRFSGVPDRFSGSGSGTDFTLTISSVEAEDAATYYCFQGSHVPNTFGQGTKVEIK

SEQ ID NO: 40536 - protein, 5 aa, Artificial Sequence
  Description of Artificial Sequence: Synthetic peptide
  XENP024856 vhCDR1
HYGMN

SEQ ID NO: 40537 - protein, 17 aa, Artificial Sequence
  Description of Artificial Sequence: Synthetic peptide
  XENP024856 vhCDR2
WINTYTGEPTYADGFTG

SEQ ID NO: 40538 - protein, 8 aa, Artificial Sequence
  Description of Artificial Sequence: Synthetic peptide
  XENP024856 vhCDR3
DYYGSSPY

SEQ ID NO: 40539 - protein, 16 aa, Artificial Sequence
  Description of Artificial Sequence: Synthetic peptide
  XENP024856 vlCDR1
KASQSIVHSNGNTYLE

SEQ ID NO: 40540 - protein, 7 aa, Artificial Sequence
  Description of Artificial Sequence: Synthetic peptide
  XENP024856 vlCDR2
KVSNRFS

SEQ ID NO: 40541 - protein, 9 aa, Artificial Sequence
  Description of Artificial Sequence: Synthetic peptide
  XENP024856 vlCDR3
FQGSHVPNT

SEQ ID NO: 40542 - protein, 249 aa, Artificial Sequence
  Description of Artificial Sequence: Synthetic polypeptide
  XENP024857 1C11[PD-1]_H3_L3.147_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDVATYYCFQGSHVPNTFGQGTKVEIK

SEQ ID NO: 40543 - protein, 117 aa, Artificial Sequence; identical to SEQ ID NO: 33034
  Description of Artificial Sequence: Synthetic polypeptide
  VH of XENP024857

SEQ ID NO: 40544 - protein, 112 aa, Artificial Sequence
  Description of Artificial Sequence: Synthetic polypeptide
  VL of XENP024857
DIVMTQSPDSLAVSLGERVTINCKASQSIVHSNGNTYLEWYQQKPGQAPKLLIYKVSNRFSGVPDRFSGSGSGTDFTLTISSVEAEDVATYYCFQGSHVPNTFGQGTKVEIK

SEQ ID NO: 40545 - protein, 5 aa, Artificial Sequence
  Description of Artificial Sequence: Synthetic peptide
  XENP024857 vhCDR1
HYGMN

SEQ ID NO: 40546 - protein, 17 aa, Artificial Sequence
  Description of Artificial Sequence: Synthetic peptide
  XENP024857 vhCDR2
WINTYTGEPTYADGFTG

SEQ ID NO: 40547 - protein, 8 aa, Artificial Sequence
  Description of Artificial Sequence: Synthetic peptide
  XENP024857 vhCDR3
DYYGSSPY

SEQ ID NO: 40548 - protein, 16 aa, Artificial Sequence
  Description of Artificial Sequence: Synthetic peptide
  XENP024857 vlCDR1
KASQSIVHSNGNTYLE

SEQ ID NO: 40549 - protein, 7 aa, Artificial Sequence
  Description of Artificial Sequence: Synthetic peptide
  XENP024857 vlCDR2
KVSNRFS

SEQ ID NO: 40550 - protein, 9 aa, Artificial Sequence
  Description of Artificial Sequence: Synthetic peptide
  XENP024857 vlCDR3
FQGSHVPNT

SEQ ID NO: 40551 - protein, 249 aa, Artificial Sequence
  Description of Artificial Sequence: Synthetic polypeptide
  XENP024858 1C11[PD-1]_H3_L3.148_scFv(GKPGS)4
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 40552 - protein, 117 aa, Artificial Sequence; identical to SEQ ID NO: 33034
  Description of Artificial Sequence: Synthetic polypeptide
  VH of XENP024858

SEQ ID NO: 40553 - protein, 112 aa, Artificial Sequence
  Description of Artificial Sequence: Synthetic polypeptide
  VL of XENP024858
DIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 40554 - protein, 5 aa, Artificial Sequence
  Description of Artificial Sequence: Synthetic peptide
  XENP024858 vhCDR1
HYGMN

SEQ ID NO: 40555 - protein, 17 aa, Artificial Sequence
  Description of Artificial Sequence: Synthetic peptide
  XENP024858 vhCDR2
WINTYTGEPTYADGFTG

SEQ ID NO: 40556 - protein, 8 aa, Artificial Sequence
  Description of Artificial Sequence: Synthetic peptide
  XENP024858 vhCDR3
DYYGSSPY

SEQ ID NO: 40557 - protein, 16 aa, Artificial Sequence
  Description of Artificial Sequence: Synthetic peptide
  XENP024858 vlCDR1
KASQSIVHSNGNTYLE

SEQ ID NO: 40558 - protein, 7 aa, Artificial Sequence
  Description of Artificial Sequence: Synthetic peptide
  XENP024858 vlCDR2
KVSNRFS

SEQ ID NO: 40559 - protein, 9 aa, Artificial Sequence
  Description of Artificial Sequence: Synthetic peptide
  XENP024858 vlCDR3
FQGSHVPNT

SEQ ID NO: 40560 - protein, 249 aa, Artificial Sequence
  Description of Artificial Sequence: Synthetic polypeptide
  XENP025295 1C11_H3.222_L3_scFv(GKPGS)4
QVQLVQSGPELKKPGESVKVSCKASGYTFTHYGINWVRQPPGQGLEWMGWINTYTGEPTYAPGFTGRFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40561 - protein, 117 aa, Artificial Sequence
  Description of Artificial Sequence: Synthetic polypeptide
  VH of XENP025295
QVQLVQSGPELKKPGESVKVSCKASGYTFTHYGINWVRQPPGQGLEWMGWINTYTGEPTYAPGFTGRFVFSIDTSQSTAYLQINSLKAEDTAVYYCARDYYGSSPYWGQGTLVTVSS

SEQ ID NO: 40562 - protein, 112 aa, Artificial Sequence; identical to SEQ ID NO: 33009
  Description of Artificial Sequence: Synthetic polypeptide
  VL of XENP025295

SEQ ID NO: 40563 - protein, 5 aa, Artificial Sequence
  Description of Artificial Sequence: Synthetic peptide
  XENP025295 vhCDR1
HYGIN

SEQ ID NO: 40564 - protein, 17 aa, Artificial Sequence
  Description of Artificial Sequence: Synthetic peptide
  XENP025295 vhCDR2
WINTYTGEPTYAPGFTG

SEQ ID NO: 40565 - protein, 8 aa, Artificial Sequence
  Description of Artificial Sequence: Synthetic peptide
  XENP025295 vhCDR3
DYYGSSPY

SEQ ID NO: 40566 - protein, 16 aa, Artificial Sequence
  Description of Artificial Sequence: Synthetic peptide
  XENP025295 vlCDR1
KSSQSIVHSNGNTYLE

SEQ ID NO: 40567 - protein, 7 aa, Artificial Sequence
  Description of Artificial Sequence: Synthetic peptide
  XENP025295 vlCDR2
KVSNRFS

SEQ ID NO: 40568 - protein, 9 aa, Artificial Sequence
  Description of Artificial Sequence: Synthetic peptide
  XENP025295 vlCDR3
FQGSHVPNT

SEQ ID NO: 40569 - protein, 249 aa, Artificial Sequence
  Description of Artificial Sequence: Synthetic polypeptide
  XENP025296 1C11_H3.223_L3_scFv(GKPGS)4
QVQLVQSGPELKKPGESVKVSCKASGYTFTHYGINWVRQPPGQGLEWMGWINTYTGEPYYAPGFTERFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40570 - protein, 117 aa, Artificial Sequence
  Description of Artificial Sequence: Synthetic polypeptide
  VH of XENP025296
QVQLVQSGPELKKPGESVKVSCKASGYTFTHYGINWVRQPPGQGLEWMGWINTYTGEPYYAPGFTERFVFSIDTSQSTAYLQINSLKAEDTAVYYCARDYYGSSPYWGQGTLVTVSS

SEQ ID NO: 40571 - protein, 112 aa, Artificial Sequence; identical to SEQ ID NO: 33009
  Description of Artificial Sequence: Synthetic polypeptide
  VL of XENP025296

SEQ ID NO: 40572 - protein, 5 aa, Artificial Sequence
  Description of Artificial Sequence: Synthetic peptide
  XENP025296 vhCDR1
HYGIN

SEQ ID NO: 40573 - protein, 17 aa, Artificial Sequence
  Description of Artificial Sequence: Synthetic peptide
  XENP025296 vhCDR2
WINTYTGEPYYAPGFTE

SEQ ID NO: 40574 - protein, 8 aa, Artificial Sequence
  Description of Artificial Sequence: Synthetic peptide
  XENP025296 vhCDR3
DYYGSSPY

SEQ ID NO: 40575 - protein, 16 aa, Artificial Sequence
  Description of Artificial Sequence: Synthetic peptide
  XENP025296 vlCDR1
KSSQSIVHSNGNTYLE

SEQ ID NO: 40576 - protein, 7 aa, Artificial Sequence
  Description of Artificial Sequence: Synthetic peptide
  XENP025296 vlCDR2
KVSNRFS

SEQ ID NO: 40577 - protein, 9 aa, Artificial Sequence
  Description of Artificial Sequence: Synthetic peptide
  XENP025296 vlCDR3
FQGSHVPNT

SEQ ID NO: 40578 - protein, 249 aa, Artificial Sequence
  Description of Artificial Sequence: Synthetic polypeptide
  XENP025301 1C11_H3.224_L3_scFv(GKPGS)4
QVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40579 - protein, 117 aa, Artificial Sequence
  Description of Artificial Sequence: Synthetic polypeptide
  VH of XENP025301
QVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSS

SEQ ID NO: 40580 - protein, 112 aa, Artificial Sequence; identical to SEQ ID NO: 33009
  Description of Artificial Sequence: Synthetic polypeptide
  VL of XENP025301

SEQ ID NO: 40581 - protein, 5 aa, Artificial Sequence
  Description of Artificial Sequence: Synthetic peptide
  XENP025301 vhCDR1
HYGIN

SEQ ID NO: 40582 - protein, 17 aa, Artificial Sequence
  Description of Artificial Sequence: Synthetic peptide
  XENP025301 vhCDR2
WINTYTGEPYYAPGFQE

SEQ ID NO: 40583 - protein, 8 aa, Artificial Sequence
  Description of Artificial Sequence: Synthetic peptide
  XENP025301 vhCDR3
DYYGSSPY

SEQ ID NO: 40584 - protein, 16 aa, Artificial Sequence
  Description of Artificial Sequence: Synthetic peptide
  XENP025301 vlCDR1
KSSQSIVHSNGNTYLE

SEQ ID NO: 40585 - protein, 7 aa, Artificial Sequence
  Description of Artificial Sequence: Synthetic peptide
  XENP025301 vlCDR2
KVSNRFS

SEQ ID NO: 40586 - protein, 9 aa, Artificial Sequence
  Description of Artificial Sequence: Synthetic peptide
  XENP025301 vlCDR3
FQGSHVPNT

SEQ ID NO: 40587 - protein, 249 aa, Artificial Sequence
  Description of Artificial Sequence: Synthetic polypeptide
  XENP025302 1C11_H3.225_L3_scFv(GKPGS)4
QVQLVQSGPELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40588 - protein, 117 aa, Artificial Sequence
  Description of Artificial Sequence: Synthetic polypeptide
  VH of XENP025302
QVQLVQSGPELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSS

SEQ ID NO: 40589 - protein, 112 aa, Artificial Sequence; identical to SEQ ID NO: 33009
  Description of Artificial Sequence: Synthetic polypeptide
  VL of XENP025302

SEQ ID NO: 40590 - protein, 5 aa, Artificial Sequence
  Description of Artificial Sequence: Synthetic peptide
  XENP025302 vhCDR1
HYGIN

SEQ ID NO: 40591 - protein, 17 aa, Artificial Sequence
  Description of Artificial Sequence: Synthetic peptide
  XENP025302 vhCDR2
WINTYTGEPYYAPGFTE

SEQ ID NO: 40592 - protein, 8 aa, Artificial Sequence
  Description of Artificial Sequence: Synthetic peptide
  XENP025302 vhCDR3
DYYGSSPY

SEQ ID NO: 40593 - protein, 16 aa, Artificial Sequence
  Description of Artificial Sequence: Synthetic peptide
  XENP025302 vlCDR1
KSSQSIVHSNGNTYLE

SEQ ID NO: 40594 - protein, 7 aa, Artificial Sequence
  Description of Artificial Sequence: Synthetic peptide
  XENP025302 vlCDR2
KVSNRFS

SEQ ID NO: 40595 - protein, 9 aa, Artificial Sequence
  Description of Artificial Sequence: Synthetic peptide
  XENP025302 vlCDR3
FQGSHVPNT

SEQ ID NO: 40596 - protein, 249 aa, Artificial Sequence
  Description of Artificial Sequence: Synthetic polypeptide
  XENP025303 1C11_H3.226_L3_scFv(GKPGS)4
QVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40597 - protein, 117 aa, Artificial Sequence
  Description of Artificial Sequence: Synthetic polypeptide
  VH of XENP025303
QVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSS

SEQ ID NO: 40598 - protein, 112 aa, Artificial Sequence; identical to SEQ ID NO: 33009
  Description of Artificial Sequence: Synthetic polypeptide
  VL of XENP025303

SEQ ID NO: 40599 - protein, 5 aa, Artificial Sequence
  Description of Artificial Sequence: Synthetic peptide
  XENP025303 vhCDR1
HYGIN

SEQ ID NO: 40600 - protein, 17 aa, Artificial Sequence
  Description of Artificial Sequence: Synthetic peptide
  XENP025303 vhCDR2
WINTYTGEPYYAPGFQE

SEQ ID NO: 40601 - protein, 8 aa, Artificial Sequence
  Description of Artificial Sequence: Synthetic peptide
  XENP025303 vhCDR3
DYYGSSPY

SEQ ID NO: 40602 - protein, 16 aa, Artificial Sequence
  Description of Artificial Sequence: Synthetic peptide
  XENP025303 vlCDR1
KSSQSIVHSNGNTYLE

SEQ ID NO: 40603 - protein, 7 aa, Artificial Sequence
  Description of Artificial Sequence: Synthetic peptide
  XENP025303 vlCDR2
KVSNRFS

SEQ ID NO: 40604 - protein, 9 aa, Artificial Sequence
  Description of Artificial Sequence: Synthetic peptide
  XENP025303 vlCDR3
FQGSHVPNT

SEQ ID NO: 40605 - protein, 249 aa, Artificial Sequence
  Description of Artificial Sequence: Synthetic polypeptide
  XENP025304 1C11_H3.227_L3_scFv(GKPGS)4
EVQLVQSGPELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40606 - protein, 117 aa, Artificial Sequence
  Description of Artificial Sequence: Synthetic polypeptide
  VH of XENP025304
EVQLVQSGPELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSS

SEQ ID NO: 40607 - protein, 112 aa, Artificial Sequence; identical to SEQ ID NO: 33009
  Description of Artificial Sequence: Synthetic polypeptide
  VL of XENP025304

SEQ ID NO: 40608 - protein, 5 aa, Artificial Sequence
  Description of Artificial Sequence: Synthetic peptide
  XENP025304 vhCDR1
HYGIN

SEQ ID NO: 40609 - protein, 17 aa, Artificial Sequence
  Description of Artificial Sequence: Synthetic peptide
  XENP025304 vhCDR2
WINTYTGEPYYAPGFTE

SEQ ID NO: 40610 - protein, 8 aa, Artificial Sequence
  Description of Artificial Sequence: Synthetic peptide
  XENP025304 vhCDR3
DYYGSSPY

SEQ ID NO: 40611 - protein, 16 aa, Artificial Sequence
  Description of Artificial Sequence: Synthetic peptide
  XENP025304 vlCDR1
KSSQSIVHSNGNTYLE

SEQ ID NO: 40612 - protein, 7 aa, Artificial Sequence
  Description of Artificial Sequence: Synthetic peptide
  XENP025304 vlCDR2
KVSNRFS

SEQ ID NO: 40613 - protein, 9 aa, Artificial Sequence
  Description of Artificial Sequence: Synthetic peptide
  XENP025304 vlCDR3
FQGSHVPNT

SEQ ID NO: 40614 - protein, 249 aa, Artificial Sequence
  Description of Artificial Sequence: Synthetic polypeptide
  XENP025305 1C11_H3.228_L3_scFv(GKPGS)4
EVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40615 - protein, 117 aa, Artificial Sequence
  Description of Artificial Sequence: Synthetic polypeptide
  VH of XENP025305
EVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSS

SEQ ID NO: 40616 - protein, 112 aa, Artificial Sequence; identical to SEQ ID NO: 33009
  Description of Artificial Sequence: Synthetic polypeptide
  VL of XENP025305

SEQ ID NO: 40617 - protein, 5 aa, Artificial Sequence
  Description of Artificial Sequence: Synthetic peptide
  XENP025305 vhCDR1
HYGIN

SEQ ID NO: 40618 - protein, 17 aa, Artificial Sequence
  Description of Artificial Sequence: Synthetic peptide
  XENP025305 vhCDR2
WINTYTGEPYYAPGFQE

SEQ ID NO: 40619 - protein, 8 aa, Artificial Sequence
  Description of Artificial Sequence: Synthetic peptide
  XENP025305 vhCDR3
DYYGSSPY

SEQ ID NO: 40620 - protein, 16 aa, Artificial Sequence
  Description of Artificial Sequence: Synthetic peptide
  XENP025305 vlCDR1
KSSQSIVHSNGNTYLE

SEQ ID NO: 40621 - protein, 7 aa, Artificial Sequence
  Description of Artificial Sequence: Synthetic peptide
  XENP025305 vlCDR2
KVSNRFS

SEQ ID NO: 40622 - protein, 9 aa, Artificial Sequence
  Description of Artificial Sequence: Synthetic peptide
  XENP025305 vlCDR3
FQGSHVPNT

SEQ ID NO: 40623 - protein, 249 aa, Artificial Sequence
  Description of Artificial Sequence: Synthetic polypeptide
  XENP025306 1C11_H3.229_L3_scFv(GKPGS)4
QVQLVQSGSELKKPGESVKVSCKASGYTFTHYGINWVRQPPGQGLEWMGWINTYTGEPYYAPGFQERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40624 - protein, 117 aa, Artificial Sequence
  Description of Artificial Sequence: Synthetic polypeptide
  VH of XENP025306
QVQLVQSGSELKKPGESVKVSCKASGYTFTHYGINWVRQPPGQGLEWMGWINTYTGEPYYAPGFQERFVFSLDTSQSTAYLQINSLKAEDTAVYYCARDYYGSSPYWGQGTLVTVSS

SEQ ID NO: 40625 - protein, 112 aa, Artificial Sequence; identical to SEQ ID NO: 33009
  Description of Artificial Sequence: Synthetic polypeptide
  VL of XENP025306

SEQ ID NO: 40626 - protein, 5 aa, Artificial Sequence
  Description of Artificial Sequence: Synthetic peptide
  XENP025306 vhCDR1
HYGIN

SEQ ID NO: 40627 - protein, 17 aa, Artificial Sequence
  Description of Artificial Sequence: Synthetic peptide
  XENP025306 vhCDR2
WINTYTGEPYYAPGFQE

SEQ ID NO: 40628 - protein, 8 aa, Artificial Sequence
  Description of Artificial Sequence: Synthetic peptide
  XENP025306 vhCDR3
DYYGSSPY

SEQ ID NO: 40629 - protein, 16 aa, Artificial Sequence
  Description of Artificial Sequence: Synthetic peptide
  XENP025306 vlCDR1
KSSQSIVHSNGNTYLE

SEQ ID NO: 40630 - protein, 7 aa, Artificial Sequence
  Description of Artificial Sequence: Synthetic peptide
  XENP025306 vlCDR2
KVSNRFS

SEQ ID NO: 40631 - protein, 9 aa, Artificial Sequence
  Description of Artificial Sequence: Synthetic peptide
  XENP025306 vlCDR3
FQGSHVPNT

SEQ ID NO: 40632 - protein, 249 aa, Artificial Sequence
  Description of Artificial Sequence: Synthetic polypeptide
  XENP025307 1C11_H3.230_L3_scFv(GKPGS)4
QVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40633 - protein, 117 aa, Artificial Sequence
  Description of Artificial Sequence: Synthetic polypeptide
  VH of XENP025307
QVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSS

SEQ ID NO: 40634 - protein, 112 aa, Artificial Sequence; identical to SEQ ID NO: 33009
  Description of Artificial Sequence: Synthetic polypeptide
  VL of XENP025307

SEQ ID NO: 40635 - protein, 5 aa, Artificial Sequence
  Description of Artificial Sequence: Synthetic peptide
  XENP025307 vhCDR1
HYGIN

SEQ ID NO: 40636 - protein, 17 aa, Artificial Sequence
  Description of Artificial Sequence: Synthetic peptide
  XENP025307 vhCDR2
WINTYTGEPYYAPGFQE

SEQ ID NO: 40637 - protein, 8 aa, Artificial Sequence
  Description of Artificial Sequence: Synthetic peptide
  XENP025307 vhCDR3
DYYGSSPY

SEQ ID NO: 40638 - protein, 16 aa, Artificial Sequence
  Description of Artificial Sequence: Synthetic peptide
  XENP025307 vlCDR1
KSSQSIVHSNGNTYLE

SEQ ID NO: 40639 - protein, 7 aa, Artificial Sequence
  Description of Artificial Sequence: Synthetic peptide
  XENP025307 vlCDR2
KVSNRFS

SEQ ID NO: 40640 - protein, 9 aa, Artificial Sequence
  Description of Artificial Sequence: Synthetic peptide
  XENP025307 vlCDR3
FQGSHVPNT

SEQ ID NO: 40641 - protein, 249 aa, Artificial Sequence
  Description of Artificial Sequence: Synthetic polypeptide
  XENP025308 1C11_H3.231_L3_scFv(GKPGS)4
QVQLVQSGSELKKPGESVKVSCKASGYTFTHYGINWVRQPPGQGLEWMGWINTYTGEPTYAPGFTGRFVFSLDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40642 - protein, 117 aa, Artificial Sequence
  Description of Artificial Sequence: Synthetic polypeptide
  VH of XENP025308
QVQLVQSGSELKKPGESVKVSCKASGYTFTHYGINWVRQPPGQGLEWMGWINTYTGEPTYAPGFTGRFVFSLDTSQSTAYLQISSLKAEDTAVYYCARDYYGSSPYWGQGTLVTVSS

SEQ ID NO: 40643 - protein, 112 aa, Artificial Sequence; identical to SEQ ID NO: 33009
  Description of Artificial Sequence: Synthetic polypeptide
  VL of XENP025308

SEQ ID NO: 40644 - protein, 5 aa, Artificial Sequence
  Description of Artificial Sequence: Synthetic peptide
  XENP025308 vhCDR1
HYGIN

SEQ ID NO: 40645 - protein, 17 aa, Artificial Sequence
  Description of Artificial Sequence: Synthetic peptide
  XENP025308 vhCDR2
WINTYTGEPTYAPGFTG

SEQ ID NO: 40646 - protein, 8 aa, Artificial Sequence
  Description of Artificial Sequence: Synthetic peptide
  XENP025308 vhCDR3
DYYGSSPY

SEQ ID NO: 40647 - protein, 16 aa, Artificial Sequence
  Description of Artificial Sequence: Synthetic peptide
  XENP025308 vlCDR1
KSSQSIVHSNGNTYLE

SEQ ID NO: 40648 - protein, 7 aa, Artificial Sequence
  Description of Artificial Sequence: Synthetic peptide
  XENP025308 vlCDR2
KVSNRFS

SEQ ID NO: 40649 - protein, 9 aa, Artificial Sequence
  Description of Artificial Sequence: Synthetic peptide
  XENP025308 vlCDR3
FQGSHVPNT

SEQ ID NO: 40650 - protein, 249 aa, Artificial Sequence
  Description of Artificial Sequence: Synthetic polypeptide
  XENP025309 1C11_H3.232_L3_scFv(GKPGS)4
QVQLVQSGSELKKPGESVKVSCKASGYTFTHYGINWVRQPPGQGLEWMGWINTYTGEPTYAPGFTGRFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40651 - protein, 117 aa, Artificial Sequence
  Description of Artificial Sequence: Synthetic polypeptide
  VH of XENP025309
QVQLVQSGSELKKPGESVKVSCKASGYTFTHYGINWVRQPPGQGLEWMGWINTYTGEPTYAPGFTGRFVFSLDTSQDTAYLQINSLKAEDTAVYYCARDYYGSSPYWGQGTLVTVSS

SEQ ID NO: 40652 - protein, 112 aa, Artificial Sequence; identical to SEQ ID NO: 33009
  Description of Artificial Sequence: Synthetic polypeptide
  VL of XENP025309

SEQ ID NO: 40653 - protein, 5 aa, Artificial Sequence
  Description of Artificial Sequence: Synthetic peptide
  XENP025309 vhCDR1
HYGIN

SEQ ID NO: 40654 - protein, 17 aa, Artificial Sequence
  Description of Artificial Sequence: Synthetic peptide
  XENP025309 vhCDR2
WINTYTGEPTYAPGFTG

SEQ ID NO: 40655 - protein, 8 aa, Artificial Sequence
  Description of Artificial Sequence: Synthetic peptide
  XENP025309 vhCDR3
DYYGSSPY

SEQ ID NO: 40656 - protein, 16 aa, Artificial Sequence
  Description of Artificial Sequence: Synthetic peptide
  XENP025309 vlCDR1
KSSQSIVHSNGNTYLE

SEQ ID NO: 40657 - protein, 7 aa, Artificial Sequence
  Description of Artificial Sequence: Synthetic peptide
  XENP025309 vlCDR2
KVSNRFS

SEQ ID NO: 40658 - protein, 9 aa, Artificial Sequence
  Description of Artificial Sequence: Synthetic peptide
  XENP025309 vlCDR3
FQGSHVPNT

SEQ ID NO: 40659 - protein, 249 aa, Artificial Sequence
  Description of Artificial Sequence: Synthetic polypeptide
  XENP025310 1C11_H3.233_L3_scFv(GKPGS)4
EVQLVQSGSELKKPGESVKVSCKASGYTFTHYGINWVRQPPGQGLEWMGWINTYTGEPYYAPGFQERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40660 - protein, 117 aa, Artificial Sequence
  Description of Artificial Sequence: Synthetic polypeptide
  VH of XENP025310
EVQLVQSGSELKKPGESVKVSCKASGYTFTHYGINWVRQPPGQGLEWMGWINTYTGEPYYAPGFQERFVFSLDTSQSTAYLQINSLKAEDTAVYYCARDYYGSSPYWGQGTLVTVSS

SEQ ID NO: 40661 - protein, 112 aa, Artificial Sequence; identical to SEQ ID NO: 33009
  Description of Artificial Sequence: Synthetic polypeptide
  VL of XENP025310

SEQ ID NO: 40662 - protein, 5 aa, Artificial Sequence
  Description of Artificial Sequence: Synthetic peptide
  XENP025310 vhCDR1
HYGIN

SEQ ID NO: 40663 - protein, 17 aa, Artificial Sequence
  Description of Artificial Sequence: Synthetic peptide
  XENP025310 vhCDR2
WINTYTGEPYYAPGFQE

SEQ ID NO: 40664 - protein, 8 aa, Artificial Sequence
  Description of Artificial Sequence: Synthetic peptide
  XENP025310 vhCDR3
DYYGSSPY

SEQ ID NO: 40665 - protein, 16 aa, Artificial Sequence
  Description of Artificial Sequence: Synthetic peptide
  XENP025310 vlCDR1
KSSQSIVHSNGNTYLE

SEQ ID NO: 40666 - protein, 7 aa, Artificial Sequence
  Description of Artificial Sequence: Synthetic peptide
  XENP025310 vlCDR2
KVSNRFS

SEQ ID NO: 40667 - protein, 9 aa, Artificial Sequence
  Description of Artificial Sequence: Synthetic peptide
  XENP025310 vlCDR3
FQGSHVPNT

SEQ ID NO: 40668 - protein, 249 aa, Artificial Sequence
  Description of Artificial Sequence: Synthetic polypeptide
  XENP025311 1C11_H3.234_L3_scFv(GKPGS)4
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40669 - protein, 117 aa, Artificial Sequence
  Description of Artificial Sequence: Synthetic polypeptide
  VH of XENP025311
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSS

SEQ ID NO: 40670 - protein, 112 aa, Artificial Sequence; identical to SEQ ID NO: 33009
  Description of Artificial Sequence: Synthetic polypeptide
  VL of XENP025311

SEQ ID NO: 40671 - protein, 5 aa, Artificial Sequence
  Description of Artificial Sequence: Synthetic peptide
  XENP025311 vhCDR1
HYGIN

SEQ ID NO: 40672 - protein, 17 aa, Artificial Sequence
  Description of Artificial Sequence: Synthetic peptide
  XENP025311 vhCDR2
WINTYTGEPYYAPGFQE

SEQ ID NO: 40673 - protein, 8 aa, Artificial Sequence
  Description of Artificial Sequence: Synthetic peptide
  XENP025311 vhCDR3
DYYGSSPY

SEQ ID NO: 40674 - protein, 16 aa, Artificial Sequence
  Description of Artificial Sequence: Synthetic peptide
  XENP025311 vlCDR1
KSSQSIVHSNGNTYLE

SEQ ID NO: 40675 - protein, 7 aa, Artificial Sequence
  Description of Artificial Sequence: Synthetic peptide
  XENP025311 vlCDR2
KVSNRFS

SEQ ID NO: 40676 - protein, 9 aa, Artificial Sequence
  Description of Artificial Sequence: Synthetic peptide
  XENP025311 vlCDR3
FQGSHVPNT

SEQ ID NO: 40677 - protein, 249 aa, Artificial Sequence
  Description of Artificial Sequence: Synthetic polypeptide
  XENP025312 1C11_H3.235_L3_scFv(GKPGS)4
EVQLVQSGSELKKPGESVKVSCKASGYTFTHYGINWVRQPPGQGLEWMGWINTYTGEPTYAPGFTGRFVFSLDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40678 - protein, 117 aa, Artificial Sequence
  Description of Artificial Sequence: Synthetic polypeptide
  VH of XENP025312
EVQLVQSGSELKKPGESVKVSCKASGYTFTHYGINWVRQPPGQGLEWMGWINTYTGEPTYAPGFTGRFVFSLDTSQSTAYLQISSLKAEDTAVYYCARDYYGSSPYWGQGTLVTVSS

SEQ ID NO: 40679 - protein, 112 aa, Artificial Sequence; identical to SEQ ID NO: 33009
  Description of Artificial Sequence: Synthetic polypeptide
  VL of XENP025312

SEQ ID NO: 40680 - protein, 5 aa, Artificial Sequence
  Description of Artificial Sequence: Synthetic peptide
  XENP025312 vhCDR1
HYGIN

SEQ ID NO: 40681 - protein, 17 aa, Artificial Sequence
  Description of Artificial Sequence: Synthetic peptide
  XENP025312 vhCDR2
WINTYTGEPTYAPGFTG

SEQ ID NO: 40682 - protein, 8 aa, Artificial Sequence
  Description of Artificial Sequence: Synthetic peptide
  XENP025312 vhCDR3
DYYGSSPY

SEQ ID NO: 40683 - protein, 16 aa, Artificial Sequence
  Description of Artificial Sequence: Synthetic peptide
  XENP025312 vlCDR1
KSSQSIVHSNGNTYLE

SEQ ID NO: 40684 - protein, 7 aa, Artificial Sequence
  Description of Artificial Sequence: Synthetic peptide
  XENP025312 vlCDR2
KVSNRFS

SEQ ID NO: 40685 - protein, 9 aa, Artificial Sequence
  Description of Artificial Sequence: Synthetic peptide
  XENP025312 vlCDR3
FQGSHVPNT

SEQ ID NO: 40686 - protein, 249 aa, Artificial Sequence
  Description of Artificial Sequence: Synthetic polypeptide
  XENP025313 1C11_H3.236_L3_scFv(GKPGS)4
EVQLVQSGSELKKPGESVKVSCKASGYTFTHYGINWVRQPPGQGLEWMGWINTYTGEPTYAPGFTGRFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40687 - protein, 117 aa, Artificial Sequence
  Description of Artificial Sequence: Synthetic polypeptide
  VH of XENP025313
EVQLVQSGSELKKPGESVKVSCKASGYTFTHYGINWVRQPPGQGLEWMGWINTYTGEPTYAPGFTGRFVFSLDTSQDTAYLQINSLKAEDTAVYYCARDYYGSSPYWGQGTLVTVSS

SEQ ID NO: 40688 - protein, 112 aa, Artificial Sequence; identical to SEQ ID NO: 33009
  Description of Artificial Sequence: Synthetic polypeptide
  VL of XENP025313

SEQ ID NO: 40689 - protein, 5 aa, Artificial Sequence
  Description of Artificial Sequence: Synthetic peptide
  XENP025313 vhCDR1
HYGIN

SEQ ID NO: 40690 - protein, 17 aa, Artificial Sequence
  Description of Artificial Sequence: Synthetic peptide
  XENP025313 vhCDR2
WINTYTGEPTYAPGFTG

SEQ ID NO: 40691 - protein, 8 aa, Artificial Sequence
  Description of Artificial Sequence: Synthetic peptide
  XENP025313 vhCDR3
DYYGSSPY

SEQ ID NO: 40692 - protein, 16 aa, Artificial Sequence
  Description of Artificial Sequence: Synthetic peptide
  XENP025313 vlCDR1
KSSQSIVHSNGNTYLE

SEQ ID NO: 40693 - protein, 7 aa, Artificial Sequence
  Description of Artificial Sequence: Synthetic peptide
  XENP025313 vlCDR2
KVSNRFS

SEQ ID NO: 40694 - protein, 9 aa, Artificial Sequence
  Description of Artificial Sequence: Synthetic peptide
  XENP025313 vlCDR3
FQGSHVPNT

SEQ ID NO: 40695 - protein, 249 aa, Artificial Sequence
  Description of Artificial Sequence: Synthetic polypeptide
  XENP025314 1C11_H3.237_L3_scFv(GKPGS)4
QVQLVQSGSELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40696 - protein, 117 aa, Artificial Sequence
  Description of Artificial Sequence: Synthetic polypeptide
  VH of XENP025314
QVQLVQSGSELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSS

SEQ ID NO: 40697 - protein, 112 aa, Artificial Sequence; identical to SEQ ID NO: 33009
  Description of Artificial Sequence: Synthetic polypeptide
  VL of XENP025314

SEQ ID NO: 40698 - protein, 5 aa, Artificial Sequence
  Description of Artificial Sequence: Synthetic peptide
  XENP025314 vhCDR1
HYGIN

SEQ ID NO: 40699 - protein, 17 aa, Artificial Sequence
  Description of Artificial Sequence: Synthetic peptide
  XENP025314 vhCDR2
WINTYTGEPYYAPGFTE

SEQ ID NO: 40700 - protein, 8 aa, Artificial Sequence
  Description of Artificial Sequence: Synthetic peptide
  XENP025314 vhCDR3
DYYGSSPY

SEQ ID NO: 40701 - protein, 16 aa, Artificial Sequence
  Description of Artificial Sequence: Synthetic peptide
  XENP025314 vlCDR1
KSSQSIVHSNGNTYLE

SEQ ID NO: 40702 - protein, 7 aa, Artificial Sequence
  Description of Artificial Sequence: Synthetic peptide
  XENP025314 vlCDR2
KVSNRFS

SEQ ID NO: 40703 - protein, 9 aa, Artificial Sequence
  Description of Artificial Sequence: Synthetic peptide
  XENP025314 vlCDR3
FQGSHVPNT

SEQ ID NO: 40704 - protein, 249 aa, Artificial Sequence
  Description of Artificial Sequence: Synthetic polypeptide
  XENP025315 1C11_H3.238_L3_scFv(GKPGS)4
QVQLVQSGSELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40705 - protein, 117 aa, Artificial Sequence
  Description of Artificial Sequence: Synthetic polypeptide
  VH of XENP025315
QVQLVQSGSELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSS

SEQ ID NO: 40706 - protein, 112 aa, Artificial Sequence; identical to SEQ ID NO: 33009
  Description of Artificial Sequence: Synthetic polypeptide
  VL of XENP025315

SEQ ID NO: 40707 - protein, 5 aa, Artificial Sequence
  Description of Artificial Sequence: Synthetic peptide
  XENP025315 vhCDR1
HYGIN

SEQ ID NO: 40708 - protein, 17 aa, Artificial Sequence
  Description of Artificial Sequence: Synthetic peptide
  XENP025315 vhCDR2
WINTYTGEPYYAPGFQE

SEQ ID NO: 40709 - protein, 8 aa, Artificial Sequence
  Description of Artificial Sequence: Synthetic peptide
  XENP025315 vhCDR3
DYYGSSPY

SEQ ID NO: 40710 - protein, 16 aa, Artificial Sequence
  Description of Artificial Sequence: Synthetic peptide
  XENP025315 vlCDR1
KSSQSIVHSNGNTYLE

SEQ ID NO: 40711 - protein, 7 aa, Artificial Sequence
  Description of Artificial Sequence: Synthetic peptide
  XENP025315 vlCDR2
KVSNRFS

SEQ ID NO: 40712 - protein, 9 aa, Artificial Sequence
  Description of Artificial Sequence: Synthetic peptide
  XENP025315 vlCDR3
FQGSHVPNT

SEQ ID NO: 40713 - protein, 249 aa, Artificial Sequence
  Description of Artificial Sequence: Synthetic polypeptide
  XENP025316 1C11_H3.213_L3.144_scFv(GKPGS)4
QVQLVQSGPELKKPGESVKVSCKASGYTFTHYGINWVRQAPGQGLEWIGWINTYTGEPYYAPGFTGRFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40714 - protein, 117 aa, Artificial Sequence; identical to SEQ ID NO: 40426
  Description of Artificial Sequence: Synthetic polypeptide
  VH of XENP025316

SEQ ID NO: 40715 - protein, 112 aa, Artificial Sequence; identical to SEQ ID NO: 40517
  Description of Artificial Sequence: Synthetic polypeptide
  VL of XENP025316

SEQ ID NO: 40716 - protein, 5 aa, Artificial Sequence
  Description of Artificial Sequence: Synthetic peptide
  XENP025316 vhCDR1
HYGIN

SEQ ID NO: 40717 - protein, 17 aa, Artificial Sequence
  Description of Artificial Sequence: Synthetic peptide
  XENP025316 vhCDR2
WINTYTGEPYYAPGFTG

SEQ ID NO: 40718 - protein, 8 aa, Artificial Sequence
  Description of Artificial Sequence: Synthetic peptide
  XENP025316 vhCDR3
DYYGSSPY

SEQ ID NO: 40719 - protein, 16 aa, Artificial Sequence
  Description of Artificial Sequence: Synthetic peptide
  XENP025316 vlCDR1
KASQSIVHSNGNTYLE

SEQ ID NO: 40720 - protein, 7 aa, Artificial Sequence
  Description of Artificial Sequence: Synthetic peptide
  XENP025316 vlCDR2
KVSNRFS

SEQ ID NO: 40721 - protein, 9 aa, Artificial Sequence
  Description of Artificial Sequence: Synthetic peptide
  XENP025316 vlCDR3
FQGSHVPNT

SEQ ID NO: 40722 - protein, 249 aa, Artificial Sequence
  Description of Artificial Sequence: Synthetic polypeptide
  XENP025317 1C11_H3.213_L3.148_scFv(GKPGS)4
QVQLVQSGPELKKPGESVKVSCKASGYTFTHYGINWVRQAPGQGLEWIGWINTYTGEPYYAPGFTGRFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 40723 - protein, 117 aa, Artificial Sequence; identical to SEQ ID NO: 40426
  Description of Artificial Sequence: Synthetic polypeptide
  VH of XENP025317

SEQ ID NO: 40724 - protein, 112 aa, Artificial Sequence; identical to SEQ ID NO: 40553
  Description of Artificial Sequence: Synthetic polypeptide
  VL of XENP025317

SEQ ID NO: 40725 - protein, 5 aa, Artificial Sequence
  Description of Artificial Sequence: Synthetic peptide
  XENP025317 vhCDR1
HYGIN

SEQ ID NO: 40726 - protein, 17 aa, Artificial Sequence
  Description of Artificial Sequence: Synthetic peptide
  XENP025317 vhCDR2
WINTYTGEPYYAPGFTG

SEQ ID NO: 40727 - protein, 8 aa, Artificial Sequence
  Description of Artificial Sequence: Synthetic peptide
  XENP025317 vhCDR3
DYYGSSPY

SEQ ID NO: 40728 - protein, 16 aa, Artificial Sequence
  Description of Artificial Sequence: Synthetic peptide
  XENP025317 vlCDR1
KASQSIVHSNGNTYLE

SEQ ID NO: 40729 - protein, 7 aa, Artificial Sequence
  Description of Artificial Sequence: Synthetic peptide
  XENP025317 vlCDR2
KVSNRFS

SEQ ID NO: 40730 - protein, 9 aa, Artificial Sequence
  Description of Artificial Sequence: Synthetic peptide
  XENP025317 vlCDR3
FQGSHVPNT

SEQ ID NO: 40731 - protein, 249 aa, Artificial Sequence
  Description of Artificial Sequence: Synthetic polypeptide
  XENP025318 1C11_H3.216_L3.144_scFv(GKPGS)4
QVQLVQSGPELKKPGESVKVSCKASGYTFTHYGINWVRQPPGQGLEWMGWINTYTGEPYYAPGFTGRFVFSIDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40732 - protein, 117 aa, Artificial Sequence; identical to SEQ ID NO: 40453
  Description of Artificial Sequence: Synthetic polypeptide
  VH of XENP025318

SEQ ID NO: 40733 - protein, 112 aa, Artificial Sequence; identical to SEQ ID NO: 40517
  Description of Artificial Sequence: Synthetic polypeptide
  VL of XENP025318

SEQ ID NO: 40734 - protein, 5 aa, Artificial Sequence
  Description of Artificial Sequence: Synthetic peptide
  XENP025318 vhCDR1
HYGIN

SEQ ID NO: 40735 - protein, 17 aa, Artificial Sequence
  Description of Artificial Sequence: Synthetic peptide
  XENP025318 vhCDR2
WINTYTGEPYYAPGFTG

SEQ ID NO: 40736 - protein, 8 aa, Artificial Sequence
  Description of Artificial Sequence: Synthetic peptide
  XENP025318 vhCDR3
DYYGSSPY

SEQ ID NO: 40737 - protein, 16 aa, Artificial Sequence
  Description of Artificial Sequence: Synthetic peptide
  XENP025318 vlCDR1
KASQSIVHSNGNTYLE

SEQ ID NO: 40738 - protein, 7 aa, Artificial Sequence
  Description of Artificial Sequence: Synthetic peptide
  XENP025318 vlCDR2
KVSNRFS

SEQ ID NO: 40739 - protein, 9 aa, Artificial Sequence
  Description of Artificial Sequence: Synthetic peptide
  XENP025318 vlCDR3
FQGSHVPNT

SEQ ID NO: 40740 - protein, 249 aa, Artificial Sequence
  Description of Artificial Sequence: Synthetic polypeptide
  XENP025319 1C11_H3.216_L3.148_scFv(GKPGS)4
QVQLVQSGPELKKPGESVKVSCKASGYTFTHYGINWVRQPPGQGLEWMGWINTYTGEPYYAPGFTGRFVFSIDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 40741 - protein, 117 aa, Artificial Sequence; identical to SEQ ID NO: 40453
  Description of Artificial Sequence: Synthetic polypeptide
  VH of XENP025319

SEQ ID NO: 40742 - protein, 112 aa, Artificial Sequence; identical to SEQ ID NO: 40553
  Description of Artificial Sequence: Synthetic polypeptide
  VL of XENP025319

SEQ ID NO: 40743 - protein, 5 aa, Artificial Sequence
  Description of Artificial Sequence: Synthetic peptide
  XENP025319 vhCDR1
HYGIN

SEQ ID NO: 40744 - protein, 17 aa, Artificial Sequence
  Description of Artificial Sequence: Synthetic peptide
  XENP025319 vhCDR2
WINTYTGEPYYAPGFTG

SEQ ID NO: 40745 - protein, 8 aa, Artificial Sequence
  Description of Artificial Sequence: Synthetic peptide
  XENP025319 vhCDR3
DYYGSSPY

SEQ ID NO: 40746 - protein, 16 aa, Artificial Sequence
  Description of Artificial Sequence: Synthetic peptide
  XENP025319 vlCDR1
KASQSIVHSNGNTYLE

SEQ ID NO: 40747 - protein, 7 aa, Artificial Sequence
  Description of Artificial Sequence: Synthetic peptide
  XENP025319 vlCDR2
KVSNRFS

SEQ ID NO: 40748 - protein, 9 aa, Artificial Sequence
  Description of Artificial Sequence: Synthetic peptide
  XENP025319 vlCDR3
FQGSHVPNT

SEQ ID NO: 40749 - protein, 249 aa, Artificial Sequence
  Description of Artificial Sequence: Synthetic polypeptide
  XENP025320 1C11_H3.188_L3.144_scFv(GKPGS)4
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40750 - protein, 117 aa, Artificial Sequence; identical to SEQ ID NO: 35324
  Description of Artificial Sequence: Synthetic polypeptide
  VH of XENP025320

SEQ ID NO: 40751 - protein, 112 aa, Artificial Sequence; identical to SEQ ID NO: 40517
  Description of Artificial Sequence: Synthetic polypeptide
  VL of XENP025320

SEQ ID NO: 40752 - protein, 5 aa, Artificial Sequence
  Description of Artificial Sequence: Synthetic peptide
  XENP025320 vhCDR1
HYGIN

SEQ ID NO: 40753 - protein, 17 aa, Artificial Sequence
  Description of Artificial Sequence: Synthetic peptide
  XENP025320 vhCDR2
WINTYTGEPYYAPGFTG

SEQ ID NO: 40754 - protein, 8 aa, Artificial Sequence
  Description of Artificial Sequence: Synthetic peptide
  XENP025320 vhCDR3
DYYGSSPY

SEQ ID NO: 40755 - protein, 16 aa, Artificial Sequence
  Description of Artificial Sequence: Synthetic peptide
  XENP025320 vlCDR1
KASQSIVHSNGNTYLE

SEQ ID NO: 40756 - protein, 7 aa, Artificial Sequence
  Description of Artificial Sequence: Synthetic peptide
  XENP025320 vlCDR2
KVSNRFS

SEQ ID NO: 40757 - protein, 9 aa, Artificial Sequence
  Description of Artificial Sequence: Synthetic peptide
  XENP025320 vlCDR3
FQGSHVPNT

SEQ ID NO: 40758 - protein, 249 aa, Artificial Sequence
  Description of Artificial Sequence: Synthetic polypeptide
  XENP025321 1C11_H3.188_L3.148_scFv(GKPGS)4
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 40759 - protein, 117 aa, Artificial Sequence; identical to SEQ ID NO: 35324
  Description of Artificial Sequence: Synthetic polypeptide
  VH of XENP025321

SEQ ID NO: 40760 - protein, 112 aa, Artificial Sequence; identical to SEQ ID NO: 40553
  Description of Artificial Sequence: Synthetic polypeptide
  VL of XENP025321

SEQ ID NO: 40761 - protein, 5 aa, Artificial Sequence
  Description of Artificial Sequence: Synthetic peptide
  XENP025321 vhCDR1
HYGIN

SEQ ID NO: 40762 - protein, 17 aa, Artificial Sequence
  Description of Artificial Sequence: Synthetic peptide
  XENP025321 vhCDR2
WINTYTGEPYYAPGFTG

SEQ ID NO: 40763 - protein, 8 aa, Artificial Sequence
  Description of Artificial Sequence: Synthetic peptide
  XENP025321 vhCDR3
DYYGSSPY

SEQ ID NO: 40764 - protein, 16 aa, Artificial Sequence
  Description of Artificial Sequence: Synthetic peptide
  XENP025321 vlCDR1
KASQSIVHSNGNTYLE

SEQ ID NO: 40765 - protein, 7 aa, Artificial Sequence
  Description of Artificial Sequence: Synthetic peptide
  XENP025321 vlCDR2
KVSNRFS

SEQ ID NO: 40766 - protein, 9 aa, Artificial Sequence
  Description of Artificial Sequence: Synthetic peptide
  XENP025321 vlCDR3
FQGSHVPNT

SEQ ID NO: 40767 - protein, 249 aa, Artificial Sequence
  Description of Artificial Sequence: Synthetic polypeptide
  XENP025802 1C11[PD-1]_H3.224_L3.144_scFv(GKPGS)4
QVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40768 - protein, 117 aa, Artificial Sequence; identical to SEQ ID NO: 40579
  Description of Artificial Sequence: Synthetic polypeptide
  VH of XENP025802

SEQ ID NO: 40769 - protein, 112 aa, Artificial Sequence; identical to SEQ ID NO: 40517
  Description of Artificial Sequence: Synthetic polypeptide
  VL of XENP025802

SEQ ID NO: 40770 - protein, 5 aa, Artificial Sequence
  Description of Artificial Sequence: Synthetic peptide
  XENP025802 vhCDR1
HYGIN

SEQ ID NO: 40771 - protein, 17 aa, Artificial Sequence
  Description of Artificial Sequence: Synthetic peptide
  XENP025802 vhCDR2
WINTYTGEPYYAPGFQE

SEQ ID NO: 40772 - protein, 8 aa, Artificial Sequence
  Description of Artificial Sequence: Synthetic peptide
  XENP025802 vhCDR3
DYYGSSPY

SEQ ID NO: 40773 - protein, 16 aa, Artificial Sequence
  Description of Artificial Sequence: Synthetic peptide
  XENP025802 vlCDR1
KASQSIVHSNGNTYLE

SEQ ID NO: 40774 - protein, 7 aa, Artificial Sequence
  Description of Artificial Sequence: Synthetic peptide
  XENP025802 vlCDR2
KVSNRFS

SEQ ID NO: 40775 - protein, 9 aa, Artificial Sequence
  Description of Artificial Sequence: Synthetic peptide
  XENP025802 vlCDR3
FQGSHVPNT

SEQ ID NO: 40776 - protein, 249 aa, Artificial Sequence
  Description of Artificial Sequence: Synthetic polypeptide
  XENP025803 1C11[PD-1]_H3.224_L3.148_scFv(GKPGS)4
QVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 40777 - protein, 117 aa, Artificial Sequence; identical to SEQ ID NO: 40579
  Description of Artificial Sequence: Synthetic polypeptide
  VH of XENP025803

SEQ ID NO: 40778 - protein, 112 aa, Artificial Sequence; identical to SEQ ID NO: 40553
  Description of Artificial Sequence: Synthetic polypeptide
  VL of XENP025803

SEQ ID NO: 40779 - protein, 5 aa, Artificial Sequence
  Description of Artificial Sequence: Synthetic peptide
  XENP025803 vhCDR1
HYGIN

SEQ ID NO: 40780 - protein, 17 aa, Artificial Sequence
  Description of Artificial Sequence: Synthetic peptide
  XENP025803 vhCDR2
WINTYTGEPYYAPGFQE

SEQ ID NO: 40781 - protein, 8 aa, Artificial Sequence
  Description of Artificial Sequence: Synthetic peptide
  XENP025803 vhCDR3
DYYGSSPY

SEQ ID NO: 40782 - protein, 16 aa, Artificial Sequence
  Description of Artificial Sequence: Synthetic peptide
  XENP025803 vlCDR1
KASQSIVHSNGNTYLE

SEQ ID NO: 40783 - protein, 7 aa, Artificial Sequence
  Description of Artificial Sequence: Synthetic peptide
  XENP025803 vlCDR2
KVSNRFS

SEQ ID NO: 40784 - protein, 9 aa, Artificial Sequence
  Description of Artificial Sequence: Synthetic peptide
  XENP025803 vlCDR3
FQGSHVPNT

SEQ ID NO: 40785 - protein, 249 aa, Artificial Sequence
  Description of Artificial Sequence: Synthetic polypeptide
  XENP025804 1C11[PD-1]_H3.228_L3.144_scFv(GKPGS)4
EVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40786 - protein, 117 aa, Artificial Sequence; identical to SEQ ID NO: 40615
  Description of Artificial Sequence: Synthetic polypeptide
  VH of XENP025804

SEQ ID NO: 40787 - protein, 112 aa, Artificial Sequence; identical to SEQ ID NO: 40517
  Description of Artificial Sequence: Synthetic polypeptide
  VL of XENP025804

SEQ ID NO: 40788 - protein, 5 aa, Artificial Sequence
  Description of Artificial Sequence: Synthetic peptide
  XENP025804 vhCDR1
HYGIN

SEQ ID NO: 40789 - protein, 17 aa, Artificial Sequence
  Description of Artificial Sequence: Synthetic peptide
  XENP025804 vhCDR2
WINTYTGEPYYAPGFQE

SEQ ID NO: 40790 - protein, 8 aa, Artificial Sequence
  Description of Artificial Sequence: Synthetic peptide
  XENP025804 vhCDR3
DYYGSSPY

SEQ ID NO: 40791 - protein, 16 aa, Artificial Sequence
  Description of Artificial Sequence: Synthetic peptide
  XENP025804 vlCDR1
KASQSIVHSNGNTYLE

SEQ ID NO: 40792 - protein, 7 aa, Artificial Sequence
  Description of Artificial Sequence: Synthetic peptide
  XENP025804 vlCDR2
KVSNRFS

SEQ ID NO: 40793 - protein, 9 aa, Artificial Sequence
  Description of Artificial Sequence: Synthetic peptide
  XENP025804 vlCDR3
FQGSHVPNT

SEQ ID NO: 40794 - protein, 249 aa, Artificial Sequence
  Description of Artificial Sequence: Synthetic polypeptide
  XENP025805 1C11[PD-1]_H3.228_L3.148_scFv(GKPGS)4
EVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 40795 - protein, 117 aa, Artificial Sequence; identical to SEQ ID NO: 40615
  Description of Artificial Sequence: Synthetic polypeptide
  VH of XENP025805

SEQ ID NO: 40796 - protein, 112 aa, Artificial Sequence; identical to SEQ ID NO: 40553
  Description of Artificial Sequence: Synthetic polypeptide
  VL of XENP025805

SEQ ID NO: 40797 - protein, 5 aa, Artificial Sequence
  Description of Artificial Sequence: Synthetic peptide
  XENP025805 vhCDR1
HYGIN

SEQ ID NO: 40798 - protein, 17 aa, Artificial Sequence
  Description of Artificial Sequence: Synthetic peptide
  XENP025805 vhCDR2
WINTYTGEPYYAPGFQE

SEQ ID NO: 40799 - protein, 8 aa, Artificial Sequence
  Description of Artificial Sequence: Synthetic peptide
  XENP025805 vhCDR3
DYYGSSPY

SEQ ID NO: 40800 - protein, 16 aa, Artificial Sequence
  Description of Artificial Sequence: Synthetic peptide
  XENP025805 vlCDR1
KASQSIVHSNGNTYLE

SEQ ID NO: 40801 - protein, 7 aa, Artificial Sequence
  Description of Artificial Sequence: Synthetic peptide
  XENP025805 vlCDR2
KVSNRFS

SEQ ID NO: 40802 - protein, 9 aa, Artificial Sequence
  Description of Artificial Sequence: Synthetic peptide
  XENP025805 vlCDR3
FQGSHVPNT

SEQ ID NO: 40803 - protein, 249 aa, Artificial Sequence
  Description of Artificial Sequence: Synthetic polypeptide
  XENP025806 1C11[PD-1]_H3.234_L3.144_scFv(GKPGS)4
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 40804 - protein, 117 aa, Artificial Sequence; identical to SEQ ID NO: 40669
  Description of Artificial Sequence: Synthetic polypeptide
  VH of XENP025806

SEQ ID NO: 40805 - protein, 112 aa, Artificial Sequence; identical to SEQ ID NO: 40517
  Description of Artificial Sequence: Synthetic polypeptide
  VL of XENP025806

SEQ ID NO: 40806 - protein, 5 aa, Artificial Sequence
  Description of Artificial Sequence: Synthetic peptide
  XENP025806 vhCDR1
HYGIN

SEQ ID NO: 40807 - protein, 17 aa, Artificial Sequence
  Description of Artificial Sequence: Synthetic peptide
  XENP025806 vhCDR2
WINTYTGEPYYAPGFQE

SEQ ID NO: 40808 - protein, 8 aa, Artificial Sequence
  Description of Artificial Sequence: Synthetic peptide
  XENP025806 vhCDR3
DYYGSSPY

SEQ ID NO: 40809 - protein, 16 aa, Artificial Sequence
  Description of Artificial Sequence: Synthetic peptide
  XENP025806 vlCDR1
KASQSIVHSNGNTYLE

SEQ ID NO: 40810 - protein, 7 aa, Artificial Sequence
  Description of Artificial Sequence: Synthetic peptide
  XENP025806 vlCDR2
KVSNRFS

SEQ ID NO: 40811 - protein, 9 aa, Artificial Sequence
  Description of Artificial Sequence: Synthetic peptide
  XENP025806 vlCDR3
FQGSHVPNT

SEQ ID NO: 40812 - protein, 249 aa, Artificial Sequence
  Description of Artificial Sequence: Synthetic polypeptide
  XENP025807 1C11[PD-1]_H3.234_L3.148_scFv(GKPGS)4
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 40813 - protein, 117 aa, Artificial Sequence; identical to SEQ ID NO: 40669
  Description of Artificial Sequence: Synthetic polypeptide
  VH of XENP025807

SEQ ID NO: 40814 - protein, 112 aa, Artificial Sequence; identical to SEQ ID NO: 40553
  Description of Artificial Sequence: Synthetic polypeptide
  VL of XENP025807

SEQ ID NO: 40815 - protein, 5 aa, Artificial Sequence
  Description of Artificial Sequence: Synthetic peptide
  XENP025807 vhCDR1
HYGIN

SEQ ID NO: 40816 - protein, 17 aa, Artificial Sequence
  Description of Artificial Sequence: Synthetic peptide
  XENP025807 vhCDR2
WINTYTGEPYYAPGFQE

SEQ ID NO: 40817 - protein, 8 aa, Artificial Sequence
  Description of Artificial Sequence: Synthetic peptide
  XENP025807 vhCDR3
DYYGSSPY

SEQ ID NO: 40818 - protein, 16 aa, Artificial Sequence
  Description of Artificial Sequence: Synthetic peptide
  XENP025807 vlCDR1
KASQSIVHSNGNTYLE

SEQ ID NO: 40819 - protein, 7 aa, Artificial Sequence
  Description of Artificial Sequence: Synthetic peptide
  XENP025807 vlCDR2
KVSNRFS

SEQ ID NO: 40820 - protein, 9 aa, Artificial Sequence
  Description of Artificial Sequence: Synthetic peptide
  XENP025807 vlCDR3
FQGSHVPNT

SEQ ID NO: 40821 - protein, 249 aa, Artificial Sequence
  Description of Artificial Sequence: Synthetic polypeptide
  XENP025808 1C11[PD-1]_H3.239_L3.144_scFv(GKPGS)4
EVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40822 - protein, 117 aa, Artificial Sequence
  Description of Artificial Sequence: Synthetic polypeptide
  VH of XENP025808
EVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSS

SEQ ID NO: 40823 - protein, 112 aa, Artificial Sequence; identical to SEQ ID NO: 33009
  Description of Artificial Sequence: Synthetic polypeptide
  VL of XENP025808

SEQ ID NO: 40824 - protein, 5 aa, Artificial Sequence
  Description of Artificial Sequence: Synthetic peptide
  XENP025808 vhCDR1
HYGIN

SEQ ID NO: 40825 - protein, 17 aa, Artificial Sequence
  Description of Artificial Sequence: Synthetic peptide
  XENP025808 vhCDR2
WINTYTGEPYYAPGFQE

SEQ ID NO: 40826 - protein, 8 aa, Artificial Sequence
  Description of Artificial Sequence: Synthetic peptide
  XENP025808 vhCDR3
DYYGSSPY

SEQ ID NO: 40827 - protein, 16 aa, Artificial Sequence
  Description of Artificial Sequence: Synthetic peptide
  XENP025808 vlCDR1
KSSQSIVHSNGNTYLE

SEQ ID NO: 40828 - protein, 7 aa, Artificial Sequence
  Description of Artificial Sequence: Synthetic peptide
  XENP025808 vlCDR2
KVSNRFS

SEQ ID NO: 40829 - protein, 9 aa, Artificial Sequence
  Description of Artificial Sequence: Synthetic peptide
  XENP025808 vlCDR3
FQGSHVPNT

SEQ ID NO: 40830 - protein, 249 aa, Artificial Sequence
  Description of Artificial Sequence: Synthetic polypeptide
  XENP025809 1C11[PD-1]_H3.240_L3.144_scFv(GKPGS)4
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40831 - protein, 117 aa, Artificial Sequence
  Description of Artificial Sequence: Synthetic polypeptide
  VH of XENP025809
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSS

SEQ ID NO: 40832 - protein, 112 aa, Artificial Sequence; identical to SEQ ID NO: 33009
  Description of Artificial Sequence: Synthetic polypeptide
  VL of XENP025809

SEQ ID NO: 40833 - protein, 5 aa, Artificial Sequence
  Description of Artificial Sequence: Synthetic peptide
  XENP025809 vhCDR1
HYGIN

SEQ ID NO: 40834 - protein, 17 aa, Artificial Sequence
  Description of Artificial Sequence: Synthetic peptide
  XENP025809 vhCDR2
WINTYTGEPYYAPGFQE

SEQ ID NO: 40835 - protein, 8 aa, Artificial Sequence
  Description of Artificial Sequence: Synthetic peptide
  XENP025809 vhCDR3
DYYGSSPY

SEQ ID NO: 40836 - protein, 16 aa, Artificial Sequence
  Description of Artificial Sequence: Synthetic peptide
  XENP025809 vlCDR1
KSSQSIVHSNGNTYLE

SEQ ID NO: 40837 - protein, 7 aa, Artificial Sequence
  Description of Artificial Sequence: Synthetic peptide
  XENP025809 vlCDR2
KVSNRFS

SEQ ID NO: 40838 - protein, 9 aa, Artificial Sequence
  Description of Artificial Sequence: Synthetic peptide
  XENP025809 vlCDR3
FQGSHVPNT

SEQ ID NO: 40839 - protein, 249 aa, Artificial Sequence
  Description of Artificial Sequence: Synthetic polypeptide
  XENP025810 1C11[PD-1]_H3.241_L3.144_scFv(GKPGS)4
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 40840 - protein, 117 aa, Artificial Sequence
  Description of Artificial Sequence: Synthetic polypeptide
  VH of XENP025810
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSS

SEQ ID NO: 40841 - protein, 112 aa, Artificial Sequence; identical to SEQ ID NO: 33009
  Description of Artificial Sequence: Synthetic polypeptide
  VL of XENP025810

SEQ ID NO: 40842 - protein, 5 aa, Artificial Sequence
  Description of Artificial Sequence: Synthetic peptide
  XENP025810 vhCDR1
HYGIN

SEQ ID NO: 40843 - protein, 17 aa, Artificial Sequence
  Description of Artificial Sequence: Synthetic peptide
  XENP025810 vhCDR2
WINTYTGEPYYAPGFQE

SEQ ID NO: 40844 - protein, 8 aa, Artificial Sequence
  Description of Artificial Sequence: Synthetic peptide
  XENP025810 vhCDR3
DYYGSSPY

SEQ ID NO: 40845 - protein, 16 aa, Artificial Sequence
  Description of Artificial Sequence: Synthetic peptide
  XENP025810 vlCDR1
KSSQSIVHSNGNTYLE

SEQ ID NO: 40846 - protein, 7 aa, Artificial Sequence
  Description of Artificial Sequence: Synthetic peptide
  XENP025810 vlCDR2
KVSNRFS

SEQ ID NO: 40847 - protein, 9 aa, Artificial Sequence
  Description of Artificial Sequence: Synthetic peptide
  XENP025810 vlCDR3
FQGSHVPNT

SEQ ID NO: 40848 - protein, 249 aa, Artificial Sequence; identical to SEQ ID NO: 40821
  Description of Artificial Sequence: Synthetic polypeptide
  XENP025811 1C11[PD-1]_H3.239_L3.148_scFv(GKPGS)4

SEQ ID NO: 40849 - protein, 117 aa, Artificial Sequence; identical to SEQ ID NO: 40822
  Description of Artificial Sequence: Synthetic polypeptide
  VH of XENP025811

SEQ ID NO: 40850 - protein, 112 aa, Artificial Sequence; identical to SEQ ID NO: 33009
  Description of Artificial Sequence: Synthetic polypeptide
  VL of XENP025811

SEQ ID NO: 40851 - protein, 5 aa, Artificial Sequence
  Description of Artificial Sequence: Synthetic peptide
  XENP025811 vhCDR1
HYGIN

SEQ ID NO: 40852 - protein, 17 aa, Artificial Sequence
  Description of Artificial Sequence: Synthetic peptide
  XENP025811 vhCDR2
WINTYTGEPYYAPGFQE

SEQ ID NO: 40853 - protein, 8 aa, Artificial Sequence
  Description of Artificial Sequence: Synthetic peptide
  XENP025811 vhCDR3
DYYGSSPY

SEQ ID NO: 40854 - protein, 16 aa, Artificial Sequence
  Description of Artificial Sequence: Synthetic peptide
  XENP025811 vlCDR1
KSSQSIVHSNGNTYLE

SEQ ID NO: 40855 - protein, 7 aa, Artificial Sequence
  Description of Artificial Sequence: Synthetic peptide
  XENP025811 vlCDR2
KVSNRFS

SEQ ID NO: 40856 - protein, 9 aa, Artificial Sequence
  Description of Artificial Sequence: Synthetic peptide
  XENP025811 vlCDR3
FQGSHVPNT

SEQ ID NO: 40857 - protein, 249 aa, Artificial Sequence; identical to SEQ ID NO: 40830
  Description of Artificial Sequence: Synthetic polypeptide
  XENP025812 1C11[PD-1]_H3.240_L3.148_scFv(GKPGS)4

SEQ ID NO: 40858 - protein, 117 aa, Artificial Sequence; identical to SEQ ID NO: 40831
  Description of Artificial Sequence: Synthetic polypeptide
  VH of XENP025812

SEQ ID NO: 40859 - protein, 112 aa, Artificial Sequence; identical to SEQ ID NO: 33009
  Description of Artificial Sequence: Synthetic polypeptide
  VL of XENP025812

SEQ ID NO: 40860 - protein, 5 aa, Artificial Sequence
  Description of Artificial Sequence: Synthetic peptide
  XENP025812 vhCDR1
HYGIN

SEQ ID NO: 40861 - protein, 17 aa, Artificial Sequence
  Description of Artificial Sequence: Synthetic peptide
  XENP025812 vhCDR2
WINTYTGEPYYAPGFQE

SEQ ID NO: 40862 - protein, 8 aa, Artificial Sequence
  Description of Artificial Sequence: Synthetic peptide
  XENP025812 vhCDR3
DYYGSSPY

SEQ ID NO: 40863 - protein, 16 aa, Artificial Sequence
  Description of Artificial Sequence: Synthetic peptide
  XENP025812 vlCDR1
KSSQSIVHSNGNTYLE

SEQ ID NO: 40864 - protein, 7 aa, Artificial Sequence
  Description of Artificial Sequence: Synthetic peptide
  XENP025812 vlCDR2
KVSNRFS

SEQ ID NO: 40865 - protein, 9 aa, Artificial Sequence
  Description of Artificial Sequence: Synthetic peptide
  XENP025812 vlCDR3
FQGSHVPNT

SEQ ID NO: 40866 - protein, 249 aa, Artificial Sequence; identical to SEQ ID NO: 40839
  Description of Artificial Sequence: Synthetic polypeptide
  XENP025813 1C11[PD-1]_H3.241_L3.148_scFv(GKPGS)4

SEQ ID NO: 40867 - protein, 117 aa, Artificial Sequence; identical to SEQ ID NO: 40840
  Description of Artificial Sequence: Synthetic polypeptide
  VH of XENP025813

SEQ ID NO: 40868 - protein, 112 aa, Artificial Sequence; identical to SEQ ID NO: 33009
  Description of Artificial Sequence: Synthetic polypeptide
  VL of XENP025813

SEQ ID NO: 40869 - protein, 5 aa, Artificial Sequence
  Description of Artificial Sequence: Synthetic peptide
  XENP025813 vhCDR1
HYGIN

SEQ ID NO: 40870 - protein, 17 aa, Artificial Sequence
  Description of Artificial Sequence: Synthetic peptide
  XENP025813 vhCDR2
WINTYTGEPYYAPGFQE

SEQ ID NO: 40871 - protein, 8 aa, Artificial Sequence
  Description of Artificial Sequence: Synthetic peptide
  XENP025813 vhCDR3
DYYGSSPY

SEQ ID NO: 40872 - protein, 16 aa, Artificial Sequence
  Description of Artificial Sequence: Synthetic peptide
  XENP025813 vlCDR1
KSSQSIVHSNGNTYLE

SEQ ID NO: 40873 - protein, 7 aa, Artificial Sequence
  Description of Artificial Sequence: Synthetic peptide
  XENP025813 vlCDR2
KVSNRFS

SEQ ID NO: 40874 - protein, 9 aa, Artificial Sequence
  Description of Artificial Sequence: Synthetic peptide
  XENP025813 vlCDR3
FQGSHVPNT

SEQ ID NO: 40875 - protein, 249 aa, Artificial Sequence
  Description of Artificial Sequence: Synthetic polypeptide
  XENP025814 1C11[PD-1]_H3.239_L3.125_scFv(GKPGS)4
EVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIK

SEQ ID NO: 40876 - protein, 117 aa, Artificial Sequence; identical to SEQ ID NO: 40822
  Description of Artificial Sequence: Synthetic polypeptide
  VH of XENP025814

SEQ ID NO: 40877 - protein, 112 aa, Artificial Sequence; identical to SEQ ID NO: 39644
  Description of Artificial Sequence: Synthetic polypeptide
  VL of XENP025814

SEQ ID NO: 40878 - protein, 5 aa, Artificial Sequence
  Description of Artificial Sequence: Synthetic peptide
  XENP025814 vhCDR1
HYGIN

SEQ ID NO: 40879 - protein, 17 aa, Artificial Sequence
  Description of Artificial Sequence: Synthetic peptide
  XENP025814 vhCDR2
WINTYTGEPYYAPGFQE

SEQ ID NO: 40880 - protein, 8 aa, Artificial Sequence
  Description of Artificial Sequence: Synthetic peptide
  XENP025814 vhCDR3
DYYGSSPY

SEQ ID NO: 40881 - protein, 16 aa, Artificial Sequence
  Description of Artificial Sequence: Synthetic peptide
  XENP025814 vlCDR1
KSSQSIVHSNGNTYLE

SEQ ID NO: 40882 - protein, 7 aa, Artificial Sequence
  Description of Artificial Sequence: Synthetic peptide
  XENP025814 vlCDR2
KVSNRFS

SEQ ID NO: 40883 - protein, 9 aa, Artificial Sequence
  Description of Artificial Sequence: Synthetic peptide
  XENP025814 vlCDR3
FQGSHVPNT

SEQ ID NO: 40884 - protein, 249 aa, Artificial Sequence
  Description of Artificial Sequence: Synthetic polypeptide
  XENP025815 1C11[PD-1]_H3.240_L3.125_scFv(GKPGS)4
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIK

SEQ ID NO: 40885 - protein, 117 aa, Artificial Sequence; identical to SEQ ID NO: 40831
  Description of Artificial Sequence: Synthetic polypeptide
  VH of XENP025815

SEQ ID NO: 40886 - protein, 112 aa, Artificial Sequence; identical to SEQ ID NO: 39644
  Description of Artificial Sequence: Synthetic polypeptide
  VL of XENP025815

SEQ ID NO: 40887 - protein, 5 aa, Artificial Sequence
  Description of Artificial Sequence: Synthetic peptide
  XENP025815 vhCDR1
HYGIN

SEQ ID NO: 40888 - protein, 17 aa, Artificial Sequence
  Description of Artificial Sequence: Synthetic peptide
  XENP025815 vhCDR2
WINTYTGEPYYAPGFQE

SEQ ID NO: 40889 - protein, 8 aa, Artificial Sequence
  Description of Artificial Sequence: Synthetic peptide
  XENP025815 vhCDR3
DYYGSSPY

SEQ ID NO: 40890 - protein, 16 aa, Artificial Sequence
  Description of Artificial Sequence: Synthetic peptide
  XENP025815 vlCDR1
KSSQSIVHSNGNTYLE

SEQ ID NO: 40891 - protein, 7 aa, Artificial Sequence
  Description of Artificial Sequence: Synthetic peptide
  XENP025815 vlCDR2
KVSNRFS

SEQ ID NO: 40892 - protein, 9 aa, Artificial Sequence
  Description of Artificial Sequence: Synthetic peptide
  XENP025815 vlCDR3
FQGSHVPNT

SEQ ID NO: 40893 - protein, 249 aa, Artificial Sequence
  Description of Artificial Sequence: Synthetic polypeptide
  XENP025816 1C11[PD-1]_H3.241_L3.125_scFv(GKPGS)4
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIK

SEQ ID NO: 40894 - protein, 117 aa, Artificial Sequence; identical to SEQ ID NO: 40840
  Description of Artificial Sequence: Synthetic polypeptide
  VH of XENP025816

SEQ ID NO: 40895 - protein, 112 aa, Artificial Sequence; identical to SEQ ID NO: 39644
  Description of Artificial Sequence: Synthetic polypeptide
  VL of XENP025816

SEQ ID NO: 40896 - protein, 5 aa, Artificial Sequence
  Description of Artificial Sequence: Synthetic peptide
  XENP025816 vhCDR1
HYGIN

SEQ ID NO: 40897 - protein, 17 aa, Artificial Sequence
  Description of Artificial Sequence: Synthetic peptide
  XENP025816 vhCDR2
WINTYTGEPYYAPGFQE

SEQ ID NO: 40898 - protein, 8 aa, Artificial Sequence
  Description of Artificial Sequence: Synthetic peptide
  XENP025816 vhCDR3
DYYGSSPY

SEQ ID NO: 40899 - protein, 16 aa, Artificial Sequence
  Description of Artificial Sequence: Synthetic peptide
  XENP025816 vlCDR1
KSSQSIVHSNGNTYLE

SEQ ID NO: 40900 - protein, 7 aa, Artificial Sequence
  Description of Artificial Sequence: Synthetic peptide
  XENP025816 vlCDR2
KVSNRFS

SEQ ID NO: 40901 - protein, 9 aa, Artificial Sequence
  Description of Artificial Sequence: Synthetic peptide
  XENP025816 vlCDR3
FQGSHVPNT

SEQ ID NO: 40902 - protein, 249 aa, Artificial Sequence
  Description of Artificial Sequence: Synthetic polypeptide
  XENP025817 1C11[PD-1]_H3.239_L3.92_scFv(GKPGS)4
EVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 40903 - protein, 117 aa, Artificial Sequence; identical to SEQ ID NO: 40822
  Description of Artificial Sequence: Synthetic polypeptide
  VH of XENP025817

SEQ ID NO: 40904 - protein, 112 aa, Artificial Sequence; identical to SEQ ID NO: 39932
  Description of Artificial Sequence: Synthetic polypeptide
  VL of XENP025817

SEQ ID NO: 40905 - protein, 5 aa, Artificial Sequence
  Description of Artificial Sequence: Synthetic peptide
  XENP025817 vhCDR1
HYGIN

SEQ ID NO: 40906 - protein, 17 aa, Artificial Sequence
  Description of Artificial Sequence: Synthetic peptide
  XENP025817 vhCDR2
WINTYTGEPYYAPGFQE

SEQ ID NO: 40907 - protein, 8 aa, Artificial Sequence
  Description of Artificial Sequence: Synthetic peptide
  XENP025817 vhCDR3
DYYGSSPY

SEQ ID NO: 40908 - protein, 16 aa, Artificial Sequence
  Description of Artificial Sequence: Synthetic peptide
  XENP025817 vlCDR1
KASQSIVHSNGNTYLE

SEQ ID NO: 40909 - protein, 7 aa, Artificial Sequence
  Description of Artificial Sequence: Synthetic peptide
  XENP025817 vlCDR2
KVSNRFT

SEQ ID NO: 40910 - protein, 9 aa, Artificial Sequence
  Description of Artificial Sequence: Synthetic peptide
  XENP025817 vlCDR3
FQGSHVPNT

SEQ ID NO: 40911 - protein, 249 aa, Artificial Sequence
  Description of Artificial Sequence: Synthetic polypeptide
  XENP025818 1C11[PD-1]_H3.240_L3.92_scFv(GKPGS)4
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 40912 - protein, 117 aa, Artificial Sequence; identical to SEQ ID NO: 40831
  Description of Artificial Sequence: Synthetic polypeptide
  VH of XENP025818

SEQ ID NO: 40913 - protein, 112 aa, Artificial Sequence; identical to SEQ ID NO: 39932
  Description of Artificial Sequence: Synthetic polypeptide
  VL of XENP025818

SEQ ID NO: 40914 - protein, 5 aa, Artificial Sequence
  Description of Artificial Sequence: Synthetic peptide
  XENP025818 vhCDR1
HYGIN

SEQ ID NO: 40915 - protein, 17 aa, Artificial Sequence
  Description of Artificial Sequence: Synthetic peptide
  XENP025818 vhCDR2
WINTYTGEPYYAPGFQE

SEQ ID NO: 40916 - protein, 8 aa, Artificial Sequence
  Description of Artificial Sequence: Synthetic peptide
  XENP025818 vhCDR3
DYYGSSPY

SEQ ID NO: 40917 - protein, 16 aa, Artificial Sequence
  Description of Artificial Sequence: Synthetic peptide
  XENP025818 vlCDR1
KASQSIVHSNGNTYLE

SEQ ID NO: 40918 - protein, 7 aa, Artificial Sequence
  Description of Artificial Sequence: Synthetic peptide
  XENP025818 vlCDR2
KVSNRFT

SEQ ID NO: 40919 - protein, 9 aa, Artificial Sequence
  Description of Artificial Sequence: Synthetic peptide
  XENP025818 vlCDR3
FQGSHVPNT

SEQ ID NO: 40920 - protein, 249 aa, Artificial Sequence
  Description of Artificial Sequence: Synthetic polypeptide
  XENP025819 1C11[PD-1]_H3.241_L3.92_scFv(GKPGS)4
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 40921 - protein, 117 aa, Artificial Sequence; identical to SEQ ID NO: 40840
  Description of Artificial Sequence: Synthetic polypeptide
  VH of XENP025819

SEQ ID NO: 40922 - protein, 112 aa, Artificial Sequence; identical to SEQ ID NO: 39932
  Description of Artificial Sequence: Synthetic polypeptide
  VL of XENP025819

SEQ ID NO: 40923 - protein, 5 aa, Artificial Sequence
  Description of Artificial Sequence: Synthetic peptide
  XENP025819 vhCDR1
HYGIN

SEQ ID NO: 40924 - protein, 17 aa, Artificial Sequence
  Description of Artificial Sequence: Synthetic peptide
  XENP025819 vhCDR2
WINTYTGEPYYAPGFQE

SEQ ID NO: 40925 - protein, 8 aa, Artificial Sequence
  Description of Artificial Sequence: Synthetic peptide
  XENP025819 vhCDR3
DYYGSSPY

SEQ ID NO: 40926 - protein, 16 aa, Artificial Sequence
  Description of Artificial Sequence: Synthetic peptide
  XENP025819 vlCDR1
KASQSIVHSNGNTYLE

SEQ ID NO: 40927 - protein, 7 aa, Artificial Sequence
  Description of Artificial Sequence: Synthetic peptide
  XENP025819 vlCDR2
KVSNRFT

SEQ ID NO: 40928 - protein, 9 aa, Artificial Sequence
  Description of Artificial Sequence: Synthetic peptide
  XENP025819 vlCDR3
FQGSHVPNT

SEQ ID NO: 40929 - protein, 446 aa, Artificial Sequence
  Description of Artificial Sequence: Synthetic polypeptide
  XENP025322 1C11_H3.223_L3_IgG1_PVA_/S267K Heavy Chain
QVQLVQSGPELKKPGESVKVSCKASGYTFTHYGINWVRQPPGQGLEWMGWINTYTGEPYYAPGFTERFVFSIDTSQSTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40930 - protein, 117 aa, Artificial Sequence; identical to SEQ ID NO: 40570
  Description of Artificial Sequence: Synthetic polypeptide
  VH of XENP025322

SEQ ID NO: 40931 - protein, 5 aa, Artificial Sequence
  Description of Artificial Sequence: Synthetic peptide
  XENP025322 vhCDR1
HYGIN

SEQ ID NO: 40932 - protein, 17 aa, Artificial Sequence
  Description of Artificial Sequence: Synthetic peptide
  XENP025322 vhCDR2
WINTYTGEPYYAPGFTE

SEQ ID NO: 40933 - protein, 8 aa, Artificial Sequence
  Description of Artificial Sequence: Synthetic peptide
  XENP025322 vhCDR3
DYYGSSPY

SEQ ID NO: 40934 - protein, 219 aa, Artificial Sequence; identical to SEQ ID NO: 33008
  Description of Artificial Sequence: Synthetic polypeptide
  XENP025322 1C11_H3.223_L3_IgG1_PVA_/S267K Light Chain

SEQ ID NO: 40935 - protein, 112 aa, Artificial Sequence; identical to SEQ ID NO: 33009
  Description of Artificial Sequence: Synthetic polypeptide
  VL of XENP025322

SEQ ID NO: 40936 - protein, 16 aa, Artificial Sequence
  Description of Artificial Sequence: Synthetic peptide
  XENP025322 vlCDR1
KSSQSIVHSNGNTYLE

SEQ ID NO: 40937 - protein, 7 aa, Artificial Sequence
  Description of Artificial Sequence: Synthetic peptide
  XENP025322 vlCDR2
KVSNRFS

SEQ ID NO: 40938 - protein, 9 aa, Artificial Sequence
  Description of Artificial Sequence: Synthetic peptide
  XENP025322 vlCDR3
FQGSHVPNT

SEQ ID NO: 40939 - protein, 446 aa, Artificial Sequence
  Description of Artificial Sequence: Synthetic polypeptide
  XENP025323 1C11_H3.224_L3_IgG1_PVA_/S267K Heavy Chain
QVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40940 - protein, 117 aa, Artificial Sequence; identical to SEQ ID NO: 40579
  Description of Artificial Sequence: Synthetic polypeptide
  VH of XENP025323

SEQ ID NO: 40941 - protein, 5 aa, Artificial Sequence
  Description of Artificial Sequence: Synthetic peptide
  XENP025323 vhCDR1
HYGIN

SEQ ID NO: 40942 - protein, 17 aa, Artificial Sequence
  Description of Artificial Sequence: Synthetic peptide
  XENP025323 vhCDR2
WINTYTGEPYYAPGFQE

SEQ ID NO: 40943 - protein, 8 aa, Artificial Sequence
  Description of Artificial Sequence: Synthetic peptide
  XENP025323 vhCDR3
DYYGSSPY

SEQ ID NO: 40944 - protein, 219 aa, Artificial Sequence; identical to SEQ ID NO: 33008
  Description of Artificial Sequence: Synthetic polypeptide
  XENP025323 1C11_H3.224_L3_IgG1_PVA_/S267K Light Chain

SEQ ID NO: 40945 - protein, 112 aa, Artificial Sequence; identical to SEQ ID NO: 33009
  Description of Artificial Sequence: Synthetic polypeptide
  VL of XENP025323

SEQ ID NO: 40946 - protein, 16 aa, Artificial Sequence
  Description of Artificial Sequence: Synthetic peptide
  XENP025323 vlCDR1
KSSQSIVHSNGNTYLE

SEQ ID NO: 40947 - protein, 7 aa, Artificial Sequence
  Description of Artificial Sequence: Synthetic peptide
  XENP025323 vlCDR2
KVSNRFS

SEQ ID NO: 40948 - protein, 9 aa, Artificial Sequence
  Description of Artificial Sequence: Synthetic peptide
  XENP025323 vlCDR3
FQGSHVPNT

SEQ ID NO: 40949 - protein, 446 aa, Artificial Sequence
  Description of Artificial Sequence: Synthetic polypeptide
  XENP025324 1C11_H3.225_L3_IgG1_PVA_/S267K Heavy Chain
QVQLVQSGPELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40950 - protein, 117 aa, Artificial Sequence; identical to SEQ ID NO: 40588
  Description of Artificial Sequence: Synthetic polypeptide
  VH of XENP025324

SEQ ID NO: 40951 - protein, 5 aa, Artificial Sequence
  Description of Artificial Sequence: Synthetic peptide
  XENP025324 vhCDR1
HYGIN

SEQ ID NO: 40952 - protein, 17 aa, Artificial Sequence
  Description of Artificial Sequence: Synthetic peptide
  XENP025324 vhCDR2
WINTYTGEPYYAPGFTE

SEQ ID NO: 40953 - protein, 8 aa, Artificial Sequence
  Description of Artificial Sequence: Synthetic peptide
  XENP025324 vhCDR3
DYYGSSPY

SEQ ID NO: 40954 - protein, 219 aa, Artificial Sequence; identical to SEQ ID NO: 33008
  Description of Artificial Sequence: Synthetic polypeptide
  XENP025324 1C11_H3.225_L3_IgG1_PVA_/S267K Light Chain

SEQ ID NO: 40955 - protein, 112 aa, Artificial Sequence; identical to SEQ ID NO: 33009
  Description of Artificial Sequence: Synthetic polypeptide
  VL of XENP025324

SEQ ID NO: 40956 - protein, 16 aa, Artificial Sequence
  Description of Artificial Sequence: Synthetic peptide
  XENP025324 vlCDR1
KSSQSIVHSNGNTYLE

SEQ ID NO: 40957 - protein, 7 aa, Artificial Sequence
  Description of Artificial Sequence: Synthetic peptide
  XENP025324 vlCDR2
KVSNRFS

SEQ ID NO: 40958 - protein, 9 aa, Artificial Sequence
  Description of Artificial Sequence: Synthetic peptide
  XENP025324 vlCDR3
FQGSHVPNT

SEQ ID NO: 40959 - protein, 446 aa, Artificial Sequence
  Description of Artificial Sequence: Synthetic polypeptide
  XENP025325 1C11_H3.226_L3_IgG1_PVA_/S267K Heavy Chain
QVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40960 - protein, 117 aa, Artificial Sequence; identical to SEQ ID NO: 40597
  Description of Artificial Sequence: Synthetic polypeptide
  VH of XENP025325

SEQ ID NO: 40961 - protein, 5 aa, Artificial Sequence
  Description of Artificial Sequence: Synthetic peptide
  XENP025325 vhCDR1
HYGIN

SEQ ID NO: 40962 - protein, 17 aa, Artificial Sequence
  Description of Artificial Sequence: Synthetic peptide
  XENP025325 vhCDR2
WINTYTGEPYYAPGFQE

SEQ ID NO: 40963 - protein, 8 aa, Artificial Sequence
  Description of Artificial Sequence: Synthetic peptide
  XENP025325 vhCDR3
DYYGSSPY

SEQ ID NO: 40964 - protein, 219 aa, Artificial Sequence; identical to SEQ ID NO: 33008
  Description of Artificial Sequence: Synthetic polypeptide
  XENP025325 1C11_H3.226_L3_IgG1_PVA_/S267K Light Chain

SEQ ID NO: 40965 - protein, 112 aa, Artificial Sequence; identical to SEQ ID NO: 33009
  Description of Artificial Sequence: Synthetic polypeptide
  VL of XENP025325

SEQ ID NO: 40966 - protein, 16 aa, Artificial Sequence
  Description of Artificial Sequence: Synthetic peptide
  XENP025325 vlCDR1
KSSQSIVHSNGNTYLE

SEQ ID NO: 40967 - protein, 7 aa, Artificial Sequence
  Description of Artificial Sequence: Synthetic peptide
  XENP025325 vlCDR2
KVSNRFS

SEQ ID NO: 40968 - protein, 9 aa, Artificial Sequence
  Description of Artificial Sequence: Synthetic peptide
  XENP025325 vlCDR3
FQGSHVPNT

SEQ ID NO: 40969 - protein, 446 aa, Artificial Sequence
  Description of Artificial Sequence: Synthetic polypeptide
  XENP025326 1C11_H3.229_L3_IgG1_PVA_/S267K Heavy Chain
QVQLVQSGSELKKPGESVKVSCKASGYTFTHYGINWVRQPPGQGLEWMGWINTYTGEPYYAPGFQERFVFSLDTSQSTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40970 - protein, 117 aa, Artificial Sequence; identical to SEQ ID NO: 40624
  Description of Artificial Sequence: Synthetic polypeptide
  VH of XENP025326

SEQ ID NO: 40971 - protein, 5 aa, Artificial Sequence
  Description of Artificial Sequence: Synthetic peptide
  XENP025326 vhCDR1
HYGIN

SEQ ID NO: 40972 - protein, 17 aa, Artificial Sequence
  Description of Artificial Sequence: Synthetic peptide
  XENP025326 vhCDR2
WINTYTGEPYYAPGFQE

SEQ ID NO: 40973 - protein, 8 aa, Artificial Sequence
  Description of Artificial Sequence: Synthetic peptide
  XENP025326 vhCDR3
DYYGSSPY

SEQ ID NO: 40974 - protein, 219 aa, Artificial Sequence; identical to SEQ ID NO: 33008
  Description of Artificial Sequence: Synthetic polypeptide
  XENP025326 1C11_H3.229_L3_IgG1_PVA_/S267K Light Chain

SEQ ID NO: 40975 - protein, 112 aa, Artificial Sequence; identical to SEQ ID NO: 33009
  Description of Artificial Sequence: Synthetic polypeptide
  VL of XENP025326

SEQ ID NO: 40976 - protein, 16 aa, Artificial Sequence
  Description of Artificial Sequence: Synthetic peptide
  XENP025326 vlCDR1
KSSQSIVHSNGNTYLE

SEQ ID NO: 40977 - protein, 7 aa, Artificial Sequence
  Description of Artificial Sequence: Synthetic peptide
  XENP025326 vlCDR2
KVSNRFS

SEQ ID NO: 40978 - protein, 9 aa, Artificial Sequence
  Description of Artificial Sequence: Synthetic peptide
  XENP025326 vlCDR3
FQGSHVPNT

SEQ ID NO: 40979 - protein, 446 aa, Artificial Sequence
  Description of Artificial Sequence: Synthetic polypeptide
  XENP025327 1C11_H3.230_L3_IgG1_PVA_/S267K Heavy Chain
QVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40980 - protein, 117 aa, Artificial Sequence; identical to SEQ ID NO: 40633
  Description of Artificial Sequence: Synthetic polypeptide
  VH of XENP025327

SEQ ID NO: 40981 - protein, 5 aa, Artificial Sequence
  Description of Artificial Sequence: Synthetic peptide
  XENP025327 vhCDR1
HYGIN

SEQ ID NO: 40982 - protein, 17 aa, Artificial Sequence
  Description of Artificial Sequence: Synthetic peptide
  XENP025327 vhCDR2
WINTYTGEPYYAPGFQE

SEQ ID NO: 40983 - protein, 8 aa, Artificial Sequence
  Description of Artificial Sequence: Synthetic peptide
  XENP025327 vhCDR3
DYYGSSPY

SEQ ID NO: 40984 - protein, 219 aa, Artificial Sequence; identical to SEQ ID NO: 33008
  Description of Artificial Sequence: Synthetic polypeptide
  XENP025327 1C11_H3.230_L3_IgG1_PVA_/S267K Light Chain

SEQ ID NO: 40985 - protein, 112 aa, Artificial Sequence; identical to SEQ ID NO: 33009
  Description of Artificial Sequence: Synthetic polypeptide
  VL of XENP025327

SEQ ID NO: 40986 - protein, 16 aa, Artificial Sequence
  Description of Artificial Sequence: Synthetic peptide
  XENP025327 vlCDR1
KSSQSIVHSNGNTYLE

SEQ ID NO: 40987 - protein, 7 aa, Artificial Sequence
  Description of Artificial Sequence: Synthetic peptide
  XENP025327 vlCDR2
KVSNRFS

SEQ ID NO: 40988 - protein, 9 aa, Artificial Sequence
  Description of Artificial Sequence: Synthetic peptide
  XENP025327 vlCDR3
FQGSHVPNT

SEQ ID NO: 40989 - protein, 446 aa, Artificial Sequence
  Description of Artificial Sequence: Synthetic polypeptide
  XENP025328 1C11_H3.231_L3_IgG1_PVA_/S267K Heavy Chain
QVQLVQSGSELKKPGESVKVSCKASGYTFTHYGINWVRQPPGQGLEWMGWINTYTGEPTYAPGFTGRFVFSLDTSQSTAYLQISSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40990 - protein, 117 aa, Artificial Sequence; identical to SEQ ID NO: 40642
  Description of Artificial Sequence: Synthetic polypeptide
  VH of XENP025328

SEQ ID NO: 40991 - protein, 5 aa, Artificial Sequence
  Description of Artificial Sequence: Synthetic peptide
  XENP025328 vhCDR1
HYGIN

SEQ ID NO: 40992 - protein, 17 aa, Artificial Sequence
  Description of Artificial Sequence: Synthetic peptide
  XENP025328 vhCDR2
WINTYTGEPTYAPGFTG

SEQ ID NO: 40993 - protein, 8 aa, Artificial Sequence
  Description of Artificial Sequence: Synthetic peptide
  XENP025328 vhCDR3
DYYGSSPY

SEQ ID NO: 40994 - protein, 219 aa, Artificial Sequence; identical to SEQ ID NO: 33008
  Description of Artificial Sequence: Synthetic polypeptide
  XENP025328 1C11_H3.231_L3_IgG1_PVA_/S267K Light Chain

SEQ ID NO: 40995 - protein, 112 aa, Artificial Sequence; identical to SEQ ID NO: 33009
  Description of Artificial Sequence: Synthetic polypeptide
  VL of XENP025328

SEQ ID NO: 40996 - protein, 16 aa, Artificial Sequence
  Description of Artificial Sequence: Synthetic peptide
  XENP025328 vlCDR1
KSSQSIVHSNGNTYLE

SEQ ID NO: 40997 - protein, 7 aa, Artificial Sequence
  Description of Artificial Sequence: Synthetic peptide
  XENP025328 vlCDR2
KVSNRFS

SEQ ID NO: 40998 - protein, 9 aa, Artificial Sequence
  Description of Artificial Sequence: Synthetic peptide
  XENP025328 vlCDR3
FQGSHVPNT

SEQ ID NO: 40999 - protein, 446 aa, Artificial Sequence
  Description of Artificial Sequence: Synthetic polypeptide
  XENP025329 1C11_H3.232_L3_IgG1_PVA_/S267K Heavy Chain
QVQLVQSGSELKKPGESVKVSCKASGYTFTHYGINWVRQPPGQGLEWMGWINTYTGEPTYAPGFTGRFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41000 - protein, 117 aa, Artificial Sequence; identical to SEQ ID NO: 40651
  Description of Artificial Sequence: Synthetic polypeptide
  VH of XENP025329

SEQ ID NO: 41001 - protein, 5 aa, Artificial Sequence
  Description of Artificial Sequence: Synthetic peptide
  XENP025329 vhCDR1
HYGIN

SEQ ID NO: 41002 - protein, 17 aa, Artificial Sequence
  Description of Artificial Sequence: Synthetic peptide
  XENP025329 vhCDR2
WINTYTGEPTYAPGFTG

SEQ ID NO: 41003 - protein, 8 aa, Artificial Sequence
  Description of Artificial Sequence: Synthetic peptide
  XENP025329 vhCDR3
DYYGSSPY

SEQ ID NO: 41004 - protein, 219 aa, Artificial Sequence; identical to SEQ ID NO: 33008
  Description of Artificial Sequence: Synthetic polypeptide
  XENP025329 1C11_H3.232_L3_IgG1_PVA_/S267K Light Chain

SEQ ID NO: 41005 - protein, 112 aa, Artificial Sequence; identical to SEQ ID NO: 33009
  Description of Artificial Sequence: Synthetic polypeptide
  VL of XENP025329

SEQ ID NO: 41006 - protein, 16 aa, Artificial Sequence
  Description of Artificial Sequence: Synthetic peptide
  XENP025329 vlCDR1
KSSQSIVHSNGNTYLE

SEQ ID NO: 41007 - protein, 7 aa, Artificial Sequence
  Description of Artificial Sequence: Synthetic peptide
  XENP025329 vlCDR2
KVSNRFS

SEQ ID NO: 41008 - protein, 9 aa, Artificial Sequence
  Description of Artificial Sequence: Synthetic peptide
  XENP025329 vlCDR3
FQGSHVPNT

SEQ ID NO: 41009 - protein, 446 aa, Artificial Sequence
  Description of Artificial Sequence: Synthetic polypeptide
  XENP025330 1C11_H3.235_L3_IgG1_PVA_/S267K Heavy Chain
EVQLVQSGSELKKPGESVKVSCKASGYTFTHYGINWVRQPPGQGLEWMGWINTYTGEPTYAPGFTGRFVFSLDTSQSTAYLQISSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41010 - protein, 117 aa, Artificial Sequence; identical to SEQ ID NO: 40678
  Description of Artificial Sequence: Synthetic polypeptide
  VH of XENP025330

SEQ ID NO: 41011 - protein, 5 aa, Artificial Sequence
  Description of Artificial Sequence: Synthetic peptide
  XENP025330 vhCDR1
HYGIN

SEQ ID NO: 41012 - protein, 17 aa, Artificial Sequence
  Description of Artificial Sequence: Synthetic peptide
  XENP025330 vhCDR2
WINTYTGEPTYAPGFTG

SEQ ID NO: 41013 - protein, 8 aa, Artificial Sequence
  Description of Artificial Sequence: Synthetic peptide
  XENP025330 vhCDR3
DYYGSSPY

SEQ ID NO: 41014 - protein, 219 aa, Artificial Sequence; identical to SEQ ID NO: 33008
  Description of Artificial Sequence: Synthetic polypeptide
  XENP025330 1C11_H3.235_L3_IgG1_PVA_/S267K Light Chain

SEQ ID NO: 41015 - protein, 112 aa, Artificial Sequence; identical to SEQ ID NO: 33009
  Description of Artificial Sequence: Synthetic polypeptide
  VL of XENP025330

SEQ ID NO: 41016 - protein, 16 aa, Artificial Sequence
  Description of Artificial Sequence: Synthetic peptide
  XENP025330 vlCDR1
KSSQSIVHSNGNTYLE

SEQ ID NO: 41017 - protein, 7 aa, Artificial Sequence
  Description of Artificial Sequence: Synthetic peptide
  XENP025330 vlCDR2
KVSNRFS

SEQ ID NO: 41018 - protein, 9 aa, Artificial Sequence
  Description of Artificial Sequence: Synthetic peptide
  XENP025330 vlCDR3
FQGSHVPNT

SEQ ID NO: 41019 - protein, 446 aa, Artificial Sequence
  Description of Artificial Sequence: Synthetic polypeptide
  XENP025331 1C11_H3.236_L3_IgG1_PVA_/S267K Heavy Chain
EVQLVQSGSELKKPGESVKVSCKASGYTFTHYGINWVRQPPGQGLEWMGWINTYTGEPTYAPGFTGRFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41020 - protein, 117 aa, Artificial Sequence; identical to SEQ ID NO: 40687
  Description of Artificial Sequence: Synthetic polypeptide
  VH of XENP025331

SEQ ID NO: 41021 - protein, 5 aa, Artificial Sequence
  Description of Artificial Sequence: Synthetic peptide
  XENP025331 vhCDR1
HYGIN

SEQ ID NO: 41022 - protein, 17 aa, Artificial Sequence
  Description of Artificial Sequence: Synthetic peptide
  XENP025331 vhCDR2
WINTYTGEPTYAPGFTG

SEQ ID NO: 41023 - protein, 8 aa, Artificial Sequence
  Description of Artificial Sequence: Synthetic peptide
  XENP025331 vhCDR3
DYYGSSPY

SEQ ID NO: 41024 - protein, 219 aa, Artificial Sequence; identical to SEQ ID NO: 33008
  Description of Artificial Sequence: Synthetic polypeptide
  XENP025331 1C11_H3.236_L3_IgG1_PVA_/S267K Light Chain

SEQ ID NO: 41025 - protein, 112 aa, Artificial Sequence; identical to SEQ ID NO: 33009
  Description of Artificial Sequence: Synthetic polypeptide
  VL of XENP025331

SEQ ID NO: 41026 - protein, 16 aa, Artificial Sequence
  Description of Artificial Sequence: Synthetic peptide
  XENP025331 vlCDR1
KSSQSIVHSNGNTYLE

SEQ ID NO: 41027 - protein, 7 aa, Artificial Sequence
  Description of Artificial Sequence: Synthetic peptide
  XENP025331 vlCDR2
KVSNRFS

SEQ ID NO: 41028 - protein, 9 aa, Artificial Sequence
  Description of Artificial Sequence: Synthetic peptide
  XENP025331 vlCDR3
FQGSHVPNT

SEQ ID NO: 41029 - protein, 446 aa, Artificial Sequence
  Description of Artificial Sequence: Synthetic polypeptide
  XENP025332 1C11_H3.237_L3_IgG1_PVA_/S267K Heavy Chain
QVQLVQSGSELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41030 - protein, 117 aa, Artificial Sequence; identical to SEQ ID NO: 40696
  Description of Artificial Sequence: Synthetic polypeptide
  VH of XENP025332

SEQ ID NO: 41031 - protein, 5 aa, Artificial Sequence
  Description of Artificial Sequence: Synthetic peptide
  XENP025332 vhCDR1
HYGIN

SEQ ID NO: 41032 - protein, 17 aa, Artificial Sequence
  Description of Artificial Sequence: Synthetic peptide
  XENP025332 vhCDR2
WINTYTGEPYYAPGFTE

SEQ ID NO: 41033 - protein, 8 aa, Artificial Sequence
  Description of Artificial Sequence: Synthetic peptide
  XENP025332 vhCDR3
DYYGSSPY

SEQ ID NO: 41034 - protein, 219 aa, Artificial Sequence; identical to SEQ ID NO: 33008
  Description of Artificial Sequence: Synthetic polypeptide
  XENP025332 1C11_H3.237_L3_IgG1_PVA_/S267K Light Chain

SEQ ID NO: 41035 - protein, 112 aa, Artificial Sequence; identical to SEQ ID NO: 33009
  Description of Artificial Sequence: Synthetic polypeptide
  VL of XENP025332

SEQ ID NO: 41036 - protein, 16 aa, Artificial Sequence
  Description of Artificial Sequence: Synthetic peptide
  XENP025332 vlCDR1
KSSQSIVHSNGNTYLE

SEQ ID NO: 41037 - protein, 7 aa, Artificial Sequence
  Description of Artificial Sequence: Synthetic peptide
  XENP025332 vlCDR2
KVSNRFS

SEQ ID NO: 41038 - protein, 9 aa, Artificial Sequence
  Description of Artificial Sequence: Synthetic peptide
  XENP025332 vlCDR3
FQGSHVPNT

SEQ ID NO: 41039 - protein, 446 aa, Artificial Sequence
  Description of Artificial Sequence: Synthetic polypeptide
  XENP025333 1C11_H3.238_L3_IgG1_PVA_/S267K Heavy Chain
QVQLVQSGSELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41040 - protein, 117 aa, Artificial Sequence; identical to SEQ ID NO: 40705
  Description of Artificial Sequence: Synthetic polypeptide
  VH of XENP025333

SEQ ID NO: 41041 - protein, 5 aa, Artificial Sequence
  Description of Artificial Sequence: Synthetic peptide
  XENP025333 vhCDR1
HYGIN

SEQ ID NO: 41042 - protein, 17 aa, Artificial Sequence
  Description of Artificial Sequence: Synthetic peptide
  XENP025333 vhCDR2
WINTYTGEPYYAPGFQE

SEQ ID NO: 41043 - protein, 8 aa, Artificial Sequence
  Description of Artificial Sequence: Synthetic peptide
  XENP025333 vhCDR3
DYYGSSPY

SEQ ID NO: 41044 - protein, 219 aa, Artificial Sequence; identical to SEQ ID NO: 33008
  Description of Artificial Sequence: Synthetic polypeptide
  XENP025333 1C11_H3.238_L3_IgG1_PVA_/S267K Light Chain

SEQ ID NO: 41045 - protein, 112 aa, Artificial Sequence; identical to SEQ ID NO: 33009
  Description of Artificial Sequence: Synthetic polypeptide
  VL of XENP025333

SEQ ID NO: 41046 - protein, 16 aa, Artificial Sequence
  Description of Artificial Sequence: Synthetic peptide
  XENP025333 vlCDR1
KSSQSIVHSNGNTYLE

SEQ ID NO: 41047 - protein, 7 aa, Artificial Sequence
  Description of Artificial Sequence: Synthetic peptide
  XENP025333 vlCDR2
KVSNRFS

SEQ ID NO: 41048 - protein, 9 aa, Artificial Sequence
  Description of Artificial Sequence: Synthetic peptide
  XENP025333 vlCDR3
FQGSHVPNT

SEQ ID NO: 41049 - protein, 446 aa, Artificial Sequence
  Description of Artificial Sequence: Synthetic polypeptide
  XENP025334 1C11[PD-1]_H3.188_L3.144_IgG1_PVA_/S267K Heavy Chain
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41050 - protein, 117 aa, Artificial Sequence; identical to SEQ ID NO: 35324
  Description of Artificial Sequence: Synthetic polypeptide
  VH of XENP025334

SEQ ID NO: 41051 - protein, 5 aa, Artificial Sequence
  Description of Artificial Sequence: Synthetic peptide
  XENP025334 vhCDR1
HYGIN

SEQ ID NO: 41052 - protein, 17 aa, Artificial Sequence
  Description of Artificial Sequence: Synthetic peptide
  XENP025334 vhCDR2
WINTYTGEPYYAPGFTG

SEQ ID NO: 41053 - protein, 8 aa, Artificial Sequence
  Description of Artificial Sequence: Synthetic peptide
  XENP025334 vhCDR3
DYYGSSPY

SEQ ID NO: 41054 - protein, 219 aa, Artificial Sequence
  Description of Artificial Sequence: Synthetic polypeptide
  XENP025334 1C11[PD-1]_H3.188_L3.144_IgG1_PVA_/S267K Light Chain
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41055 - protein, 112 aa, Artificial Sequence; identical to SEQ ID NO: 40517
  Description of Artificial Sequence: Synthetic polypeptide
  VL of XENP025334

SEQ ID NO: 41056 - protein, 16 aa, Artificial Sequence
  Description of Artificial Sequence: Synthetic peptide
  XENP025334 vlCDR1
KASQSIVHSNGNTYLE

SEQ ID NO: 41057 - protein, 7 aa, Artificial Sequence
  Description of Artificial Sequence: Synthetic peptide
  XENP025334 vlCDR2
KVSNRFS

SEQ ID NO: 41058 - protein, 9 aa, Artificial Sequence
  Description of Artificial Sequence: Synthetic peptide
  XENP025334 vlCDR3
FQGSHVPNT

SEQ ID NO: 41059 - protein, 446 aa, Artificial Sequence; identical to SEQ ID NO: 41049
  Description of Artificial Sequence: Synthetic polypeptide
  XENP025335 1C11[PD-1]_H3.188_L3.148_IgG1_PVA_/S267K Heavy Chain

SEQ ID NO: 41060 - protein, 117 aa, Artificial Sequence; identical to SEQ ID NO: 35324
  Description of Artificial Sequence: Synthetic polypeptide
  VH of XENP025335

SEQ ID NO: 41061 - protein, 5 aa, Artificial Sequence
  Description of Artificial Sequence: Synthetic peptide
  XENP025335 vhCDR1
HYGIN

SEQ ID NO: 41062 - protein, 17 aa, Artificial Sequence
  Description of Artificial Sequence: Synthetic peptide
  XENP025335 vhCDR2
WINTYTGEPYYAPGFTG

SEQ ID NO: 41063 - protein, 8 aa, Artificial Sequence
  Description of Artificial Sequence: Synthetic peptide
  XENP025335 vhCDR3
DYYGSSPY

SEQ ID NO: 41064 - protein, 219 aa, Artificial Sequence
  Description of Artificial Sequence: Synthetic polypeptide
  XENP025335 1C11[PD-1]_H3.188_L3.148_IgG1_PVA_/S267K Light Chain
DIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41065 - protein, 112 aa, Artificial Sequence; identical to SEQ ID NO: 40553
  Description of Artificial Sequence: Synthetic polypeptide
  VL of XENP025335

SEQ ID NO: 41066 - protein, 16 aa, Artificial Sequence
  Description of Artificial Sequence: Synthetic peptide
  XENP025335 vlCDR1
KASQSIVHSNGNTYLE

SEQ ID NO: 41067 - protein, 7 aa, Artificial Sequence
  Description of Artificial Sequence: Synthetic peptide
  XENP025335 vlCDR2
KVSNRFS

SEQ ID NO: 41068 - protein, 9 aa, Artificial Sequence
  Description of Artificial Sequence: Synthetic peptide
  XENP025335 vlCDR3
FQGSHVPNT

SEQ ID NO: 41069 - protein, 446 aa, Artificial Sequence; identical to SEQ ID NO: 40939
  Description of Artificial Sequence: Synthetic polypeptide
  XENP025336 1C11[PD-1]_H3.224_L3.144_IgG1_PVA_/S267K Heavy Chain

SEQ ID NO: 41070 - protein, 117 aa, Artificial Sequence; identical to SEQ ID NO: 40579
  Description of Artificial Sequence: Synthetic polypeptide
  VH of XENP025336

SEQ ID NO: 41071 - protein, 5 aa, Artificial Sequence
  Description of Artificial Sequence: Synthetic peptide
  XENP025336 vhCDR1
HYGIN

SEQ ID NO: 41072 - protein, 17 aa, Artificial Sequence
  Description of Artificial Sequence: Synthetic peptide
  XENP025336 vhCDR2
WINTYTGEPYYAPGFQE

SEQ ID NO: 41073 - protein, 8 aa, Artificial Sequence
  Description of Artificial Sequence: Synthetic peptide
  XENP025336 vhCDR3
DYYGSSPY

SEQ ID NO: 41074 - protein, 219 aa, Artificial Sequence; identical to SEQ ID NO: 41054
  Description of Artificial Sequence: Synthetic polypeptide
  XENP025336 1C11[PD-1]_H3.224_L3.144_IgG1_PVA_/S267K Light Chain

SEQ ID NO: 41075 - protein, 112 aa, Artificial Sequence; identical to SEQ ID NO: 40517
  Description of Artificial Sequence: Synthetic polypeptide
  VL of XENP025336

SEQ ID NO: 41076 - protein, 16 aa, Artificial Sequence
  Description of Artificial Sequence: Synthetic peptide
  XENP025336 vlCDR1
KASQSIVHSNGNTYLE

SEQ ID NO: 41077 - protein, 7 aa, Artificial Sequence
  Description of Artificial Sequence: Synthetic peptide
  XENP025336 vlCDR2
KVSNRFS

SEQ ID NO: 41078 - protein, 9 aa, Artificial Sequence
  Description of Artificial Sequence: Synthetic peptide
  XENP025336 vlCDR3
FQGSHVPNT

SEQ ID NO: 41079 - protein, 446 aa, Artificial Sequence; identical to SEQ ID NO: 40939
  Description of Artificial Sequence: Synthetic polypeptide
  XENP025337 1C11[PD-1]_H3.224_L3.148_IgG1_PVA_/S267K Heavy Chain

SEQ ID NO: 41080 - protein, 117 aa, Artificial Sequence; identical to SEQ ID NO: 40579
  Description of Artificial Sequence: Synthetic polypeptide
  VH of XENP025337

SEQ ID NO: 41081 - protein, 5 aa, Artificial Sequence
  Description of Artificial Sequence: Synthetic peptide
  XENP025337 vhCDR1
HYGIN

SEQ ID NO: 41082 - protein, 17 aa, Artificial Sequence
  Description of Artificial Sequence: Synthetic peptide
  XENP025337 vhCDR2
WINTYTGEPYYAPGFQE

SEQ ID NO: 41083 - protein, 8 aa, Artificial Sequence
  Description of Artificial Sequence: Synthetic peptide
  XENP025337 vhCDR3
DYYGSSPY

SEQ ID NO: 41084 - protein, 219 aa, Artificial Sequence; identical to SEQ ID NO: 41064
  Description of Artificial Sequence: Synthetic polypeptide
  XENP025337 1C11[PD-1]_H3.224_L3.148_IgG1_PVA_/S267K Light Chain

SEQ ID NO: 41085 - protein, 112 aa, Artificial Sequence; identical to SEQ ID NO: 40553
  Description of Artificial Sequence: Synthetic polypeptide
  VL of XENP025337

SEQ ID NO: 41086 - protein, 16 aa, Artificial Sequence
  Description of Artificial Sequence: Synthetic peptide
  XENP025337 vlCDR1
KASQSIVHSNGNTYLE

SEQ ID NO: 41087 - protein, 7 aa, Artificial Sequence
  Description of Artificial Sequence: Synthetic peptide
  XENP025337 vlCDR2
KVSNRFS

SEQ ID NO: 41088 - protein, 9 aa, Artificial Sequence
  Description of Artificial Sequence: Synthetic peptide
  XENP025337 vlCDR3
FQGSHVPNT

SEQ ID NO: 41089 - protein, 446 aa, Artificial Sequence; identical to SEQ ID NO: 40959
  Description of Artificial Sequence: Synthetic polypeptide
  XENP025338 1C11[PD-1]_H3.226_L3.144_IgG1_PVA_/S267K Heavy Chain

SEQ ID NO: 41090 - protein, 117 aa, Artificial Sequence; identical to SEQ ID NO: 40597
  Description of Artificial Sequence: Synthetic polypeptide
  VH of XENP025338

SEQ ID NO: 41091 - protein, 5 aa, Artificial Sequence
  Description of Artificial Sequence: Synthetic peptide
  XENP025338 vhCDR1
HYGIN

SEQ ID NO: 41092 - protein, 17 aa, Artificial Sequence
  Description of Artificial Sequence: Synthetic peptide
  XENP025338 vhCDR2
WINTYTGEPYYAPGFQE

SEQ ID NO: 41093 - protein, 8 aa, Artificial Sequence
  Description of Artificial Sequence: Synthetic peptide
  XENP025338 vhCDR3
DYYGSSPY

SEQ ID NO: 41094 - protein, 219 aa, Artificial Sequence; identical to SEQ ID NO: 41054
  Description of Artificial Sequence: Synthetic polypeptide
  XENP025338 1C11[PD-1]_H3.226_L3.144_IgG1_PVA_/S267K Light Chain

SEQ ID NO: 41095 - protein, 112 aa, Artificial Sequence; identical to SEQ ID NO: 40517
  Description of Artificial Sequence: Synthetic polypeptide
  VL of XENP025338

SEQ ID NO: 41096 - protein, 16 aa, Artificial Sequence
  Description of Artificial Sequence: Synthetic peptide
  XENP025338 vlCDR1
KASQSIVHSNGNTYLE

SEQ ID NO: 41097 - protein, 7 aa, Artificial Sequence
  Description of Artificial Sequence: Synthetic peptide
  XENP025338 vlCDR2
KVSNRFS

SEQ ID NO: 41098 - protein, 9 aa, Artificial Sequence
  Description of Artificial Sequence: Synthetic peptide
  XENP025338 vlCDR3
FQGSHVPNT

SEQ ID NO: 41099 - protein, 446 aa, Artificial Sequence; identical to SEQ ID NO: 40959
  Description of Artificial Sequence: Synthetic polypeptide
  XENP025339 1C11[PD-1]_H3.226_L3.148_IgG1_PVA_/S267K Heavy Chain

SEQ ID NO: 41100 - protein, 117 aa, Artificial Sequence; identical to SEQ ID NO: 40597
  Description of Artificial Sequence: Synthetic polypeptide
  VH of XENP025339

SEQ ID NO: 41101 - protein, 5 aa, Artificial Sequence
  Description of Artificial Sequence: Synthetic peptide
  XENP025339 vhCDR1
HYGIN

SEQ ID NO: 41102 - protein, 17 aa, Artificial Sequence
  Description of Artificial Sequence: Synthetic peptide
  XENP025339 vhCDR2
WINTYTGEPYYAPGFQE

SEQ ID NO: 41103 - protein, 8 aa, Artificial Sequence
  Description of Artificial Sequence: Synthetic peptide
  XENP025339 vhCDR3
DYYGSSPY

SEQ ID NO: 41104 - protein, 219 aa, Artificial Sequence; identical to SEQ ID NO: 41064
  Description of Artificial Sequence: Synthetic polypeptide
  XENP025339 1C11[PD-1]_H3.226_L3.148_IgG1_PVA_/S267K Light Chain

SEQ ID NO: 41105 - protein, 112 aa, Artificial Sequence; identical to SEQ ID NO: 40553
  Description of Artificial Sequence: Synthetic polypeptide
  VL of XENP025339

SEQ ID NO: 41106 - protein, 16 aa, Artificial Sequence
  Description of Artificial Sequence: Synthetic peptide
  XENP025339 vlCDR1
KASQSIVHSNGNTYLE

SEQ ID NO: 41107 - protein, 7 aa, Artificial Sequence
  Description of Artificial Sequence: Synthetic peptide
  XENP025339 vlCDR2
KVSNRFS

SEQ ID NO: 41108 - protein, 9 aa, Artificial Sequence
  Description of Artificial Sequence: Synthetic peptide
  XENP025339 vlCDR3
FQGSHVPNT

SEQ ID NO: 41109 - protein, 446 aa, Artificial Sequence; identical to SEQ ID NO: 41049
  Description of Artificial Sequence: Synthetic polypeptide
  XENP025340 1C11[PD-1]_H3.188_L3_IgG1_PVA_/S267K Heavy Chain

SEQ ID NO: 41110 - protein, 117 aa, Artificial Sequence; identical to SEQ ID NO: 35324
  Description of Artificial Sequence: Synthetic polypeptide
  VH of XENP025340

SEQ ID NO: 41111 - protein, 5 aa, Artificial Sequence
  Description of Artificial Sequence: Synthetic peptide
  XENP025340 vhCDR1
HYGIN

SEQ ID NO: 41112 - protein, 17 aa, Artificial Sequence
  Description of Artificial Sequence: Synthetic peptide
  XENP025340 vhCDR2
WINTYTGEPYYAPGFTG

SEQ ID NO: 41113 - protein, 8 aa, Artificial Sequence
  Description of Artificial Sequence: Synthetic peptide
  XENP025340 vhCDR3
DYYGSSPY

SEQ ID NO: 41114 - protein, 219 aa, Artificial Sequence; identical to SEQ ID NO: 33008
  Description of Artificial Sequence: Synthetic polypeptide
  XENP025340 1C11[PD-1]_H3.188_L3_IgG1_PVA_/S267K Light Chain

SEQ ID NO: 41115 - protein, 112 aa, Artificial Sequence; identical to SEQ ID NO: 33009
  Description of Artificial Sequence: Synthetic polypeptide
  VL of XENP025340

SEQ ID NO: 41116 - protein, 16 aa, Artificial Sequence
  Description of Artificial Sequence: Synthetic peptide
  XENP025340 vlCDR1
KSSQSIVHSNGNTYLE

SEQ ID NO: 41117 - protein, 7 aa, Artificial Sequence
  Description of Artificial Sequence: Synthetic peptide
  XENP025340 vlCDR2
KVSNRFS

SEQ ID NO: 41118 - protein, 9 aa, Artificial Sequence
  Description of Artificial Sequence: Synthetic peptide
  XENP025340 vlCDR3
FQGSHVPNT

SEQ ID NO: 41119 - protein, 446 aa, Artificial Sequence; identical to SEQ ID NO: 39254
  Description of Artificial Sequence: Synthetic polypeptide
  XENP025341 1C11[PD-1]_H3_L3.141_IgG1_PVA_/S267K Heavy Chain

SEQ ID NO: 41120 - protein, 117 aa, Artificial Sequence; identical to SEQ ID NO: 33034
  Description of Artificial Sequence: Synthetic polypeptide
  VH of XENP025341

SEQ ID NO: 41121 - protein, 5 aa, Artificial Sequence
  Description of Artificial Sequence: Synthetic peptide
  XENP025341 vhCDR1
HYGMN

SEQ ID NO: 41122 - protein, 17 aa, Artificial Sequence
  Description of Artificial Sequence: Synthetic peptide
  XENP025341 vhCDR2
WINTYTGEPTYADGFTG

SEQ ID NO: 41123 - protein, 8 aa, Artificial Sequence
  Description of Artificial Sequence: Synthetic peptide
  XENP025341 vhCDR3
DYYGSSPY

SEQ ID NO: 41124 - protein, 219 aa, Artificial Sequence
  Description of Artificial Sequence: Synthetic polypeptide
  XENP025341 1C11[PD-1]_H3_L3.141_IgG1_PVA_/S267K Light Chain
DIVMTQSPDSLAVSLGERATINCKASQSIVHSNGNTYLEWYQQKPGQPPKLLIYKVSNRFSGVPDRFSGSGSGTDFTLTISSVEAEDVATYYCFQGSHVPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41125 - protein, 112 aa, Artificial Sequence; identical to SEQ ID NO: 40076
  Description of Artificial Sequence: Synthetic polypeptide
  VL of XENP025341

SEQ ID NO: 41126 - protein, 16 aa, Artificial Sequence
  Description of Artificial Sequence: Synthetic peptide
  XENP025341 vlCDR1
KASQSIVHSNGNTYLE

SEQ ID NO: 41127 - protein, 7 aa, Artificial Sequence
  Description of Artificial Sequence: Synthetic peptide
  XENP025341 vlCDR2
KVSNRFS

SEQ ID NO: 41128 - protein, 9 aa, Artificial Sequence
  Description of Artificial Sequence: Synthetic peptide
  XENP025341 vlCDR3
FQGSHVPNT

SEQ ID NO: 41129 - protein, 446 aa, Artificial Sequence; identical to SEQ ID NO: 39254
  Description of Artificial Sequence: Synthetic polypeptide
  XENP025342 1C11[PD-1]_H3_L3.142_IgG1_PVA_/S267K Heavy Chain

SEQ ID NO: 41130 - protein, 117 aa, Artificial Sequence; identical to SEQ ID NO: 33034
  Description of Artificial Sequence: Synthetic polypeptide
  VH of XENP025342

SEQ ID NO: 41131 - protein, 5 aa, Artificial Sequence
  Description of Artificial Sequence: Synthetic peptide
  XENP025342 vhCDR1
HYGMN

SEQ ID NO: 41132 - protein, 17 aa, Artificial Sequence
  Description of Artificial Sequence: Synthetic peptide
  XENP025342 vhCDR2
WINTYTGEPTYADGFTG

SEQ ID NO: 41133 - protein, 8 aa, Artificial Sequence
  Description of Artificial Sequence: Synthetic peptide
  XENP025342 vhCDR3
DYYGSSPY

SEQ ID NO: 41134 - protein, 219 aa, Artificial Sequence
  Description of Artificial Sequence: Synthetic polypeptide
  XENP025342 1C11[PD-1]_H3_L3.142_IgG1_PVA_/S267K Light Chain
DIVMTQSPDSLAVSLGERATINCKASQSIVHSNGNTYLEWYQQKPGQAPKLLIYKVSNRFSGVPDRFSGSGSGTDFTLTISSVEAEDVATYYCFQGSHVPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41135 - protein, 112 aa, Artificial Sequence; identical to SEQ ID NO: 40085
  Description of Artificial Sequence: Synthetic polypeptide
  VL of XENP025342

SEQ ID NO: 41136 - protein, 16 aa, Artificial Sequence
  Description of Artificial Sequence: Synthetic peptide
  XENP025342 vlCDR1
KASQSIVHSNGNTYLE

SEQ ID NO: 41137 - protein, 7 aa, Artificial Sequence
  Description of Artificial Sequence: Synthetic peptide
  XENP025342 vlCDR2
KVSNRFS

SEQ ID NO: 41138 - protein, 9 aa, Artificial Sequence
  Description of Artificial Sequence: Synthetic peptide
  XENP025342 vlCDR3
FQGSHVPNT

SEQ ID NO: 41139 - protein, 446 aa, Artificial Sequence; identical to SEQ ID NO: 39254
  Description of Artificial Sequence: Synthetic polypeptide
  XENP025820 1C11[PD-1]_H3_L3.144_IgG1_PVA_/S267K Heavy Chain

SEQ ID NO: 41140 - protein, 117 aa, Artificial Sequence; identical to SEQ ID NO: 33034
  Description of Artificial Sequence: Synthetic polypeptide
  VH of XENP025820

SEQ ID NO: 41141 - protein, 5 aa, Artificial Sequence
  Description of Artificial Sequence: Synthetic peptide
  XENP025820 vhCDR1
HYGMN

SEQ ID NO: 41142 - protein, 17 aa, Artificial Sequence
  Description of Artificial Sequence: Synthetic peptide
  XENP025820 vhCDR2
WINTYTGEPTYADGFTG

SEQ ID NO: 41143 - protein, 8 aa, Artificial Sequence
  Description of Artificial Sequence: Synthetic peptide
  XENP025820 vhCDR3
DYYGSSPY

SEQ ID NO: 41144 - protein, 219 aa, Artificial Sequence; identical to SEQ ID NO: 41054
  Description of Artificial Sequence: Synthetic polypeptide
  XENP025820 1C11[PD-1]_H3_L3.144_IgG1_PVA_/S267K Light Chain

SEQ ID NO: 41145 - protein, 112 aa, Artificial Sequence; identical to SEQ ID NO: 40517
  Description of Artificial Sequence: Synthetic polypeptide
  VL of XENP025820

SEQ ID NO: 41146 - protein, 16 aa, Artificial Sequence
  Description of Artificial Sequence: Synthetic peptide
  XENP025820 vlCDR1
KASQSIVHSNGNTYLE

SEQ ID NO: 41147 - protein, 7 aa, Artificial Sequence
  Description of Artificial Sequence: Synthetic peptide
  XENP025820 vlCDR2
KVSNRFS

SEQ ID NO: 41148 - protein, 9 aa, Artificial Sequence
  Description of Artificial Sequence: Synthetic peptide
  XENP025820 vlCDR3
FQGSHVPNT

SEQ ID NO: 41149 - protein, 446 aa, Artificial Sequence; identical to SEQ ID NO: 39254
  Description of Artificial Sequence: Synthetic polypeptide
  XENP025821 1C11[PD-1]_H3_L3.148_IgG1_PVA_/S267K Heavy Chain

SEQ ID NO: 41150 - protein, 117 aa, Artificial Sequence; identical to SEQ ID NO: 33034
  Description of Artificial Sequence: Synthetic polypeptide
  VH of XENP025821

SEQ ID NO: 41151 - protein, 5 aa, Artificial Sequence
  Description of Artificial Sequence: Synthetic peptide
  XENP025821 vhCDR1
HYGMN

SEQ ID NO: 41152 - protein, 17 aa, Artificial Sequence
  Description of Artificial Sequence: Synthetic peptide
  XENP025821 vhCDR2
WINTYTGEPTYADGFTG

SEQ ID NO: 41153 - protein, 8 aa, Artificial Sequence
  Description of Artificial Sequence: Synthetic peptide
  XENP025821 vhCDR3
DYYGSSPY

SEQ ID NO: 41154 - protein, 219 aa, Artificial Sequence; identical to SEQ ID NO: 41064
  Description of Artificial Sequence: Synthetic polypeptide
  XENP025821 1C11[PD-1]_H3_L3.148_IgG1_PVA_/S267K Light Chain

SEQ ID NO: 41155 - protein, 112 aa, Artificial Sequence; identical to SEQ ID NO: 40553
  Description of Artificial Sequence: Synthetic polypeptide
  VL of XENP025821

SEQ ID NO: 41156 - protein, 16 aa, Artificial Sequence
  Description of Artificial Sequence: Synthetic peptide
  XENP025821 vlCDR1
KASQSIVHSNGNTYLE

SEQ ID NO: 41157 - protein, 7 aa, Artificial Sequence
  Description of Artificial Sequence: Synthetic peptide
  XENP025821 vlCDR2
KVSNRFS

SEQ ID NO: 41158 - protein, 9 aa, Artificial Sequence
  Description of Artificial Sequence: Synthetic peptide
  XENP025821 vlCDR3
FQGSHVPNT

SEQ ID NO: 41159 - protein, 446 aa, Artificial Sequence
  Description of Artificial Sequence: Synthetic polypeptide
  XENP025822 1C11[PD-1]_H3.216_L3_IgG1_PVA_/S267K Heavy Chain
QVQLVQSGPELKKPGESVKVSCKASGYTFTHYGINWVRQPPGQGLEWMGWINTYTGEPYYAPGFTGRFVFSIDTSQSTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41160 - protein, 117 aa, Artificial Sequence; identical to SEQ ID NO: 40453
  Description of Artificial Sequence: Synthetic polypeptide
  VH of XENP025822

SEQ ID NO: 41161 - protein, 5 aa, Artificial Sequence
  Description of Artificial Sequence: Synthetic peptide
  XENP025822 vhCDR1
HYGIN

SEQ ID NO: 41162 - protein, 17 aa, Artificial Sequence
  Description of Artificial Sequence: Synthetic peptide
  XENP025822 vhCDR2
WINTYTGEPYYAPGFTG

SEQ ID NO: 41163 - protein, 8 aa, Artificial Sequence
  Description of Artificial Sequence: Synthetic peptide
  XENP025822 vhCDR3
DYYGSSPY

SEQ ID NO: 41164 - protein, 219 aa, Artificial Sequence; identical to SEQ ID NO: 33008
  Description of Artificial Sequence: Synthetic polypeptide
  XENP025822 1C11[PD-1]_H3.216_L3_IgG1_PVA_/S267K Light Chain

SEQ ID NO: 41165 - protein, 112 aa, Artificial Sequence; identical to SEQ ID NO: 33009
  Description of Artificial Sequence: Synthetic polypeptide
  VL of XENP025822

SEQ ID NO: 41166 - protein, 16 aa, Artificial Sequence
  Description of Artificial Sequence: Synthetic peptide
  XENP025822 vlCDR1
KSSQSIVHSNGNTYLE

SEQ ID NO: 41167 - protein, 7 aa, Artificial Sequence
  Description of Artificial Sequence: Synthetic peptide
  XENP025822 vlCDR2
KVSNRFS

SEQ ID NO: 41168 - protein, 9 aa, Artificial Sequence
  Description of Artificial Sequence: Synthetic peptide
  XENP025822 vlCDR3
FQGSHVPNT

SEQ ID NO: 41169 - protein, 446 aa, Artificial Sequence
  Description of Artificial Sequence: Synthetic polypeptide
  XENP025823 1C11[PD-1]_H3.228_L3_IgG1_PVA_/S267K Heavy Chain
EVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41170 - protein, 117 aa, Artificial Sequence; identical to SEQ ID NO: 40615
  Description of Artificial Sequence: Synthetic polypeptide
  VH of XENP025823

SEQ ID NO: 41171 - protein, 5 aa, Artificial Sequence
  Description of Artificial Sequence: Synthetic peptide
  XENP025823 vhCDR1
HYGIN

SEQ ID NO: 41172 - protein, 17 aa, Artificial Sequence
  Description of Artificial Sequence: Synthetic peptide
  XENP025823 vhCDR2
WINTYTGEPYYAPGFQE

SEQ ID NO: 41173 - protein, 8 aa, Artificial Sequence
  Description of Artificial Sequence: Synthetic peptide
  XENP025823 vhCDR3
DYYGSSPY

SEQ ID NO: 41174 - protein, 219 aa, Artificial Sequence; identical to SEQ ID NO: 33008
  Description of Artificial Sequence: Synthetic polypeptide
  XENP025823 1C11[PD-1]_H3.228_L3_IgG1_PVA_/S267K Light Chain

SEQ ID NO: 41175 - protein, 112 aa, Artificial Sequence; identical to SEQ ID NO: 33009
  Description of Artificial Sequence: Synthetic polypeptide
  VL of XENP025823

SEQ ID NO: 41176 - protein, 16 aa, Artificial Sequence
  Description of Artificial Sequence: Synthetic peptide
  XENP025823 vlCDR1
KSSQSIVHSNGNTYLE

SEQ ID NO: 41177 - protein, 7 aa, Artificial Sequence
  Description of Artificial Sequence: Synthetic peptide
  XENP025823 vlCDR2
KVSNRFS

SEQ ID NO: 41178 - protein, 9 aa, Artificial Sequence
  Description of Artificial Sequence: Synthetic peptide
  XENP025823 vlCDR3
FQGSHVPNT

SEQ ID NO: 41179 - protein, 446 aa, Artificial Sequence
  Description of Artificial Sequence: Synthetic polypeptide
  XENP025824 1C11[PD-1]_H3.234_L3_IgG1_PVA_/S267K Heavy Chain
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41180 - protein, 117 aa, Artificial Sequence; identical to SEQ ID NO: 40669
  Description of Artificial Sequence: Synthetic polypeptide
  VH of XENP025824

SEQ ID NO: 41181 - protein, 5 aa, Artificial Sequence
  Description of Artificial Sequence: Synthetic peptide
  XENP025824 vhCDR1
HYGIN

SEQ ID NO: 41182 - protein, 17 aa, Artificial Sequence
  Description of Artificial Sequence: Synthetic peptide
  XENP025824 vhCDR2
WINTYTGEPYYAPGFQE

SEQ ID NO: 41183 - protein, 8 aa, Artificial Sequence
  Description of Artificial Sequence: Synthetic peptide
  XENP025824 vhCDR3
DYYGSSPY

SEQ ID NO: 41184 - protein, 219 aa, Artificial Sequence; identical to SEQ ID NO: 33008
  Description of Artificial Sequence: Synthetic polypeptide
  XENP025824 1C11[PD-1]_H3.234_L3_IgG1_PVA_/S267K Light Chain

SEQ ID NO: 41185 - protein, 112 aa, Artificial Sequence; identical to SEQ ID NO: 33009
  Description of Artificial Sequence: Synthetic polypeptide
  VL of XENP025824

SEQ ID NO: 41186 - protein, 16 aa, Artificial Sequence
  Description of Artificial Sequence: Synthetic peptide
  XENP025824 vlCDR1
KSSQSIVHSNGNTYLE

SEQ ID NO: 41187 - protein, 7 aa, Artificial Sequence
  Description of Artificial Sequence: Synthetic peptide
  XENP025824 vlCDR2
KVSNRFS

SEQ ID NO: 41188 - protein, 9 aa, Artificial Sequence
  Description of Artificial Sequence: Synthetic peptide
  XENP025824 vlCDR3
FQGSHVPNT

SEQ ID NO: 41189 - protein, 446 aa, Artificial Sequence
  Description of Artificial Sequence: Synthetic polypeptide
  XENP025825 1C11[PD-1]_H3.239_L3.144_IgG1_PVA_/S267K Heavy Chain
EVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41190 - protein, 117 aa, Artificial Sequence; identical to SEQ ID NO: 40822
  Description of Artificial Sequence: Synthetic polypeptide
  VH of XENP025825

SEQ ID NO: 41191 - protein, 5 aa, Artificial Sequence
  Description of Artificial Sequence: Synthetic peptide
  XENP025825 vhCDR1
HYGIN

SEQ ID NO: 41192 - protein, 17 aa, Artificial Sequence
  Description of Artificial Sequence: Synthetic peptide
  XENP025825 vhCDR2
WINTYTGEPYYAPGFQE

SEQ ID NO: 41193 - protein, 8 aa, Artificial Sequence
  Description of Artificial Sequence: Synthetic peptide
  XENP025825 vhCDR3
DYYGSSPY

SEQ ID NO: 41194 - protein, 219 aa, Artificial Sequence; identical to SEQ ID NO: 41054
  Description of Artificial Sequence: Synthetic polypeptide
  XENP025825 1C11[PD-1]_H3.239_L3.144_IgG1_PVA_/S267K Light Chain

SEQ ID NO: 41195 - protein, 112 aa, Artificial Sequence; identical to SEQ ID NO: 40517
  Description of Artificial Sequence: Synthetic polypeptide
  VL of XENP025825

SEQ ID NO: 41196 - protein, 16 aa, Artificial Sequence
  Description of Artificial Sequence: Synthetic peptide
  XENP025825 vlCDR1
KASQSIVHSNGNTYLE

SEQ ID NO: 41197 - protein, 7 aa, Artificial Sequence
  Description of Artificial Sequence: Synthetic peptide
  XENP025825 vlCDR2
KVSNRFS

SEQ ID NO: 41198 - protein, 9 aa, Artificial Sequence
  Description of Artificial Sequence: Synthetic peptide
  XENP025825 vlCDR3
FQGSHVPNT

SEQ ID NO: 41199 - protein, 446 aa, Artificial Sequence
  Description of Artificial Sequence: Synthetic polypeptide
  XENP025826 1C11[PD-1]_H3.240_L3.144_IgG1_PVA_/S267K Heavy Chain
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41200 - protein, 117 aa, Artificial Sequence; identical to SEQ ID NO: 40831
  Description of Artificial Sequence: Synthetic polypeptide
  VH of XENP025826

SEQ ID NO: 41201 - protein, 5 aa, Artificial Sequence
  Description of Artificial Sequence: Synthetic peptide
  XENP025826 vhCDR1
HYGIN

SEQ ID NO: 41202 - protein, 17 aa, Artificial Sequence
  Description of Artificial Sequence: Synthetic peptide
  XENP025826 vhCDR2
WINTYTGEPYYAPGFQE

SEQ ID NO: 41203 - protein, 8 aa, Artificial Sequence
  Description of Artificial Sequence: Synthetic peptide
  XENP025826 vhCDR3
DYYGSSPY

SEQ ID NO: 41204 - protein, 219 aa, Artificial Sequence; identical to SEQ ID NO: 41054
  Description of Artificial Sequence: Synthetic polypeptide
  XENP025826 1C11[PD-1]_H3.240_L3.144_IgG1_PVA_/S267K Light Chain

SEQ ID NO: 41205 - protein, 112 aa, Artificial Sequence; identical to SEQ ID NO: 40517
  Description of Artificial Sequence: Synthetic polypeptide
  VL of XENP025826

SEQ ID NO: 41206 - protein, 16 aa, Artificial Sequence
  Description of Artificial Sequence: Synthetic peptide
  XENP025826 vlCDR1
KASQSIVHSNGNTYLE

SEQ ID NO: 41207 - protein, 7 aa, Artificial Sequence
  Description of Artificial Sequence: Synthetic peptide
  XENP025826 vlCDR2
KVSNRFS

SEQ ID NO: 41208 - protein, 9 aa, Artificial Sequence
  Description of Artificial Sequence: Synthetic peptide
  XENP025826 vlCDR3
FQGSHVPNT

SEQ ID NO: 41209 - protein, 446 aa, Artificial Sequence
  Description of Artificial Sequence: Synthetic polypeptide
  XENP025827 1C11[PD-1]_H3.241_L3.144_IgG1_PVA_/S267K Heavy Chain
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41210 - protein, 117 aa, Artificial Sequence; identical to SEQ ID NO: 40840
  Description of Artificial Sequence: Synthetic polypeptide
  VH of XENP025827

SEQ ID NO: 41211 - protein, 5 aa, Artificial Sequence
  Description of Artificial Sequence: Synthetic peptide
  XENP025827 vhCDR1
HYGIN

SEQ ID NO: 41212 - protein, 17 aa, Artificial Sequence
  Description of Artificial Sequence: Synthetic peptide
  XENP025827 vhCDR2
WINTYTGEPYYAPGFQE

SEQ ID NO: 41213 - protein, 8 aa, Artificial Sequence
  Description of Artificial Sequence: Synthetic peptide
  XENP025827 vhCDR3
DYYGSSPY

SEQ ID NO: 41214 - protein, 219 aa, Artificial Sequence; identical to SEQ ID NO: 41054
  Description of Artificial Sequence: Synthetic polypeptide
  XENP025827 1C11[PD-1]_H3.241_L3.144_IgG1_PVA_/S267K Light Chain

SEQ ID NO: 41215 - protein, 112 aa, Artificial Sequence; identical to SEQ ID NO: 40517
  Description of Artificial Sequence: Synthetic polypeptide
  VL of XENP025827

SEQ ID NO: 41216 - protein, 16 aa, Artificial Sequence
  Description of Artificial Sequence: Synthetic peptide
  XENP025827 vlCDR1
KASQSIVHSNGNTYLE

SEQ ID NO: 41217 - protein, 7 aa, Artificial Sequence
  Description of Artificial Sequence: Synthetic peptide
  XENP025827 vlCDR2
KVSNRFS

SEQ ID NO: 41218 - protein, 9 aa, Artificial Sequence
  Description of Artificial Sequence: Synthetic peptide
  XENP025827 vlCDR3
FQGSHVPNT

SEQ ID NO: 41219 - protein, 446 aa, Artificial Sequence; identical to SEQ ID NO: 41189
  Description of Artificial Sequence: Synthetic polypeptide
  XENP025828 1C11[PD-1]_H3.239_L3.148_IgG1_PVA_/S267K Heavy Chain

SEQ ID NO: 41220 - protein, 117 aa, Artificial Sequence; identical to SEQ ID NO: 40822
  Description of Artificial Sequence: Synthetic polypeptide
  VH of XENP025828

SEQ ID NO: 41221 - protein, 5 aa, Artificial Sequence
  Description of Artificial Sequence: Synthetic peptide
  XENP025828 vhCDR1
HYGIN

SEQ ID NO: 41222 - protein, 17 aa, Artificial Sequence
  Description of Artificial Sequence: Synthetic peptide
  XENP025828 vhCDR2
WINTYTGEPYYAPGFQE

SEQ ID NO: 41223 - protein, 8 aa, Artificial Sequence
  Description of Artificial Sequence: Synthetic peptide
  XENP025828 vhCDR3
DYYGSSPY

SEQ ID NO: 41224 - protein, 219 aa, Artificial Sequence; identical to SEQ ID NO: 41064
  Description of Artificial Sequence: Synthetic polypeptide
  XENP025828 1C11[PD-1]_H3.239_L3.148_IgG1_PVA_/S267K Light Chain

SEQ ID NO: 41225 - protein, 112 aa, Artificial Sequence; identical to SEQ ID NO: 40553
  Description of Artificial Sequence: Synthetic polypeptide
  VL of XENP025828

SEQ ID NO: 41226 - protein, 16 aa, Artificial Sequence
  Description of Artificial Sequence: Synthetic peptide
  XENP025828 vlCDR1
KASQSIVHSNGNTYLE

SEQ ID NO: 41227 - protein, 7 aa, Artificial Sequence
  Description of Artificial Sequence: Synthetic peptide
  XENP025828 vlCDR2
KVSNRFS

SEQ ID NO: 41228 - protein, 9 aa, Artificial Sequence
  Description of Artificial Sequence: Synthetic peptide
  XENP025828 vlCDR3
FQGSHVPNT

SEQ ID NO: 41229 - protein, 446 aa, Artificial Sequence; identical to SEQ ID NO: 41199
  Description of Artificial Sequence: Synthetic polypeptide
  XENP025829 1C11[PD-1]_H3.240_L3.148_IgG1_PVA_/S267K Heavy Chain

SEQ ID NO: 41230 - protein, 117 aa, Artificial Sequence; identical to SEQ ID NO: 40831
  Description of Artificial Sequence: Synthetic polypeptide
  VH of XENP025829

SEQ ID NO: 41231 - protein, 5 aa, Artificial Sequence
  Description of Artificial Sequence: Synthetic peptide
  XENP025829 vhCDR1
HYGIN

SEQ ID NO: 41232 - protein, 17 aa, Artificial Sequence
  Description of Artificial Sequence: Synthetic peptide
  XENP025829 vhCDR2
WINTYTGEPYYAPGFQE

SEQ ID NO: 41233 - protein, 8 aa, Artificial Sequence
  Description of Artificial Sequence: Synthetic peptide
  XENP025829 vhCDR3
DYYGSSPY

SEQ ID NO: 41234 - protein, 219 aa, Artificial Sequence; identical to SEQ ID NO: 41064
  Description of Artificial Sequence: Synthetic polypeptide
  XENP025829 1C11[PD-1]_H3.240_L3.148_IgG1_PVA_/S267K Light Chain

SEQ ID NO: 41235 - protein, 112 aa, Artificial Sequence; identical to SEQ ID NO: 40553
  Description of Artificial Sequence: Synthetic polypeptide
  VL of XENP025829

SEQ ID NO: 41236 - protein, 16 aa, Artificial Sequence
  Description of Artificial Sequence: Synthetic peptide
  XENP025829 vlCDR1
KASQSIVHSNGNTYLE

SEQ ID NO: 41237 - protein, 7 aa, Artificial Sequence
  Description of Artificial Sequence: Synthetic peptide
  XENP025829 vlCDR2
KVSNRFS

SEQ ID NO: 41238 - protein, 9 aa, Artificial Sequence
  Description of Artificial Sequence: Synthetic peptide
  XENP025829 vlCDR3
FQGSHVPNT

SEQ ID NO: 41239 - protein, 446 aa, Artificial Sequence; identical to SEQ ID NO: 41209
  Description of Artificial Sequence: Synthetic polypeptide
  XENP025830 1C11[PD-1]_H3.241_L3.148_IgG1_PVA_/S267K Heavy Chain

SEQ ID NO: 41240 - protein, 117 aa, Artificial Sequence; identical to SEQ ID NO: 40840
  Description of Artificial Sequence: Synthetic polypeptide
  VH of XENP025830

SEQ ID NO: 41241 - protein, 5 aa, Artificial Sequence
  Description of Artificial Sequence: Synthetic peptide
  XENP025830 vhCDR1
HYGIN

SEQ ID NO: 41242 - protein, 17 aa, Artificial Sequence
  Description of Artificial Sequence: Synthetic peptide
  XENP025830 vhCDR2
WINTYTGEPYYAPGFQE

SEQ ID NO: 41243 - protein, 8 aa, Artificial Sequence
  Description of Artificial Sequence: Synthetic peptide
  XENP025830 vhCDR3
DYYGSSPY

SEQ ID NO: 41244 - protein, 219 aa, Artificial Sequence; identical to SEQ ID NO: 41064
  Description of Artificial Sequence: Synthetic polypeptide
  XENP025830 1C11[PD-1]_H3.241_L3.148_IgG1_PVA_/S267K Light Chain

SEQ ID NO: 41245 - protein, 112 aa, Artificial Sequence; identical to SEQ ID NO: 40553
  Description of Artificial Sequence: Synthetic polypeptide
  VL of XENP025830

SEQ ID NO: 41246 - protein, 16 aa, Artificial Sequence
  Description of Artificial Sequence: Synthetic peptide
  XENP025830 vlCDR1
KASQSIVHSNGNTYLE

SEQ ID NO: 41247 - protein, 7 aa, Artificial Sequence
  Description of Artificial Sequence: Synthetic peptide
  XENP025830 vlCDR2
KVSNRFS

SEQ ID NO: 41248 - protein, 9 aa, Artificial Sequence
  Description of Artificial Sequence: Synthetic peptide
  XENP025830 vlCDR3
FQGSHVPNT

SEQ ID NO: 41249 - protein, 446 aa, Artificial Sequence; identical to SEQ ID NO: 41159
  Description of Artificial Sequence: Synthetic polypeptide
  XENP025831 1C11[PD-1]_H3.216_L3.144_IgG1_PVA_/S267K Heavy Chain

SEQ ID NO: 41250 - protein, 117 aa, Artificial Sequence; identical to SEQ ID NO: 40453
  Description of Artificial Sequence: Synthetic polypeptide
  VH of XENP025831

SEQ ID NO: 41251 - protein, 5 aa, Artificial Sequence
  Description of Artificial Sequence: Synthetic peptide
  XENP025831 vhCDR1
HYGIN

SEQ ID NO: 41252 - protein, 17 aa, Artificial Sequence
  Description of Artificial Sequence: Synthetic peptide
  XENP025831 vhCDR2
WINTYTGEPYYAPGFTG

SEQ ID NO: 41253 - protein, 8 aa, Artificial Sequence
  Description of Artificial Sequence: Synthetic peptide
  XENP025831 vhCDR3
DYYGSSPY

SEQ ID NO: 41254 - protein, 219 aa, Artificial Sequence; identical to SEQ ID NO: 41054
  Description of Artificial Sequence: Synthetic polypeptide
  XENP025831 1C11[PD-1]_H3.216_L3.144_IgG1_PVA_/S267K Light Chain

SEQ ID NO: 41255 - protein, 112 aa, Artificial Sequence; identical to SEQ ID NO: 40517
  Description of Artificial Sequence: Synthetic polypeptide
  VL of XENP025831

SEQ ID NO: 41256 - protein, 16 aa, Artificial Sequence
  Description of Artificial Sequence: Synthetic peptide
  XENP025831 vlCDR1
KASQSIVHSNGNTYLE

SEQ ID NO: 41257 - protein, 7 aa, Artificial Sequence
  Description of Artificial Sequence: Synthetic peptide
  XENP025831 vlCDR2
KVSNRFS

SEQ ID NO: 41258 - protein, 9 aa, Artificial Sequence
  Description of Artificial Sequence: Synthetic peptide
  XENP025831 vlCDR3
FQGSHVPNT

SEQ ID NO: 41259 - protein, 446 aa, Artificial Sequence; identical to SEQ ID NO: 41159
  Description of Artificial Sequence: Synthetic polypeptide
  XENP025832 1C11[PD-1]_H3.216_L3.148_IgG1_PVA_/S267K Heavy Chain

SEQ ID NO: 41260 - protein, 117 aa, Artificial Sequence; identical to SEQ ID NO: 40453
  Description of Artificial Sequence: Synthetic polypeptide
  VH of XENP025832

SEQ ID NO: 41261 - protein, 5 aa, Artificial Sequence
  Description of Artificial Sequence: Synthetic peptide
  XENP025832 vhCDR1
HYGIN

SEQ ID NO: 41262 - protein, 17 aa, Artificial Sequence
  Description of Artificial Sequence: Synthetic peptide
  XENP025832 vhCDR2
WINTYTGEPYYAPGFTG

SEQ ID NO: 41263 - protein, 8 aa, Artificial Sequence
  Description of Artificial Sequence: Synthetic peptide
  XENP025832 vhCDR3
DYYGSSPY

SEQ ID NO: 41264 - protein, 219 aa, Artificial Sequence; identical to SEQ ID NO: 41064
  Description of Artificial Sequence: Synthetic polypeptide
  XENP025832 1C11[PD-1]_H3.216_L3.148_IgG1_PVA_/S267K Light Chain

SEQ ID NO: 41265 - protein, 112 aa, Artificial Sequence; identical to SEQ ID NO: 40553
  Description of Artificial Sequence: Synthetic polypeptide
  VL of XENP025832

SEQ ID NO: 41266 - protein, 16 aa, Artificial Sequence
  Description of Artificial Sequence: Synthetic peptide
  XENP025832 vlCDR1
KASQSIVHSNGNTYLE

SEQ ID NO: 41267 - protein, 7 aa, Artificial Sequence
  Description of Artificial Sequence: Synthetic peptide
  XENP025832 vlCDR2
KVSNRFS

SEQ ID NO: 41268 - protein, 9 aa, Artificial Sequence
  Description of Artificial Sequence: Synthetic peptide
  XENP025832 vlCDR3
FQGSHVPNT

SEQ ID NO: 41269 - protein, 446 aa, Artificial Sequence; identical to SEQ ID NO: 41169
  Description of Artificial Sequence: Synthetic polypeptide
  XENP025833 1C11[PD-1]_H3.228_L3.144_IgG1_PVA_/S267K Heavy Chain

SEQ ID NO: 41270 - protein, 117 aa, Artificial Sequence; identical to SEQ ID NO: 40615
  Description of Artificial Sequence: Synthetic polypeptide
  VH of XENP025833

SEQ ID NO: 41271 - protein, 5 aa, Artificial Sequence
  Description of Artificial Sequence: Synthetic peptide
  XENP025833 vhCDR1
HYGIN

SEQ ID NO: 41272 - protein, 17 aa, Artificial Sequence
  Description of Artificial Sequence: Synthetic peptide
  XENP025833 vhCDR2
WINTYTGEPYYAPGFQE

SEQ ID NO: 41273 - protein, 8 aa, Artificial Sequence
  Description of Artificial Sequence: Synthetic peptide
  XENP025833 vhCDR3
DYYGSSPY

SEQ ID NO: 41274 - protein, 219 aa, Artificial Sequence; identical to SEQ ID NO: 41054
  Description of Artificial Sequence: Synthetic polypeptide
  XENP025833 1C11[PD-1]_H3.228_L3.144_IgG1_PVA_/S267K Light Chain

SEQ ID NO: 41275 - protein, 112 aa, Artificial Sequence; identical to SEQ ID NO: 40517
  Description of Artificial Sequence: Synthetic polypeptide
  VL of XENP025833

SEQ ID NO: 41276 - protein, 16 aa, Artificial Sequence
  Description of Artificial Sequence: Synthetic peptide
  XENP025833 vlCDR1
KASQSIVHSNGNTYLE

SEQ ID NO: 41277 - protein, 7 aa, Artificial Sequence
  Description of Artificial Sequence: Synthetic peptide
  XENP025833 vlCDR2
KVSNRFS

SEQ ID NO: 41278 - protein, 9 aa, Artificial Sequence
  Description of Artificial Sequence: Synthetic peptide
  XENP025833 vlCDR3
FQGSHVPNT

SEQ ID NO: 41279 - protein, 446 aa, Artificial Sequence; identical to SEQ ID NO: 41169
  Description of Artificial Sequence: Synthetic polypeptide
  XENP025834 1C11[PD-1]_H3.228_L3.148_IgG1_PVA_/S267K Heavy Chain

SEQ ID NO: 41280 - protein, 117 aa, Artificial Sequence; identical to SEQ ID NO: 40615
  Description of Artificial Sequence: Synthetic polypeptide
  VH of XENP025834

SEQ ID NO: 41281 - protein, 5 aa, Artificial Sequence
  Description of Artificial Sequence: Synthetic peptide
  XENP025834 vhCDR1
HYGIN

SEQ ID NO: 41282 - protein, 17 aa, Artificial Sequence
  Description of Artificial Sequence: Synthetic peptide
  XENP025834 vhCDR2
WINTYTGEPYYAPGFQE

SEQ ID NO: 41283 - protein, 8 aa, Artificial Sequence
  Description of Artificial Sequence: Synthetic peptide
  XENP025834 vhCDR3
DYYGSSPY

SEQ ID NO: 41284 - protein, 219 aa, Artificial Sequence; identical to SEQ ID NO: 41064
  Description of Artificial Sequence: Synthetic polypeptide
  XENP025834 1C11[PD-1]_H3.228_L3.148_IgG1_PVA_/S267K Light Chain

SEQ ID NO: 41285 - protein, 112 aa, Artificial Sequence; identical to SEQ ID NO: 40553
  Description of Artificial Sequence: Synthetic polypeptide
  VL of XENP025834

SEQ ID NO: 41286 - protein, 16 aa, Artificial Sequence
  Description of Artificial Sequence: Synthetic peptide
  XENP025834 vlCDR1
KASQSIVHSNGNTYLE

SEQ ID NO: 41287 - protein, 7 aa, Artificial Sequence
  Description of Artificial Sequence: Synthetic peptide
  XENP025834 vlCDR2
KVSNRFS

SEQ ID NO: 41288 - protein, 9 aa, Artificial Sequence
  Description of Artificial Sequence: Synthetic peptide
  XENP025834 vlCDR3
FQGSHVPNT

SEQ ID NO: 41289 - protein, 446 aa, Artificial Sequence; identical to SEQ ID NO: 41179
  Description of Artificial Sequence: Synthetic polypeptide
  XENP025835 1C11[PD-1]_H3.234_L3.144_IgG1_PVA_/S267K Heavy Chain

SEQ ID NO: 41290 - protein, 117 aa, Artificial Sequence; identical to SEQ ID NO: 40669
  Description of Artificial Sequence: Synthetic polypeptide
  VH of XENP025835

SEQ ID NO: 41291 - protein, 5 aa, Artificial Sequence
  Description of Artificial Sequence: Synthetic peptide
  XENP025835 vhCDR1
HYGIN

SEQ ID NO: 41292 - protein, 17 aa, Artificial Sequence
  Description of Artificial Sequence: Synthetic peptide
  XENP025835 vhCDR2
WINTYTGEPYYAPGFQE

SEQ ID NO: 41293 - protein, 8 aa, Artificial Sequence
  Description of Artificial Sequence: Synthetic peptide
  XENP025835 vhCDR3
DYYGSSPY

SEQ ID NO: 41294 - protein, 219 aa, Artificial Sequence; identical to SEQ ID NO: 41054
  Description of Artificial Sequence: Synthetic polypeptide
  XENP025835 1C11[PD-1]_H3.234_L3.144_IgG1_PVA_/S267K Light Chain

SEQ ID NO: 41295 - protein, 112 aa, Artificial Sequence; identical to SEQ ID NO: 40517
  Description of Artificial Sequence: Synthetic polypeptide
  VL of XENP025835

SEQ ID NO: 41296 - protein, 16 aa, Artificial Sequence
  Description of Artificial Sequence: Synthetic peptide
  XENP025835 vlCDR1
KASQSIVHSNGNTYLE

SEQ ID NO: 41297 - protein, 7 aa, Artificial Sequence
  Description of Artificial Sequence: Synthetic peptide
  XENP025835 vlCDR2
KVSNRFS

SEQ ID NO: 41298 - protein, 9 aa, Artificial Sequence
  Description of Artificial Sequence: Synthetic peptide
  XENP025835 vlCDR3
FQGSHVPNT

SEQ ID NO: 41299 - protein, 446 aa, Artificial Sequence; identical to SEQ ID NO: 41179
  Description of Artificial Sequence: Synthetic polypeptide
  XENP025836 1C11[PD-1]_H3.234_L3.148_IgG1_PVA_/S267K Heavy Chain

SEQ ID NO: 41300 - protein, 117 aa, Artificial Sequence; identical to SEQ ID NO: 40669
  Description of Artificial Sequence: Synthetic polypeptide
  VH of XENP025836

SEQ ID NO: 41301 - protein, 5 aa, Artificial Sequence
  Description of Artificial Sequence: Synthetic peptide
  XENP025836 vhCDR1
HYGIN

SEQ ID NO: 41302 - protein, 17 aa, Artificial Sequence
  Description of Artificial Sequence: Synthetic peptide
  XENP025836 vhCDR2
WINTYTGEPYYAPGFQE

SEQ ID NO: 41303 - protein, 8 aa, Artificial Sequence
  Description of Artificial Sequence: Synthetic peptide
  XENP025836 vhCDR3
DYYGSSPY

SEQ ID NO: 41304 - protein, 219 aa, Artificial Sequence; identical to SEQ ID NO: 41064
  Description of Artificial Sequence: Synthetic polypeptide
  XENP025836 1C11[PD-1]_H3.234_L3.148_IgG1_PVA_/S267K Light Chain

SEQ ID NO: 41305 - protein, 112 aa, Artificial Sequence; identical to SEQ ID NO: 40553
  Description of Artificial Sequence: Synthetic polypeptide
  VL of XENP025836

SEQ ID NO: 41306 - protein, 16 aa, Artificial Sequence
  Description of Artificial Sequence: Synthetic peptide
  XENP025836 vlCDR1
KASQSIVHSNGNTYLE

SEQ ID NO: 41307 - protein, 7 aa, Artificial Sequence
  Description of Artificial Sequence: Synthetic peptide
  XENP025836 vlCDR2
KVSNRFS

SEQ ID NO: 41308 - protein, 9 aa, Artificial Sequence
  Description of Artificial Sequence: Synthetic peptide
  XENP025836 vlCDR3
FQGSHVPNT

SEQ ID NO: 41309 - protein, 446 aa, Artificial Sequence; identical to SEQ ID NO: 41189
  Description of Artificial Sequence: Synthetic polypeptide
  XENP025837 1C11[PD-1]_H3.239_L3.125_IgG1_PVA_/S267K Heavy Chain

SEQ ID NO: 41310 - protein, 117 aa, Artificial Sequence; identical to SEQ ID NO: 40822
  Description of Artificial Sequence: Synthetic polypeptide
  VH of XENP025837

SEQ ID NO: 41311 - protein, 5 aa, Artificial Sequence
  Description of Artificial Sequence: Synthetic peptide
  XENP025837 vhCDR1
HYGIN

SEQ ID NO: 41312 - protein, 17 aa, Artificial Sequence
  Description of Artificial Sequence: Synthetic peptide
  XENP025837 vhCDR2
WINTYTGEPYYAPGFQE

SEQ ID NO: 41313 - protein, 8 aa, Artificial Sequence
  Description of Artificial Sequence: Synthetic peptide
  XENP025837 vhCDR3
DYYGSSPY

SEQ ID NO: 41314 - protein, 219 aa, Artificial Sequence
  Description of Artificial Sequence: Synthetic polypeptide
  XENP025837 1C11[PD-1]_H3.239_L3.125_IgG1_PVA_/S267K Light Chain
DVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41315 - protein, 112 aa, Artificial Sequence; identical to SEQ ID NO: 39644
  Description of Artificial Sequence: Synthetic polypeptide
  VL of XENP025837

SEQ ID NO: 41316 - protein, 16 aa, Artificial Sequence
  Description of Artificial Sequence: Synthetic peptide
  XENP025837 vlCDR1
KSSQSIVHSNGNTYLE

SEQ ID NO: 41317 - protein, 7 aa, Artificial Sequence
  Description of Artificial Sequence: Synthetic peptide
  XENP025837 vlCDR2
KVSNRFS

SEQ ID NO: 41318 - protein, 9 aa, Artificial Sequence
  Description of Artificial Sequence: Synthetic peptide
  XENP025837 vlCDR3
FQGSHVPNT

SEQ ID NO: 41319 - protein, 446 aa, Artificial Sequence; identical to SEQ ID NO: 41199
  Description of Artificial Sequence: Synthetic polypeptide
  XENP025838 1C11[PD-1]_H3.240_L3.125_IgG1_PVA_/S267K Heavy Chain

SEQ ID NO: 41320 - protein, 117 aa, Artificial Sequence; identical to SEQ ID NO: 40831
  Description of Artificial Sequence: Synthetic polypeptide
  VH of XENP025838

SEQ ID NO: 41321 - protein, 5 aa, Artificial Sequence
  Description of Artificial Sequence: Synthetic peptide
  XENP025838 vhCDR1
HYGIN

SEQ ID NO: 41322 - protein, 17 aa, Artificial Sequence
  Description of Artificial Sequence: Synthetic peptide
  XENP025838 vhCDR2
WINTYTGEPYYAPGFQE

SEQ ID NO: 41323 - protein, 8 aa, Artificial Sequence
  Description of Artificial Sequence: Synthetic peptide
  XENP025838 vhCDR3
DYYGSSPY

SEQ ID NO: 41324 - protein, 219 aa, Artificial Sequence; identical to SEQ ID NO: 41314
  Description of Artificial Sequence: Synthetic polypeptide
  XENP025838 1C11[PD-1]_H3.240_L3.125_IgG1_PVA_/S267K Light Chain

SEQ ID NO: 41325 - protein, 112 aa, Artificial Sequence; identical to SEQ ID NO: 39644
  Description of Artificial Sequence: Synthetic polypeptide
  VL of XENP025838

SEQ ID NO: 41326 - protein, 16 aa, Artificial Sequence
  Description of Artificial Sequence: Synthetic peptide
  XENP025838 vlCDR1
KSSQSIVHSNGNTYLE

SEQ ID NO: 41327 - protein, 7 aa, Artificial Sequence
  Description of Artificial Sequence: Synthetic peptide
  XENP025838 vlCDR2
KVSNRFS

SEQ ID NO: 41328 - protein, 9 aa, Artificial Sequence
  Description of Artificial Sequence: Synthetic peptide
  XENP025838 vlCDR3
FQGSHVPNT

SEQ ID NO: 41329 - protein, 446 aa, Artificial Sequence; identical to SEQ ID NO: 41209
  Description of Artificial Sequence: Synthetic polypeptide
  XENP025839 1C11[PD-1]_H3.241_L3.125_IgG1_PVA_/S267K Heavy Chain

SEQ ID NO: 41330 - protein, 117 aa, Artificial Sequence; identical to SEQ ID NO: 40840
  Description of Artificial Sequence: Synthetic polypeptide
  VH of XENP025839

SEQ ID NO: 41331 - protein, 5 aa, Artificial Sequence
  Description of Artificial Sequence: Synthetic peptide
  XENP025839 vhCDR1
HYGIN

SEQ ID NO: 41332 - protein, 17 aa, Artificial Sequence
  Description of Artificial Sequence: Synthetic peptide
  XENP025839 vhCDR2
WINTYTGEPYYAPGFQE

SEQ ID NO: 41333 - protein, 8 aa, Artificial Sequence
  Description of Artificial Sequence: Synthetic peptide
  XENP025839 vhCDR3
DYYGSSPY

SEQ ID NO: 41334 - protein, 219 aa, Artificial Sequence; identical to SEQ ID NO: 41314
  Description of Artificial Sequence: Synthetic polypeptide
  XENP025839 1C11[PD-1]_H3.241_L3.125_IgG1_PVA_/S267K Light Chain

SEQ ID NO: 41335 - protein, 112 aa, Artificial Sequence; identical to SEQ ID NO: 39644
  Description of Artificial Sequence: Synthetic polypeptide
  VL of XENP025839

SEQ ID NO: 41336 - protein, 16 aa, Artificial Sequence
  Description of Artificial Sequence: Synthetic peptide
  XENP025839 vlCDR1
KSSQSIVHSNGNTYLE

SEQ ID NO: 41337 - protein, 7 aa, Artificial Sequence
  Description of Artificial Sequence: Synthetic peptide
  XENP025839 vlCDR2
KVSNRFS

SEQ ID NO: 41338 - protein, 9 aa, Artificial Sequence
  Description of Artificial Sequence: Synthetic peptide
  XENP025839 vlCDR3
FQGSHVPNT

SEQ ID NO: 41339 - protein, 446 aa, Artificial Sequence; identical to SEQ ID NO: 41189
  Description of Artificial Sequence: Synthetic polypeptide
  XENP025840 1C11[PD-1]_H3.239_L3.92_IgG1_PVA_/S267K Heavy Chain

SEQ ID NO: 41340 - protein, 117 aa, Artificial Sequence; identical to SEQ ID NO: 40822
  Description of Artificial Sequence: Synthetic polypeptide
  VH of XENP025840

SEQ ID NO: 41341 - protein, 5 aa, Artificial Sequence
  Description of Artificial Sequence: Synthetic peptide
  XENP025840 vhCDR1
HYGIN

SEQ ID NO: 41342 - protein, 17 aa, Artificial Sequence
  Description of Artificial Sequence: Synthetic peptide
  XENP025840 vhCDR2
WINTYTGEPYYAPGFQE

SEQ ID NO: 41343 - protein, 8 aa, Artificial Sequence
  Description of Artificial Sequence: Synthetic peptide
  XENP025840 vhCDR3
DYYGSSPY

SEQ ID NO: 41344 - protein, 219 aa, Artificial Sequence
  Description of Artificial Sequence: Synthetic polypeptide
  XENP025840 1C11[PD-1]_H3.239_L3.92_IgG1_PVA_/S267K Light Chain
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41345 - protein, 112 aa, Artificial Sequence; identical to SEQ ID NO: 39932
  Description of Artificial Sequence: Synthetic polypeptide
  VL of XENP025840

SEQ ID NO: 41346 - protein, 16 aa, Artificial Sequence
  Description of Artificial Sequence: Synthetic peptide
  XENP025840 vlCDR1
KASQSIVHSNGNTYLE

SEQ ID NO: 41347 - protein, 7 aa, Artificial Sequence
  Description of Artificial Sequence: Synthetic peptide
  XENP025840 vlCDR2
KVSNRFT

SEQ ID NO: 41348 - protein, 9 aa, Artificial Sequence
  Description of Artificial Sequence: Synthetic peptide
  XENP025840 vlCDR3
FQGSHVPNT

SEQ ID NO: 41349 - protein, 446 aa, Artificial Sequence; identical to SEQ ID NO: 41199
  Description of Artificial Sequence: Synthetic polypeptide
  XENP025841 1C11[PD-1]_H3.240_L3.92_IgG1_PVA_/S267K Heavy Chain

SEQ ID NO: 41350 - protein, 117 aa, Artificial Sequence; identical to SEQ ID NO: 40831
  Description of Artificial Sequence: Synthetic polypeptide
  VH of XENP025841

SEQ ID NO: 41351 - protein, 5 aa, Artificial Sequence
  Description of Artificial Sequence: Synthetic peptide
  XENP025841 vhCDR1
HYGIN

SEQ ID NO: 41352 - protein, 17 aa, Artificial Sequence
  Description of Artificial Sequence: Synthetic peptide
  XENP025841 vhCDR2
WINTYTGEPYYAPGFQE

SEQ ID NO: 41353 - protein, 8 aa, Artificial Sequence
  Description of Artificial Sequence: Synthetic peptide
  XENP025841 vhCDR3
DYYGSSPY

SEQ ID NO: 41354 - protein, 219 aa, Artificial Sequence; identical to SEQ ID NO: 41344
  Description of Artificial Sequence: Synthetic polypeptide
  XENP025841 1C11[PD-1]_H3.240_L3.92_IgG1_PVA_/S267K Light Chain

SEQ ID NO: 41355 - protein, 112 aa, Artificial Sequence; identical to SEQ ID NO: 39932
  Description of Artificial Sequence: Synthetic polypeptide
  VL of XENP025841

SEQ ID NO: 41356 - protein, 16 aa, Artificial Sequence
  Description of Artificial Sequence: Synthetic peptide
  XENP025841 vlCDR1
KASQSIVHSNGNTYLE

SEQ ID NO: 41357 - protein, 7 aa, Artificial Sequence
  Description of Artificial Sequence: Synthetic peptide
  XENP025841 vlCDR2
KVSNRFT

SEQ ID NO: 41358 - protein, 9 aa, Artificial Sequence
  Description of Artificial Sequence: Synthetic peptide
  XENP025841 vlCDR3
FQGSHVPNT

SEQ ID NO: 41359 - protein, 446 aa, Artificial Sequence; identical to SEQ ID NO: 41209
  Description of Artificial Sequence: Synthetic polypeptide
  XENP025842 1C11[PD-1]_H3.241_L3.92_IgG1_PVA_/S267K Heavy Chain

SEQ ID NO: 41360 - protein, 117 aa, Artificial Sequence; identical to SEQ ID NO: 40840
  Description of Artificial Sequence: Synthetic polypeptide
  VH of XENP025842

SEQ ID NO: 41361 - protein, 5 aa, Artificial Sequence
  Description of Artificial Sequence: Synthetic peptide
  XENP025842 vhCDR1
HYGIN

SEQ ID NO: 41362 - protein, 17 aa, Artificial Sequence
  Description of Artificial Sequence: Synthetic peptide
  XENP025842 vhCDR2
WINTYTGEPYYAPGFQE

SEQ ID NO: 41363 - protein, 8 aa, Artificial Sequence
  Description of Artificial Sequence: Synthetic peptide
  XENP025842 vhCDR3
DYYGSSPY

SEQ ID NO: 41364 - protein, 219 aa, Artificial Sequence; identical to SEQ ID NO: 41344
  Description of Artificial Sequence: Synthetic polypeptide
  XENP025842 1C11[PD-1]_H3.241_L3.92_IgG1_PVA_/S267K Light Chain

SEQ ID NO: 41365 - protein, 112 aa, Artificial Sequence; identical to SEQ ID NO: 39932
  Description of Artificial Sequence: Synthetic polypeptide
  VL of XENP025842

SEQ ID NO: 41366 - protein, 16 aa, Artificial Sequence
  Description of Artificial Sequence: Synthetic peptide
  XENP025842 vlCDR1
KASQSIVHSNGNTYLE

SEQ ID NO: 41367 - protein, 7 aa, Artificial Sequence
  Description of Artificial Sequence: Synthetic peptide
  XENP025842 vlCDR2
KVSNRFT

SEQ ID NO: 41368 - protein, 9 aa, Artificial Sequence
  Description of Artificial Sequence: Synthetic peptide
  XENP025842 vlCDR3
FQGSHVPNT

SEQ ID NO: 41369 - protein, 446 aa, Artificial Sequence; identical to SEQ ID NO: 39254
  Description of Artificial Sequence: Synthetic polypeptide
  XENP022553 1C11[PD-1]_H3L3_IgG1_PVA_/S267K Heavy Chain

SEQ ID NO: 41370 - protein, 117 aa, Artificial Sequence; identical to SEQ ID NO: 33034
  Description of Artificial Sequence: Synthetic polypeptide
  VH of XENP022553

SEQ ID NO: 41371 - protein, 5 aa, Artificial Sequence
  Description of Artificial Sequence: Synthetic peptide
  XENP022553 vhCDR1
HYGMN

SEQ ID NO: 41372 - protein, 17 aa, Artificial Sequence
  Description of Artificial Sequence: Synthetic peptide
  XENP022553 vhCDR2
WINTYTGEPTYADGFTG

SEQ ID NO: 41373 - protein, 8 aa, Artificial Sequence
  Description of Artificial Sequence: Synthetic peptide
  XENP022553 vhCDR3
DYYGSSPY

SEQ ID NO: 41374 - protein, 219 aa, Artificial Sequence; identical to SEQ ID NO: 33008
  Description of Artificial Sequence: Synthetic polypeptide
  XENP022553 1C11[PD-1]_H3L3_IgG1_PVA_/S267K Light Chain

SEQ ID NO: 41375 - protein, 112 aa, Artificial Sequence; identical to SEQ ID NO: 33009
  Description of Artificial Sequence: Synthetic polypeptide
  VL of XENP022553

SEQ ID NO: 41376 - protein, 16 aa, Artificial Sequence
  Description of Artificial Sequence: Synthetic peptide
  XENP022553 vlCDR1
KSSQSIVHSNGNTYLE

SEQ ID NO: 41377 - protein, 7 aa, Artificial Sequence
  Description of Artificial Sequence: Synthetic peptide
  XENP022553 vlCDR2
KVSNRFS

SEQ ID NO: 41378 - protein, 9 aa, Artificial Sequence
  Description of Artificial Sequence: Synthetic peptide
  XENP022553 vlCDR3
FQGSHVPNT

SEQ ID NO: 41379 - protein, 446 aa, Artificial Sequence
  Description of Artificial Sequence: Synthetic polypeptide
  XENP026321 1C11[PD-1]_H3.59_L3.1_IgG1_PVA_/S267K Heavy Chain
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41380 - protein, 117 aa, Artificial Sequence; identical to SEQ ID NO: 33992
  Description of Artificial Sequence: Synthetic polypeptide
  VH of XENP026321

SEQ ID NO: 41381 - protein, 5 aa, Artificial Sequence
  Description of Artificial Sequence: Synthetic peptide
  XENP026321 vhCDR1
HYGMN

SEQ ID NO: 41382 - protein, 17 aa, Artificial Sequence
  Description of Artificial Sequence: Synthetic peptide
  XENP026321 vhCDR2
WINTYTGEPTYADGFTG

SEQ ID NO: 41383 - protein, 8 aa, Artificial Sequence
  Description of Artificial Sequence: Synthetic peptide
  XENP026321 vhCDR3
DYYGSSPY

SEQ ID NO: 41384 - protein, 219 aa, Artificial Sequence
  Description of Artificial Sequence: Synthetic polypeptide
  XENP026321 1C11[PD-1]_H3.59_L3.1_IgG1_PVA_/S267K Light Chain
DILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41385 - protein, 112 aa, Artificial Sequence; identical to SEQ ID NO: 39365
  Description of Artificial Sequence: Synthetic polypeptide
  VL of XENP026321

SEQ ID NO: 41386 - protein, 16 aa, Artificial Sequence
  Description of Artificial Sequence: Synthetic peptide
  XENP026321 vlCDR1
KSSQSIVHSNGNTYLE

SEQ ID NO: 41387 - protein, 7 aa, Artificial Sequence
  Description of Artificial Sequence: Synthetic peptide
  XENP026321 vlCDR2
KVSNRFS

SEQ ID NO: 41388 - protein, 9 aa, Artificial Sequence
  Description of Artificial Sequence: Synthetic peptide
  XENP026321 vlCDR3
FQGSHVPNT

SEQ ID NO: 41389 - protein, 446 aa, Artificial Sequence; identical to SEQ ID NO: 41379
  Description of Artificial Sequence: Synthetic polypeptide
  XENP026322 1C11[PD-1]_H3.59_L3.38_IgG1_PVA_/S267K Heavy Chain

SEQ ID NO: 41390 - protein, 117 aa, Artificial Sequence; identical to SEQ ID NO: 33992
  Description of Artificial Sequence: Synthetic polypeptide
  VH of XENP026322

SEQ ID NO: 41391 - protein, 5 aa, Artificial Sequence
  Description of Artificial Sequence: Synthetic peptide
  XENP026322 vhCDR1
HYGMN

SEQ ID NO: 41392 - protein, 17 aa, Artificial Sequence
  Description of Artificial Sequence: Synthetic peptide
  XENP026322 vhCDR2
WINTYTGEPTYADGFTG

SEQ ID NO: 41393 - protein, 8 aa, Artificial Sequence
  Description of Artificial Sequence: Synthetic peptide
  XENP026322 vhCDR3
DYYGSSPY

SEQ ID NO: 41394 - protein, 219 aa, Artificial Sequence
  Description of Artificial Sequence: Synthetic polypeptide
  XENP026322 1C11[PD-1]_H3.59_L3.38_IgG1_PVA_/S267K Light Chain
DVLMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41395 - protein, 112 aa, Artificial Sequence
  Description of Artificial Sequence: Synthetic polypeptide
  VL of XENP026322
DVLMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIK

SEQ ID NO: 41396 - protein, 16 aa, Artificial Sequence
  Description of Artificial Sequence: Synthetic peptide
  XENP026322 vlCDR1
KSSQSIVHSNGNNYLE

SEQ ID NO: 41397 - protein, 7 aa, Artificial Sequence
  Description of Artificial Sequence: Synthetic peptide
  XENP026322 vlCDR2
KVSNRFS

SEQ ID NO: 41398 - protein, 9 aa, Artificial Sequence
  Description of Artificial Sequence: Synthetic peptide
  XENP026322 vlCDR3
FQGSHVPNT

SEQ ID NO: 41399 - protein, 446 aa, Artificial Sequence; identical to SEQ ID NO: 41379
  Description of Artificial Sequence: Synthetic polypeptide
  XENP026323 1C11[PD-1]_H3.59_L3.51_IgG1_PVA_/S267K Heavy Chain

SEQ ID NO: 41400 - protein, 117 aa, Artificial Sequence; identical to SEQ ID NO: 33992
  Description of Artificial Sequence: Synthetic polypeptide
  VH of XENP026323

SEQ ID NO: 41401 - protein, 5 aa, Artificial Sequence
  Description of Artificial Sequence: Synthetic peptide
  XENP026323 vhCDR1
HYGMN

SEQ ID NO: 41402 - protein, 17 aa, Artificial Sequence
  Description of Artificial Sequence: Synthetic peptide
  XENP026323 vhCDR2
WINTYTGEPTYADGFTG

SEQ ID NO: 41403 - protein, 8 aa, Artificial Sequence
  Description of Artificial Sequence: Synthetic peptide
  XENP026323 vhCDR3
DYYGSSPY

SEQ ID NO: 41404 - protein, 219 aa, Artificial Sequence
  Description of Artificial Sequence: Synthetic polypeptide
  XENP026323 1C11[PD-1]_H3.59_L3.51_IgG1_PVA_/S267K Light Chain
DVLMTQSPDSLAVSLGERATINCKSSQSIVHSNGNTYLEWYQQKPGQSPKLLIYSVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41405 - protein, 112 aa, Artificial Sequence
  Description of Artificial Sequence: Synthetic polypeptide
  VL of XENP026323
DVLMTQSPDSLAVSLGERATINCKSSQSIVHSNGNTYLEWYQQKPGQSPKLLIYSVSNRFSGVPDRFSGSGSGTDFTLTISSLQAEDVAVYYCFQGSHVPNTFGGGTKVEIK

SEQ ID NO: 41406 - protein, 16 aa, Artificial Sequence
  Description of Artificial Sequence: Synthetic peptide
  XENP026323 vlCDR1
KSSQSIVHSNGNTYLE

SEQ ID NO: 41407 - protein, 7 aa, Artificial Sequence
  Description of Artificial Sequence: Synthetic peptide
  XENP026323 vlCDR2
SVSNRFS

SEQ ID NO: 41408 - protein, 9 aa, Artificial Sequence
  Description of Artificial Sequence: Synthetic peptide
  XENP026323 vlCDR3
FQGSHVPNT

SEQ ID NO: 41409 - protein, 446 aa, Artificial Sequence; identical to SEQ ID NO: 41379
  Description of Artificial Sequence: Synthetic polypeptide
  XENP026324 1C11[PD-1]_H3.59_L3.59_IgG1_PVA_/S267K Heavy Chain

SEQ ID NO: 41410 - protein, 117 aa, Artificial Sequence; identical to SEQ ID NO: 33992
  Description of Artificial Sequence: Synthetic polypeptide
  VH of XENP026324

SEQ ID NO: 41411 - protein, 5 aa, Artificial Sequence
  Description of Artificial Sequence: Synthetic peptide
  XENP026324 vhCDR1
HYGMN

SEQ ID NO: 41412 - protein, 17 aa, Artificial Sequence
  Description of Artificial Sequence: Synthetic peptide
  XENP026324 vhCDR2
WINTYTGEPTYADGFTG

SEQ ID NO: 41413 - protein, 8 aa, Artificial Sequence
  Description of Artificial Sequence: Synthetic peptide
  XENP026324 vhCDR3
DYYGSSPY

SEQ ID NO: 41414 - protein, 219 aa, Artificial Sequence
  Description of Artificial Sequence: Synthetic polypeptide
  XENP026324 1C11[PD-1]_H3.59_L3.59_IgG1_PVA_/S267K Light Chain
DVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41415 - protein, 112 aa, Artificial Sequence; identical to SEQ ID NO: 39446
  Description of Artificial Sequence: Synthetic polypeptide
  VL of XENP026324

SEQ ID NO: 41416 - protein, 16 aa, Artificial Sequence
  Description of Artificial Sequence: Synthetic peptide
  XENP026324 vlCDR1
KSSQSIVHSNGNTYLE

SEQ ID NO: 41417 - protein, 7 aa, Artificial Sequence
  Description of Artificial Sequence: Synthetic peptide
  XENP026324 vlCDR2
KVSNRFS

SEQ ID NO: 41418 - protein, 9 aa, Artificial Sequence
  Description of Artificial Sequence: Synthetic peptide
  XENP026324 vlCDR3
FQGSHVPNT

SEQ ID NO: 41419 - protein, 446 aa, Artificial Sequence; identical to SEQ ID NO: 41379
  Description of Artificial Sequence: Synthetic polypeptide
  XENP026325 1C11[PD-1]_H3.59_L3.73_IgG1_PVA_/S267K Heavy Chain

SEQ ID NO: 41420 - protein, 117 aa, Artificial Sequence; identical to SEQ ID NO: 33992
  Description of Artificial Sequence: Synthetic polypeptide
  VH of XENP026325

SEQ ID NO: 41421 - protein, 5 aa, Artificial Sequence
  Description of Artificial Sequence: Synthetic peptide
  XENP026325 vhCDR1
HYGMN

SEQ ID NO: 41422 - protein, 17 aa, Artificial Sequence
  Description of Artificial Sequence: Synthetic peptide
  XENP026325 vhCDR2
WINTYTGEPTYADGFTG

SEQ ID NO: 41423 - protein, 8 aa, Artificial Sequence
  Description of Artificial Sequence: Synthetic peptide
  XENP026325 vhCDR3
DYYGSSPY

SEQ ID NO: 41424 - protein, 219 aa, Artificial Sequence
  Description of Artificial Sequence: Synthetic polypeptide
  XENP026325 1C11[PD-1]_H3.59_L3.73_IgG1_PVA_/S267K Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41425 - protein, 112 aa, Artificial Sequence; identical to SEQ ID NO: 39482
  Description of Artificial Sequence: Synthetic polypeptide
  VL of XENP026325

SEQ ID NO: 41426 - protein, 16 aa, Artificial Sequence
  Description of Artificial Sequence: Synthetic peptide
  XENP026325 vlCDR1
KSSQSIVHSNGNTYLE

SEQ ID NO: 41427 - protein, 7 aa, Artificial Sequence
  Description of Artificial Sequence: Synthetic peptide
  XENP026325 vlCDR2
KVSNRFS

SEQ ID NO: 41428 - protein, 9 aa, Artificial Sequence
  Description of Artificial Sequence: Synthetic peptide
  XENP026325 vlCDR3
FQGSHVPNT

SEQ ID NO: 41429 - protein, 446 aa, Artificial Sequence; identical to SEQ ID NO: 41379
  Description of Artificial Sequence: Synthetic polypeptide
  XENP026326 1C11[PD-1]_H3.59_L3.125_IgG1_PVA_/S267K Heavy Chain

SEQ ID NO: 41430 - protein, 117 aa, Artificial Sequence; identical to SEQ ID NO: 33992
  Description of Artificial Sequence: Synthetic polypeptide
  VH of XENP026326

SEQ ID NO: 41431 - protein, 5 aa, Artificial Sequence
  Description of Artificial Sequence: Synthetic peptide
  XENP026326 vhCDR1
HYGMN

SEQ ID NO: 41432 - protein, 17 aa, Artificial Sequence
  Description of Artificial Sequence: Synthetic peptide
  XENP026326 vhCDR2
WINTYTGEPTYADGFTG

SEQ ID NO: 41433 - protein, 8 aa, Artificial Sequence
  Description of Artificial Sequence: Synthetic peptide
  XENP026326 vhCDR3
DYYGSSPY

SEQ ID NO: 41434 - protein, 219 aa, Artificial Sequence; identical to SEQ ID NO: 41314
  Description of Artificial Sequence: Synthetic polypeptide
  XENP026326 1C11[PD-1]_H3.59_L3.125_IgG1_PVA_/S267K Light Chain

SEQ ID NO: 41435 - protein, 112 aa, Artificial Sequence; identical to SEQ ID NO: 39644
  Description of Artificial Sequence: Synthetic polypeptide
  VL of XENP026326

SEQ ID NO: 41436 - protein, 16 aa, Artificial Sequence
  Description of Artificial Sequence: Synthetic peptide
  XENP026326 vlCDR1
KSSQSIVHSNGNTYLE

SEQ ID NO: 41437 - protein, 7 aa, Artificial Sequence
  Description of Artificial Sequence: Synthetic peptide
  XENP026326 vlCDR2
KVSNRFS

SEQ ID NO: 41438 - protein, 9 aa, Artificial Sequence
  Description of Artificial Sequence: Synthetic peptide
  XENP026326 vlCDR3
FQGSHVPNT

SEQ ID NO: 41439 - protein, 446 aa, Artificial Sequence
  Description of Artificial Sequence: Synthetic polypeptide
  XENP026327 1C11[PD-1]_H3.135_L3.1_IgG1_PVA_/S267K Heavy Chain
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41440 - protein, 117 aa, Artificial Sequence; identical to SEQ ID NO: 34694
  Description of Artificial Sequence: Synthetic polypeptide
  VH of XENP026327

SEQ ID NO: 41441 - protein, 5 aa, Artificial Sequence
  Description of Artificial Sequence: Synthetic peptide
  XENP026327 vhCDR1
HYGMN

SEQ ID NO: 41442 - protein, 17 aa, Artificial Sequence
  Description of Artificial Sequence: Synthetic peptide
  XENP026327 vhCDR2
WINTYTSEPTYADGFTG

SEQ ID NO: 41443 - protein, 8 aa, Artificial Sequence
  Description of Artificial Sequence: Synthetic peptide
  XENP026327 vhCDR3
DYYGSSPY

SEQ ID NO: 41444 - protein, 219 aa, Artificial Sequence; identical to SEQ ID NO: 41384
  Description of Artificial Sequence: Synthetic polypeptide
  XENP026327 1C11[PD-1]_H3.135_L3.1_IgG1_PVA_/S267K Light Chain

SEQ ID NO: 41445 - protein, 112 aa, Artificial Sequence; identical to SEQ ID NO: 39365
  Description of Artificial Sequence: Synthetic polypeptide
  VL of XENP026327

SEQ ID NO: 41446 - protein, 16 aa, Artificial Sequence
  Description of Artificial Sequence: Synthetic peptide
  XENP026327 vlCDR1
KSSQSIVHSNGNTYLE

SEQ ID NO: 41447 - protein, 7 aa, Artificial Sequence
  Description of Artificial Sequence: Synthetic peptide
  XENP026327 vlCDR2
KVSNRFS

SEQ ID NO: 41448 - protein, 9 aa, Artificial Sequence
  Description of Artificial Sequence: Synthetic peptide
  XENP026327 vlCDR3
FQGSHVPNT

SEQ ID NO: 41449 - protein, 446 aa, Artificial Sequence; identical to SEQ ID NO: 41439
  Description of Artificial Sequence: Synthetic polypeptide
  XENP026328 1C11[PD-1]_H3.135_L3.38_IgG1_PVA_/S267K Heavy Chain

SEQ ID NO: 41450 - protein, 117 aa, Artificial Sequence; identical to SEQ ID NO: 34694
  Description of Artificial Sequence: Synthetic polypeptide
  VH of XENP026328

SEQ ID NO: 41451 - protein, 5 aa, Artificial Sequence
  Description of Artificial Sequence: Synthetic peptide
  XENP026328 vhCDR1
HYGMN

SEQ ID NO: 41452 - protein, 17 aa, Artificial Sequence
  Description of Artificial Sequence: Synthetic peptide
  XENP026328 vhCDR2
WINTYTSEPTYADGFTG

SEQ ID NO: 41453 - protein, 8 aa, Artificial Sequence
  Description of Artificial Sequence: Synthetic peptide
  XENP026328 vhCDR3
DYYGSSPY

SEQ ID NO: 41454 - protein, 219 aa, Artificial Sequence; identical to SEQ ID NO: 41394
  Description of Artificial Sequence: Synthetic polypeptide
  XENP026328 1C11[PD-1]_H3.135_L3.38_IgG1_PVA_/S267K Light Chain

SEQ ID NO: 41455 - protein, 112 aa, Artificial Sequence; identical to SEQ ID NO: 41395
  Description of Artificial Sequence: Synthetic polypeptide
  VL of XENP026328

SEQ ID NO: 41456 - protein, 16 aa, Artificial Sequence
  Description of Artificial Sequence: Synthetic peptide
  XENP026328 vlCDR1
KSSQSIVHSNGNNYLE

SEQ ID NO: 41457 - protein, 7 aa, Artificial Sequence
  Description of Artificial Sequence: Synthetic peptide
  XENP026328 vlCDR2
KVSNRFS

SEQ ID NO: 41458 - protein, 9 aa, Artificial Sequence
  Description of Artificial Sequence: Synthetic peptide
  XENP026328 vlCDR3
FQGSHVPNT

SEQ ID NO: 41459 - protein, 446 aa, Artificial Sequence; identical to SEQ ID NO: 41439
  Description of Artificial Sequence: Synthetic polypeptide
  XENP026329 1C11[PD-1]_H3.135_L3.51_IgG1_PVA_/S267K Heavy Chain

SEQ ID NO: 41460 - protein, 117 aa, Artificial Sequence; identical to SEQ ID NO: 34694
  Description of Artificial Sequence: Synthetic polypeptide
  VH of XENP026329

SEQ ID NO: 41461 - protein, 5 aa, Artificial Sequence
  Description of Artificial Sequence: Synthetic peptide
  XENP026329 vhCDR1
HYGMN

SEQ ID NO: 41462 - protein, 17 aa, Artificial Sequence
  Description of Artificial Sequence: Synthetic peptide
  XENP026329 vhCDR2
WINTYTSEPTYADGFTG

SEQ ID NO: 41463 - protein, 8 aa, Artificial Sequence
  Description of Artificial Sequence: Synthetic peptide
  XENP026329 vhCDR3
DYYGSSPY

SEQ ID NO: 41464 - protein, 219 aa, Artificial Sequence; identical to SEQ ID NO: 41404
  Description of Artificial Sequence: Synthetic polypeptide
  XENP026329 1C11[PD-1]_H3.135_L3.51_IgG1_PVA_/S267K Light Chain

SEQ ID NO: 41465 - protein, 112 aa, Artificial Sequence; identical to SEQ ID NO: 41405
  Description of Artificial Sequence: Synthetic polypeptide
  VL of XENP026329

SEQ ID NO: 41466 - protein, 16 aa, Artificial Sequence
  Description of Artificial Sequence: Synthetic peptide
  XENP026329 vlCDR1
KSSQSIVHSNGNTYLE

SEQ ID NO: 41467 - protein, 7 aa, Artificial Sequence
  Description of Artificial Sequence: Synthetic peptide
  XENP026329 vlCDR2
SVSNRFS

SEQ ID NO: 41468 - protein, 9 aa, Artificial Sequence
  Description of Artificial Sequence: Synthetic peptide
  XENP026329 vlCDR3
FQGSHVPNT

SEQ ID NO: 41469 - protein, 446 aa, Artificial Sequence; identical to SEQ ID NO: 41439
  Description of Artificial Sequence: Synthetic polypeptide
  XENP026330 1C11[PD-1]_H3.135_L3.59_IgG1_PVA_/S267K Heavy Chain

SEQ ID NO: 41470 - protein, 117 aa, Artificial Sequence; identical to SEQ ID NO: 34694
  Description of Artificial Sequence: Synthetic polypeptide
  VH of XENP026330

SEQ ID NO: 41471 - protein, 5 aa, Artificial Sequence
  Description of Artificial Sequence: Synthetic peptide
  XENP026330 vhCDR1
HYGMN

SEQ ID NO: 41472 - protein, 17 aa, Artificial Sequence
  Description of Artificial Sequence: Synthetic peptide
  XENP026330 vhCDR2
WINTYTSEPTYADGFTG

SEQ ID NO: 41473 - protein, 8 aa, Artificial Sequence
  Description of Artificial Sequence: Synthetic peptide
  XENP026330 vhCDR3
DYYGSSPY

SEQ ID NO: 41474 - protein, 219 aa, Artificial Sequence; identical to SEQ ID NO: 41414
  Description of Artificial Sequence: Synthetic polypeptide
  XENP026330 1C11[PD-1]_H3.135_L3.59_IgG1_PVA_/S267K Light Chain

SEQ ID NO: 41475 - protein, 112 aa, Artificial Sequence; identical to SEQ ID NO: 39446
  Description of Artificial Sequence: Synthetic polypeptide
  VL of XENP026330

SEQ ID NO: 41476 - protein, 16 aa, Artificial Sequence
  Description of Artificial Sequence: Synthetic peptide
  XENP026330 vlCDR1
KSSQSIVHSNGNTYLE

SEQ ID NO: 41477 - protein, 7 aa, Artificial Sequence
  Description of Artificial Sequence: Synthetic peptide
  XENP026330 vlCDR2
KVSNRFS

SEQ ID NO: 41478 - protein, 9 aa, Artificial Sequence
  Description of Artificial Sequence: Synthetic peptide
  XENP026330 vlCDR3
FQGSHVPNT

SEQ ID NO: 41479 - protein, 446 aa, Artificial Sequence; identical to SEQ ID NO: 41439
  Description of Artificial Sequence: Synthetic polypeptide
  XENP026331 1C11[PD-1]_H3.135_L3.73_IgG1_PVA_/S267K Heavy Chain

SEQ ID NO: 41480 - protein, 117 aa, Artificial Sequence; identical to SEQ ID NO: 34694
  Description of Artificial Sequence: Synthetic polypeptide
  VH of XENP026331

SEQ ID NO: 41481 - protein, 5 aa, Artificial Sequence
  Description of Artificial Sequence: Synthetic peptide
  XENP026331 vhCDR1
HYGMN

SEQ ID NO: 41482 - protein, 17 aa, Artificial Sequence
  Description of Artificial Sequence: Synthetic peptide
  XENP026331 vhCDR2
WINTYTSEPTYADGFTG

SEQ ID NO: 41483 - protein, 8 aa, Artificial Sequence
  Description of Artificial Sequence: Synthetic peptide
  XENP026331 vhCDR3
DYYGSSPY

SEQ ID NO: 41484 - protein, 219 aa, Artificial Sequence; identical to SEQ ID NO: 41424
  Description of Artificial Sequence: Synthetic polypeptide
  XENP026331 1C11[PD-1]_H3.135_L3.73_IgG1_PVA_/S267K Light Chain

SEQ ID NO: 41485 - protein, 112 aa, Artificial Sequence; identical to SEQ ID NO: 39482
  Description of Artificial Sequence: Synthetic polypeptide
  VL of XENP026331

SEQ ID NO: 41486 - protein, 16 aa, Artificial Sequence
  Description of Artificial Sequence: Synthetic peptide
  XENP026331 vlCDR1
KSSQSIVHSNGNTYLE

SEQ ID NO: 41487 - protein, 7 aa, Artificial Sequence
  Description of Artificial Sequence: Synthetic peptide
  XENP026331 vlCDR2
KVSNRFS

SEQ ID NO: 41488 - protein, 9 aa, Artificial Sequence
  Description of Artificial Sequence: Synthetic peptide
  XENP026331 vlCDR3
FQGSHVPNT

SEQ ID NO: 41489 - protein, 446 aa, Artificial Sequence; identical to SEQ ID NO: 41439
  Description of Artificial Sequence: Synthetic polypeptide
  XENP026332 1C11[PD-1]_H3.135_L3.125_IgG1_PVA_/S267K Heavy Chain

SEQ ID NO: 41490 - protein, 117 aa, Artificial Sequence; identical to SEQ ID NO: 34694
  Description of Artificial Sequence: Synthetic polypeptide
  VH of XENP026332

SEQ ID NO: 41491 - protein, 5 aa, Artificial Sequence
  Description of Artificial Sequence: Synthetic peptide
  XENP026332 vhCDR1
HYGMN

SEQ ID NO: 41492 - protein, 17 aa, Artificial Sequence
  Description of Artificial Sequence: Synthetic peptide
  XENP026332 vhCDR2
WINTYTSEPTYADGFTG

SEQ ID NO: 41493 - protein, 8 aa, Artificial Sequence
  Description of Artificial Sequence: Synthetic peptide
  XENP026332 vhCDR3
DYYGSSPY

SEQ ID NO: 41494 - protein, 219 aa, Artificial Sequence; identical to SEQ ID NO: 41314
  Description of Artificial Sequence: Synthetic polypeptide
  XENP026332 1C11[PD-1]_H3.135_L3.125_IgG1_PVA_/S267K Light Chain

SEQ ID NO: 41495 - protein, 112 aa, Artificial Sequence; identical to SEQ ID NO: 39644
  Description of Artificial Sequence: Synthetic polypeptide
  VL of XENP026332

SEQ ID NO: 41496 - protein, 16 aa, Artificial Sequence
  Description of Artificial Sequence: Synthetic peptide
  XENP026332 vlCDR1
KSSQSIVHSNGNTYLE

SEQ ID NO: 41497 - protein, 7 aa, Artificial Sequence
  Description of Artificial Sequence: Synthetic peptide
  XENP026332 vlCDR2
KVSNRFS

SEQ ID NO: 41498 - protein, 9 aa, Artificial Sequence
  Description of Artificial Sequence: Synthetic peptide
  XENP026332 vlCDR3
FQGSHVPNT

SEQ ID NO: 41499 - protein, 446 aa, Artificial Sequence
  Description of Artificial Sequence: Synthetic polypeptide
  XENP026333 1C11[PD-1]_H3.138_L3.1_IgG1_PVA_/S267K Heavy Chain
QIQLVQSGSELKKPGASVKVSCKASGYTFTHYGMNWVRQAPGQGLEWMGWINTYTGDPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41500 - protein, 117 aa, Artificial Sequence; identical to SEQ ID NO: 34721
  Description of Artificial Sequence: Synthetic polypeptide
  VH of XENP026333

SEQ ID NO: 41501 - protein, 5 aa, Artificial Sequence
  Description of Artificial Sequence: Synthetic peptide
  XENP026333 vhCDR1
HYGMN

SEQ ID NO: 41502 - protein, 17 aa, Artificial Sequence
  Description of Artificial Sequence: Synthetic peptide
  XENP026333 vhCDR2
WINTYTGDPTYADGFTG

SEQ ID NO: 41503 - protein, 8 aa, Artificial Sequence
  Description of Artificial Sequence: Synthetic peptide
  XENP026333 vhCDR3
DYYGSSPY

SEQ ID NO: 41504 - protein, 219 aa, Artificial Sequence; identical to SEQ ID NO: 41384
  Description of Artificial Sequence: Synthetic polypeptide
  XENP026333 1C11[PD-1]_H3.138_L3.1_IgG1_PVA_/S267K Light Chain

SEQ ID NO: 41505 - protein, 112 aa, Artificial Sequence; identical to SEQ ID NO: 39365
  Description of Artificial Sequence: Synthetic polypeptide
  VL of XENP026333

SEQ ID NO: 41506 - protein, 16 aa, Artificial Sequence
  Description of Artificial Sequence: Synthetic peptide
  XENP026333 vlCDR1
KSSQSIVHSNGNTYLE

SEQ ID NO: 41507 - protein, 7 aa, Artificial Sequence
  Description of Artificial Sequence: Synthetic peptide
  XENP026333 vlCDR2
KVSNRFS

SEQ ID NO: 41508 - protein, 9 aa, Artificial Sequence
  Description of Artificial Sequence: Synthetic peptide
  XENP026333 vlCDR3
FQGSHVPNT

SEQ ID NO: 41509 - protein, 446 aa, Artificial Sequence; identical to SEQ ID NO: 41499
  Description of Artificial Sequence: Synthetic polypeptide
  XENP026334 1C11[PD-1]_H3.138_L3.38_IgG1_PVA_/S267K Heavy Chain

SEQ ID NO: 41510 - protein, 117 aa, Artificial Sequence; identical to SEQ ID NO: 34721
  Description of Artificial Sequence: Synthetic polypeptide
  VH of XENP026334

SEQ ID NO: 41511 - protein, 5 aa, Artificial Sequence
  Description of Artificial Sequence: Synthetic peptide
  XENP026334 vhCDR1
HYGMN

SEQ ID NO: 41512 - protein, 17 aa, Artificial Sequence
  Description of Artificial Sequence: Synthetic peptide
  XENP026334 vhCDR2
WINTYTGDPTYADGFTG

SEQ ID NO: 41513 - protein, 8 aa, Artificial Sequence
  Description of Artificial Sequence: Synthetic peptide
  XENP026334 vhCDR3
DYYGSSPY

SEQ ID NO: 41514 - protein, 219 aa, Artificial Sequence; identical to SEQ ID NO: 41394
  Description of Artificial Sequence: Synthetic polypeptide
  XENP026334 1C11[PD-1]_H3.138_L3.38_IgG1_PVA_/S267K Light Chain

SEQ ID NO: 41515 - protein, 112 aa, Artificial Sequence; identical to SEQ ID NO: 41395
  Description of Artificial Sequence: Synthetic polypeptide
  VL of XENP026334

SEQ ID NO: 41516 - protein, 16 aa, Artificial Sequence
  Description of Artificial Sequence: Synthetic peptide
  XENP026334 vlCDR1
KSSQSIVHSNGNNYLE

SEQ ID NO: 41517 - protein, 7 aa, Artificial Sequence
  Description of Artificial Sequence: Synthetic peptide
  XENP026334 vlCDR2
KVSNRFS

SEQ ID NO: 41518 - protein, 9 aa, Artificial Sequence
  Description of Artificial Sequence: Synthetic peptide
  XENP026334 vlCDR3
FQGSHVPNT

SEQ ID NO: 41519 - protein, 446 aa, Artificial Sequence; identical to SEQ ID NO: 41499
  Description of Artificial Sequence: Synthetic polypeptide
  XENP026335 1C11[PD-1]_H3.138_L3.51_IgG1_PVA_/S267K Heavy Chain

SEQ ID NO: 41520 - protein, 117 aa, Artificial Sequence; identical to SEQ ID NO: 34721
  Description of Artificial Sequence: Synthetic polypeptide
  VH of XENP026335

SEQ ID NO: 41521 - protein, 5 aa, Artificial Sequence
  Description of Artificial Sequence: Synthetic peptide
  XENP026335 vhCDR1
HYGMN

SEQ ID NO: 41522 - protein, 17 aa, Artificial Sequence
  Description of Artificial Sequence: Synthetic peptide
  XENP026335 vhCDR2
WINTYTGDPTYADGFTG

SEQ ID NO: 41523 - protein, 8 aa, Artificial Sequence
  Description of Artificial Sequence: Synthetic peptide
  XENP026335 vhCDR3
DYYGSSPY

SEQ ID NO: 41524 - protein, 219 aa, Artificial Sequence; identical to SEQ ID NO: 41404
  Description of Artificial Sequence: Synthetic polypeptide
  XENP026335 1C11[PD-1]_H3.138_L3.51_IgG1_PVA_/S267K Light Chain

SEQ ID NO: 41525 - protein, 112 aa, Artificial Sequence; identical to SEQ ID NO: 41405
  Description of Artificial Sequence: Synthetic polypeptide
  VL of XENP026335

SEQ ID NO: 41526 - protein, 16 aa, Artificial Sequence
  Description of Artificial Sequence: Synthetic peptide
  XENP026335 vlCDR1
KSSQSIVHSNGNTYLE

SEQ ID NO: 41527 - protein, 7 aa, Artificial Sequence
  Description of Artificial Sequence: Synthetic peptide
  XENP026335 vlCDR2
SVSNRFS

SEQ ID NO: 41528 - protein, 9 aa, Artificial Sequence
  Description of Artificial Sequence: Synthetic peptide
  XENP026335 vlCDR3
FQGSHVPNT

SEQ ID NO: 41529 - protein, 446 aa, Artificial Sequence; identical to SEQ ID NO: 41499
  Description of Artificial Sequence: Synthetic polypeptide
  XENP026336 1C11[PD-1]_H3.138_L3.59_IgG1_PVA_/S267K Heavy Chain

SEQ ID NO: 41530 - protein, 117 aa, Artificial Sequence; identical to SEQ ID NO: 34721
  Description of Artificial Sequence: Synthetic polypeptide
  VH of XENP026336

SEQ ID NO: 41531 - protein, 5 aa, Artificial Sequence
  Description of Artificial Sequence: Synthetic peptide
  XENP026336 vhCDR1
HYGMN

SEQ ID NO: 41532 - protein, 17 aa, Artificial Sequence
  Description of Artificial Sequence: Synthetic peptide
  XENP026336 vhCDR2
WINTYTGDPTYADGFTG

SEQ ID NO: 41533 - protein, 8 aa, Artificial Sequence
  Description of Artificial Sequence: Synthetic peptide
  XENP026336 vhCDR3
DYYGSSPY

SEQ ID NO: 41534 - protein, 219 aa, Artificial Sequence; identical to SEQ ID NO: 41414
  Description of Artificial Sequence: Synthetic polypeptide
  XENP026336 1C11[PD-1]_H3.138_L3.59_IgG1_PVA_/S267K Light Chain

SEQ ID NO: 41535 - protein, 112 aa, Artificial Sequence; identical to SEQ ID NO: 39446
  Description of Artificial Sequence: Synthetic polypeptide
  VL of XENP026336

SEQ ID NO: 41536 - protein, 16 aa, Artificial Sequence
  Description of Artificial Sequence: Synthetic peptide
  XENP026336 vlCDR1
KSSQSIVHSNGNTYLE

SEQ ID NO: 41537 - protein, 7 aa, Artificial Sequence
  Description of Artificial Sequence: Synthetic peptide
  XENP026336 vlCDR2
KVSNRFS

SEQ ID NO: 41538 - protein, 9 aa, Artificial Sequence
  Description of Artificial Sequence: Synthetic peptide
  XENP026336 vlCDR3
FQGSHVPNT

SEQ ID NO: 41539 - protein, 446 aa, Artificial Sequence; identical to SEQ ID NO: 41499
  Description of Artificial Sequence: Synthetic polypeptide
  XENP026337 1C11[PD-1]_H3.138_L3.73_IgG1_PVA_/S267K Heavy Chain

SEQ ID NO: 41540 - protein, 117 aa, Artificial Sequence; identical to SEQ ID NO: 34721
  Description of Artificial Sequence: Synthetic polypeptide
  VH of XENP026337

SEQ ID NO: 41541 - protein, 5 aa, Artificial Sequence
  Description of Artificial Sequence: Synthetic peptide
  XENP026337 vhCDR1
HYGMN

SEQ ID NO: 41542 - protein, 17 aa, Artificial Sequence
  Description of Artificial Sequence: Synthetic peptide
  XENP026337 vhCDR2
WINTYTGDPTYADGFTG

SEQ ID NO: 41543 - protein, 8 aa, Artificial Sequence
  Description of Artificial Sequence: Synthetic peptide
  XENP026337 vhCDR3
DYYGSSPY

SEQ ID NO: 41544 - protein, 219 aa, Artificial Sequence; identical to SEQ ID NO: 41424
  Description of Artificial Sequence: Synthetic polypeptide
  XENP026337 1C11[PD-1]_H3.138_L3.73_IgG1_PVA_/S267K Light Chain

SEQ ID NO: 41545 - protein, 112 aa, Artificial Sequence; identical to SEQ ID NO: 39482
  Description of Artificial Sequence: Synthetic polypeptide
  VL of XENP026337

SEQ ID NO: 41546 - protein, 16 aa, Artificial Sequence
  Description of Artificial Sequence: Synthetic peptide
  XENP026337 vlCDR1
KSSQSIVHSNGNTYLE

SEQ ID NO: 41547 - protein, 7 aa, Artificial Sequence
  Description of Artificial Sequence: Synthetic peptide
  XENP026337 vlCDR2
KVSNRFS

SEQ ID NO: 41548 - protein, 9 aa, Artificial Sequence
  Description of Artificial Sequence: Synthetic peptide
  XENP026337 vlCDR3
FQGSHVPNT

SEQ ID NO: 41549 - protein, 446 aa, Artificial Sequence; identical to SEQ ID NO: 41499
  Description of Artificial Sequence: Synthetic polypeptide
  XENP026338 1C11[PD-1]_H3.138_L3.125_IgG1_PVA_/S267K Heavy Chain

SEQ ID NO: 41550 - protein, 117 aa, Artificial Sequence; identical to SEQ ID NO: 34721
  Description of Artificial Sequence: Synthetic polypeptide
  VH of XENP026338

SEQ ID NO: 41551 - protein, 5 aa, Artificial Sequence
  Description of Artificial Sequence: Synthetic peptide
  XENP026338 vhCDR1
HYGMN

SEQ ID NO: 41552 - protein, 17 aa, Artificial Sequence
  Description of Artificial Sequence: Synthetic peptide
  XENP026338 vhCDR2
WINTYTGDPTYADGFTG

SEQ ID NO: 41553 - protein, 8 aa, Artificial Sequence
  Description of Artificial Sequence: Synthetic peptide
  XENP026338 vhCDR3
DYYGSSPY

SEQ ID NO: 41554 - protein, 219 aa, Artificial Sequence; identical to SEQ ID NO: 41314
  Description of Artificial Sequence: Synthetic polypeptide
  XENP026338 1C11[PD-1]_H3.138_L3.125_IgG1_PVA_/S267K Light Chain

SEQ ID NO: 41555 - protein, 112 aa, Artificial Sequence; identical to SEQ ID NO: 39644
  Description of Artificial Sequence: Synthetic polypeptide
  VL of XENP026338

SEQ ID NO: 41556 - protein, 16 aa, Artificial Sequence
  Description of Artificial Sequence: Synthetic peptide
  XENP026338 vlCDR1
KSSQSIVHSNGNTYLE

SEQ ID NO: 41557 - protein, 7 aa, Artificial Sequence
  Description of Artificial Sequence: Synthetic peptide
  XENP026338 vlCDR2
KVSNRFS

SEQ ID NO: 41558 - protein, 9 aa, Artificial Sequence
  Description of Artificial Sequence: Synthetic peptide
  XENP026338 vlCDR3
FQGSHVPNT

SEQ ID NO: 41559 - protein, 446 aa, Artificial Sequence
  Description of Artificial Sequence: Synthetic polypeptide
  XENP026339 1C11[PD-1]_H3.155_L3.1_IgG1_PVA_/S267K Heavy Chain
QIQLVQSGSELKKPGASVKVSCKASGYTFTHYGMNWVRQAPGQGLEWMGWINTYTGEPTYADGFTGRFVFSLDNSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41560 - protein, 117 aa, Artificial Sequence; identical to SEQ ID NO: 34856
  Description of Artificial Sequence: Synthetic polypeptide
  VH of XENP026339

SEQ ID NO: 41561 - protein, 5 aa, Artificial Sequence
  Description of Artificial Sequence: Synthetic peptide
  XENP026339 vhCDR1
HYGMN

SEQ ID NO: 41562 - protein, 17 aa, Artificial Sequence
  Description of Artificial Sequence: Synthetic peptide
  XENP026339 vhCDR2
WINTYTGEPTYADGFTG

SEQ ID NO: 41563 - protein, 8 aa, Artificial Sequence
  Description of Artificial Sequence: Synthetic peptide
  XENP026339 vhCDR3
DYYGSSPY

SEQ ID NO: 41564 - protein, 219 aa, Artificial Sequence; identical to SEQ ID NO: 41384
  Description of Artificial Sequence: Synthetic polypeptide
  XENP026339 1C11[PD-1]_H3.155_L3.1_IgG1_PVA_/S267K Light Chain

SEQ ID NO: 41565 - protein, 112 aa, Artificial Sequence; identical to SEQ ID NO: 39365
  Description of Artificial Sequence: Synthetic polypeptide
  VL of XENP026339

SEQ ID NO: 41566 - protein, 16 aa, Artificial Sequence
  Description of Artificial Sequence: Synthetic peptide
  XENP026339 vlCDR1
KSSQSIVHSNGNTYLE

SEQ ID NO: 41567 - protein, 7 aa, Artificial Sequence
  Description of Artificial Sequence: Synthetic peptide
  XENP026339 vlCDR2
KVSNRFS

SEQ ID NO: 41568 - protein, 9 aa, Artificial Sequence
  Description of Artificial Sequence: Synthetic peptide
  XENP026339 vlCDR3
FQGSHVPNT

SEQ ID NO: 41569 - protein, 446 aa, Artificial Sequence; identical to SEQ ID NO: 41559
  Description of Artificial Sequence: Synthetic polypeptide
  XENP026340 1C11[PD-1]_H3.155_L3.38_IgG1_PVA_/S267K Heavy Chain

SEQ ID NO: 41570 - protein, 117 aa, Artificial Sequence; identical to SEQ ID NO: 34856
  Description of Artificial Sequence: Synthetic polypeptide
  VH of XENP026340

SEQ ID NO: 41571 - protein, 5 aa, Artificial Sequence
  Description of Artificial Sequence: Synthetic peptide
  XENP026340 vhCDR1
HYGMN

SEQ ID NO: 41572 - protein, 17 aa, Artificial Sequence
  Description of Artificial Sequence: Synthetic peptide
  XENP026340 vhCDR2
WINTYTGEPTYADGFTG

SEQ ID NO: 41573 - protein, 8 aa, Artificial Sequence
  Description of Artificial Sequence: Synthetic peptide
  XENP026340 vhCDR3
DYYGSSPY

SEQ ID NO: 41574 - protein, 219 aa, Artificial Sequence; identical to SEQ ID NO: 41394
  Description of Artificial Sequence: Synthetic polypeptide
  XENP026340 1C11[PD-1]_H3.155_L3.38_IgG1_PVA_/S267K Light Chain

SEQ ID NO: 41575 - protein, 112 aa, Artificial Sequence; identical to SEQ ID NO: 41395
  Description of Artificial Sequence: Synthetic polypeptide
  VL of XENP026340

SEQ ID NO: 41576 - protein, 16 aa, Artificial Sequence
  Description of Artificial Sequence: Synthetic peptide
  XENP026340 vlCDR1
KSSQSIVHSNGNNYLE

SEQ ID NO: 41577 - protein, 7 aa, Artificial Sequence
  Description of Artificial Sequence: Synthetic peptide
  XENP026340 vlCDR2
KVSNRFS

SEQ ID NO: 41578 - protein, 9 aa, Artificial Sequence
  Description of Artificial Sequence: Synthetic peptide
  XENP026340 vlCDR3
FQGSHVPNT

SEQ ID NO: 41579 - protein, 446 aa, Artificial Sequence; identical to SEQ ID NO: 41559
  Description of Artificial Sequence: Synthetic polypeptide
  XENP026341 1C11[PD-1]_H3.155_L3.51_IgG1_PVA_/S267K Heavy Chain

SEQ ID NO: 41580 - protein, 117 aa, Artificial Sequence; identical to SEQ ID NO: 34856
  Description of Artificial Sequence: Synthetic polypeptide
  VH of XENP026341

SEQ ID NO: 41581 - protein, 5 aa, Artificial Sequence
  Description of Artificial Sequence: Synthetic peptide
  XENP026341 vhCDR1
HYGMN

SEQ ID NO: 41582 - protein, 17 aa, Artificial Sequence
  Description of Artificial Sequence: Synthetic peptide
  XENP026341 vhCDR2
WINTYTGEPTYADGFTG

SEQ ID NO: 41583 - protein, 8 aa, Artificial Sequence
  Description of Artificial Sequence: Synthetic peptide
  XENP026341 vhCDR3
DYYGSSPY

SEQ ID NO: 41584 - protein, 219 aa, Artificial Sequence; identical to SEQ ID NO: 41404
  Description of Artificial Sequence: Synthetic polypeptide
  XENP026341 1C11[PD-1]_H3.155_L3.51_IgG1_PVA_/S267K Light Chain

SEQ ID NO: 41585 - protein, 112 aa, Artificial Sequence; identical to SEQ ID NO: 41405
  Description of Artificial Sequence: Synthetic polypeptide
  VL of XENP026341

SEQ ID NO: 41586 - protein, 16 aa, Artificial Sequence
  Description of Artificial Sequence: Synthetic peptide
  XENP026341 vlCDR1
KSSQSIVHSNGNTYLE

SEQ ID NO: 41587 - protein, 7 aa, Artificial Sequence
  Description of Artificial Sequence: Synthetic peptide
  XENP026341 vlCDR2
SVSNRFS

SEQ ID NO: 41588 - protein, 9 aa, Artificial Sequence
  Description of Artificial Sequence: Synthetic peptide
  XENP026341 vlCDR3
FQGSHVPNT

SEQ ID NO: 41589 - protein, 446 aa, Artificial Sequence; identical to SEQ ID NO: 41559
  Description of Artificial Sequence: Synthetic polypeptide
  XENP026342 1C11[PD-1]_H3.155_L3.59_IgG1_PVA_/S267K Heavy Chain

SEQ ID NO: 41590 - protein, 117 aa, Artificial Sequence; identical to SEQ ID NO: 34856
  Description of Artificial Sequence: Synthetic polypeptide
  VH of XENP026342

SEQ ID NO: 41591 - protein, 5 aa, Artificial Sequence
  Description of Artificial Sequence: Synthetic peptide
  XENP026342 vhCDR1
HYGMN

SEQ ID NO: 41592 - protein, 17 aa, Artificial Sequence
  Description of Artificial Sequence: Synthetic peptide
  XENP026342 vhCDR2
WINTYTGEPTYADGFTG

SEQ ID NO: 41593 - protein, 8 aa, Artificial Sequence
  Description of Artificial Sequence: Synthetic peptide
  XENP026342 vhCDR3
DYYGSSPY

SEQ ID NO: 41594 - protein, 219 aa, Artificial Sequence; identical to SEQ ID NO: 41414
  Description of Artificial Sequence: Synthetic polypeptide
  XENP026342 1C11[PD-1]_H3.155_L3.59_IgG1_PVA_/S267K Light Chain

SEQ ID NO: 41595 - protein, 112 aa, Artificial Sequence; identical to SEQ ID NO: 39446
  Description of Artificial Sequence: Synthetic polypeptide
  VL of XENP026342

SEQ ID NO: 41596 - protein, 16 aa, Artificial Sequence
  Description of Artificial Sequence: Synthetic peptide
  XENP026342 vlCDR1
KSSQSIVHSNGNTYLE

SEQ ID NO: 41597 - protein, 7 aa, Artificial Sequence
  Description of Artificial Sequence: Synthetic peptide
  XENP026342 vlCDR2
KVSNRFS

SEQ ID NO: 41598 - protein, 9 aa, Artificial Sequence
  Description of Artificial Sequence: Synthetic peptide
  XENP026342 vlCDR3
FQGSHVPNT

SEQ ID NO: 41599 - protein, 446 aa, Artificial Sequence; identical to SEQ ID NO: 41559
  Description of Artificial Sequence: Synthetic polypeptide
  XENP026343 1C11[PD-1]_H3.155_L3.73_IgG1_PVA_/S267K Heavy Chain

SEQ ID NO: 41600 - protein, 117 aa, Artificial Sequence; identical to SEQ ID NO: 34856
  Description of Artificial Sequence: Synthetic polypeptide
  VH of XENP026343

SEQ ID NO: 41601 - protein, 5 aa, Artificial Sequence
  Description of Artificial Sequence: Synthetic peptide
  XENP026343 vhCDR1
HYGMN

SEQ ID NO: 41602 - protein, 17 aa, Artificial Sequence
  Description of Artificial Sequence: Synthetic peptide
  XENP026343 vhCDR2
WINTYTGEPTYADGFTG

SEQ ID NO: 41603 - protein, 8 aa, Artificial Sequence
  Description of Artificial Sequence: Synthetic peptide
  XENP026343 vhCDR3
DYYGSSPY

SEQ ID NO: 41604 - protein, 219 aa, Artificial Sequence; identical to SEQ ID NO: 41424
  Description of Artificial Sequence: Synthetic polypeptide
  XENP026343 1C11[PD-1]_H3.155_L3.73_IgG1_PVA_/S267K Light Chain

SEQ ID NO: 41605 - protein, 112 aa, Artificial Sequence; identical to SEQ ID NO: 39482
  Description of Artificial Sequence: Synthetic polypeptide
  VL of XENP026343

SEQ ID NO: 41606 - protein, 16 aa, Artificial Sequence
  Description of Artificial Sequence: Synthetic peptide
  XENP026343 vlCDR1
KSSQSIVHSNGNTYLE

SEQ ID NO: 41607 - protein, 7 aa, Artificial Sequence
  Description of Artificial Sequence: Synthetic peptide
  XENP026343 vlCDR2
KVSNRFS

SEQ ID NO: 41608 - protein, 9 aa, Artificial Sequence
  Description of Artificial Sequence: Synthetic peptide
  XENP026343 vlCDR3
FQGSHVPNT

SEQ ID NO: 41609 - protein, 446 aa, Artificial Sequence; identical to SEQ ID NO: 41559
  Description of Artificial Sequence: Synthetic polypeptide
  XENP026344 1C11[PD-1]_H3.155_L3.125_IgG1_PVA_/S267K Heavy Chain

SEQ ID NO: 41610 - protein, 117 aa, Artificial Sequence; identical to SEQ ID NO: 34856
  Description of Artificial Sequence: Synthetic polypeptide
  VH of XENP026344

SEQ ID NO: 41611 - protein, 5 aa, Artificial Sequence
  Description of Artificial Sequence: Synthetic peptide
  XENP026344 vhCDR1
HYGMN

SEQ ID NO: 41612 - protein, 17 aa, Artificial Sequence
  Description of Artificial Sequence: Synthetic peptide
  XENP026344 vhCDR2
WINTYTGEPTYADGFTG

SEQ ID NO: 41613 - protein, 8 aa, Artificial Sequence
  Description of Artificial Sequence: Synthetic peptide
  XENP026344 vhCDR3
DYYGSSPY

SEQ ID NO: 41614 - protein, 219 aa, Artificial Sequence; identical to SEQ ID NO: 41314
  Description of Artificial Sequence: Synthetic polypeptide
  XENP026344 1C11[PD-1]_H3.155_L3.125_IgG1_PVA_/S267K Light Chain

SEQ ID NO: 41615 - protein, 112 aa, Artificial Sequence; identical to SEQ ID NO: 39644
  Description of Artificial Sequence: Synthetic polypeptide
  VL of XENP026344

SEQ ID NO: 41616 - protein, 16 aa, Artificial Sequence
  Description of Artificial Sequence: Synthetic peptide
  XENP026344 vlCDR1
KSSQSIVHSNGNTYLE

SEQ ID NO: 41617 - protein, 7 aa, Artificial Sequence
  Description of Artificial Sequence: Synthetic peptide
  XENP026344 vlCDR2
KVSNRFS

SEQ ID NO: 41618 - protein, 9 aa, Artificial Sequence
  Description of Artificial Sequence: Synthetic peptide
  XENP026344 vlCDR3
FQGSHVPNT

SEQ ID NO: 41619 - protein, 446 aa, Artificial Sequence; identical to SEQ ID NO: 39254
  Description of Artificial Sequence: Synthetic polypeptide
  XenD17478 1C11[PD-1]_H3_IgG1_PVA_/S267K

SEQ ID NO: 41620 - protein, 117 aa, Artificial Sequence; identical to SEQ ID NO: 33034
  Description of Artificial Sequence: Synthetic polypeptide
  VH of XenD17478

SEQ ID NO: 41621 - protein, 5 aa, Artificial Sequence
  Description of Artificial Sequence: Synthetic peptide
  XenD17478 vhCDR1
HYGMN

SEQ ID NO: 41622 - protein, 17 aa, Artificial Sequence
  Description of Artificial Sequence: Synthetic peptide
  XenD17478 vhCDR2
WINTYTGEPTYADGFTG

SEQ ID NO: 41623 - protein, 8 aa, Artificial Sequence
  Description of Artificial Sequence: Synthetic peptide
  XenD17478 vhCDR3
DYYGSSPY

SEQ ID NO: 41624 - protein, 446 aa, Artificial Sequence; identical to SEQ ID NO: 41379
  Description of Artificial Sequence: Synthetic polypeptide
  XenD18576 1C11_H3.59_IgG1_PVA_/S267K

SEQ ID NO: 41625 - protein, 117 aa, Artificial Sequence; identical to SEQ ID NO: 33992
  Description of Artificial Sequence: Synthetic polypeptide
  VH of XenD18576

SEQ ID NO: 41626 - protein, 5 aa, Artificial Sequence
  Description of Artificial Sequence: Synthetic peptide
  XenD18576 vhCDR1
HYGMN

SEQ ID NO: 41627 - protein, 17 aa, Artificial Sequence
  Description of Artificial Sequence: Synthetic peptide
  XenD18576 vhCDR2
WINTYTGEPTYADGFTG

SEQ ID NO: 41628 - protein, 8 aa, Artificial Sequence
  Description of Artificial Sequence: Synthetic peptide
  XenD18576 vhCDR3
DYYGSSPY

SEQ ID NO: 41629 - protein, 446 aa, Artificial Sequence
  Description of Artificial Sequence: Synthetic polypeptide
  XenD22097 1C11_H3.242_IgG1_PVA_/S267K
QIQLVQSGSELKKPGASVKVSCKASAYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41630 - protein, 117 aa, Artificial Sequence
  Description of Artificial Sequence: Synthetic polypeptide
  VH of XenD22097
QIQLVQSGSELKKPGASVKVSCKASAYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41631 - protein, 5 aa, Artificial Sequence
  Description of Artificial Sequence: Synthetic peptide
  XenD22097 vhCDR1
HYGMN

SEQ ID NO: 41632 - protein, 17 aa, Artificial Sequence
  Description of Artificial Sequence: Synthetic peptide
  XenD22097 vhCDR2
WINTYTGEPTYADGFTG

SEQ ID NO: 41633 - protein, 8 aa, Artificial Sequence
  Description of Artificial Sequence: Synthetic peptide
  XenD22097 vhCDR3
DYYGSSPY

SEQ ID NO: 41634 - protein, 446 aa, Artificial Sequence
  Description of Artificial Sequence: Synthetic polypeptide
  XenD22098 1C11_H3.243_IgG1_PVA_/S267K
QIQLVQSGSELKKPGASVKVSCKASSYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41635 - protein, 117 aa, Artificial Sequence
  Description of Artificial Sequence: Synthetic polypeptide
  VH of XenD22098
QIQLVQSGSELKKPGASVKVSCKASSYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41636 - protein, 5 aa, Artificial Sequence
  Description of Artificial Sequence: Synthetic peptide
  XenD22098 vhCDR1
HYGMN

SEQ ID NO: 41637 - protein, 17 aa, Artificial Sequence
  Description of Artificial Sequence: Synthetic peptide
  XenD22098 vhCDR2
WINTYTGEPTYADGFTG

SEQ ID NO: 41638 - protein, 8 aa, Artificial Sequence
  Description of Artificial Sequence: Synthetic peptide
  XenD22098 vhCDR3
DYYGSSPY

SEQ ID NO: 41639 - protein, 446 aa, Artificial Sequence
  Description of Artificial Sequence: Synthetic polypeptide
  XenD22099 1C11_H3.244_IgG1_PVA_/S267K
QIQLVQSGSELKKPGASVKVSCKASTYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41640 - protein, 117 aa, Artificial Sequence
  Description of Artificial Sequence: Synthetic polypeptide
  VH of XenD22099
QIQLVQSGSELKKPGASVKVSCKASTYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41641 - protein, 5 aa, Artificial Sequence
  Description of Artificial Sequence: Synthetic peptide
  XenD22099 vhCDR1
HYGMN

SEQ ID NO: 41642 - protein, 17 aa, Artificial Sequence
  Description of Artificial Sequence: Synthetic peptide
  XenD22099 vhCDR2
WINTYTGEPTYADGFTG

SEQ ID NO: 41643 - protein, 8 aa, Artificial Sequence
  Description of Artificial Sequence: Synthetic peptide
  XenD22099 vhCDR3
DYYGSSPY

SEQ ID NO: 41644 - protein, 446 aa, Artificial Sequence
  Description of Artificial Sequence: Synthetic polypeptide
  XenD22100 1C11_H3.245_IgG1_PVA_/S267K
QIQLVQSGSELKKPGASVKVSCKASGWTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41645 - protein, 117 aa, Artificial Sequence
  Description of Artificial Sequence: Synthetic polypeptide
  VH of XenD22100
QIQLVQSGSELKKPGASVKVSCKASGWTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41646 - protein, 5 aa, Artificial Sequence
  Description of Artificial Sequence: Synthetic peptide
  XenD22100 vhCDR1
HYGMN

SEQ ID NO: 41647 - protein, 17 aa, Artificial Sequence
  Description of Artificial Sequence: Synthetic peptide
  XenD22100 vhCDR2
WINTYTGEPTYADGFTG

SEQ ID NO: 41648 - protein, 8 aa, Artificial Sequence
  Description of Artificial Sequence: Synthetic peptide
  XenD22100 vhCDR3
DYYGSSPY

SEQ ID NO: 41649 - protein, 446 aa, Artificial Sequence
  Description of Artificial Sequence: Synthetic polypeptide
  XenD22101 1C11_H3.246_IgG1_PVA_/S267K
QIQLVQSGSELKKPGASVKVSCKASGLTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41650 - protein, 117 aa, Artificial Sequence
  Description of Artificial Sequence: Synthetic polypeptide
  VH of XenD22101
QIQLVQSGSELKKPGASVKVSCKASGLTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41651 - protein, 5 aa, Artificial Sequence
  Description of Artificial Sequence: Synthetic peptide
  XenD22101 vhCDR1
HYGMN

SEQ ID NO: 41652 - protein, 17 aa, Artificial Sequence
  Description of Artificial Sequence: Synthetic peptide
  XenD22101 vhCDR2
WINTYTGEPTYADGFTG

SEQ ID NO: 41653 - protein, 8 aa, Artificial Sequence
  Description of Artificial Sequence: Synthetic peptide
  XenD22101 vhCDR3
DYYGSSPY

SEQ ID NO: 41654 - protein, 446 aa, Artificial Sequence
  Description of Artificial Sequence: Synthetic polypeptide
  XenD22102 1C11_H3.247_IgG1_PVA_/S267K
QIQLVQSGSELKKPGASVKVSCKASGHTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41655 - protein, 117 aa, Artificial Sequence
  Description of Artificial Sequence: Synthetic polypeptide
  VH of XenD22102
QIQLVQSGSELKKPGASVKVSCKASGHTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41656 - protein, 5 aa, Artificial Sequence
  Description of Artificial Sequence: Synthetic peptide
  XenD22102 vhCDR1
HYGMN

SEQ ID NO: 41657 - protein, 17 aa, Artificial Sequence
  Description of Artificial Sequence: Synthetic peptide
  XenD22102 vhCDR2
WINTYTGEPTYADGFTG

SEQ ID NO: 41658 - protein, 8 aa, Artificial Sequence
  Description of Artificial Sequence: Synthetic peptide
  XenD22102 vhCDR3
DYYGSSPY

SEQ ID NO: 41659 - protein, 446 aa, Artificial Sequence
  Description of Artificial Sequence: Synthetic polypeptide
  XenD22103 1C11_H3.248_IgG1_PVA_/S267K
QIQLVQSGSELKKPGASVKVSCKASGQTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41660 - protein, 117 aa, Artificial Sequence
  Description of Artificial Sequence: Synthetic polypeptide
  VH of XenD22103
QIQLVQSGSELKKPGASVKVSCKASGQTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41661 - protein, 5 aa, Artificial Sequence
  Description of Artificial Sequence: Synthetic peptide
  XenD22103 vhCDR1
HYGMN

SEQ ID NO: 41662 - protein, 17 aa, Artificial Sequence
  Description of Artificial Sequence: Synthetic peptide
  XenD22103 vhCDR2
WINTYTGEPTYADGFTG

SEQ ID NO: 41663 - protein, 8 aa, Artificial Sequence
  Description of Artificial Sequence: Synthetic peptide
  XenD22103 vhCDR3
DYYGSSPY

SEQ ID NO: 41664 - protein, 446 aa, Artificial Sequence
  Description of Artificial Sequence: Synthetic polypeptide
  XenD22104 1C11_H3.249_IgG1_PVA_/S267K
QIQLVQSGSELKKPGASVKVSCKASGDTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41665 - protein, 117 aa, Artificial Sequence
  Description of Artificial Sequence: Synthetic polypeptide
  VH of XenD22104
QIQLVQSGSELKKPGASVKVSCKASGDTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41666 - protein, 5 aa, Artificial Sequence
  Description of Artificial Sequence: Synthetic peptide
  XenD22104 vhCDR1
HYGMN

SEQ ID NO: 41667 - protein, 17 aa, Artificial Sequence
  Description of Artificial Sequence: Synthetic peptide
  XenD22104 vhCDR2
WINTYTGEPTYADGFTG

SEQ ID NO: 41668 - protein, 8 aa, Artificial Sequence
  Description of Artificial Sequence: Synthetic peptide
  XenD22104 vhCDR3
DYYGSSPY

SEQ ID NO: 41669 - protein, 446 aa, Artificial Sequence
  Description of Artificial Sequence: Synthetic polypeptide
  XenD22105 1C11_H3.250_IgG1_PVA_/S267K
QIQLVQSGSELKKPGASVKVSCKASGKTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41670 - protein, 117 aa, Artificial Sequence
  Description of Artificial Sequence: Synthetic polypeptide
  VH of XenD22105
QIQLVQSGSELKKPGASVKVSCKASGKTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41671 - protein, 5 aa, Artificial Sequence
  Description of Artificial Sequence: Synthetic peptide
  XenD22105 vhCDR1
HYGMN

SEQ ID NO: 41672 - protein, 17 aa, Artificial Sequence
  Description of Artificial Sequence: Synthetic peptide
  XenD22105 vhCDR2
WINTYTGEPTYADGFTG

SEQ ID NO: 41673 - protein, 8 aa, Artificial Sequence
  Description of Artificial Sequence: Synthetic peptide
  XenD22105 vhCDR3
DYYGSSPY

SEQ ID NO: 41674 - protein, 446 aa, Artificial Sequence
  Description of Artificial Sequence: Synthetic polypeptide
  XenD22106 1C11_H3.251_IgG1_PVA_/S267K
QIQLVQSGSELKKPGASVKVSCKASGYVFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41675 - protein, 117 aa, Artificial Sequence
  Description of Artificial Sequence: Synthetic polypeptide
  VH of XenD22106
QIQLVQSGSELKKPGASVKVSCKASGYVFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41676 - protein, 5 aa, Artificial Sequence
  Description of Artificial Sequence: Synthetic peptide
  XenD22106 vhCDR1
HYGMN

SEQ ID NO: 41677 - protein, 17 aa, Artificial Sequence
  Description of Artificial Sequence: Synthetic peptide
  XenD22106 vhCDR2
WINTYTGEPTYADGFTG

SEQ ID NO: 41678 - protein, 8 aa, Artificial Sequence
  Description of Artificial Sequence: Synthetic peptide
  XenD22106 vhCDR3
DYYGSSPY

SEQ ID NO: 41679 - protein, 446 aa, Artificial Sequence
  Description of Artificial Sequence: Synthetic polypeptide
  XenD22107 1C11_H3.252_IgG1_PVA_/S267K
QIQLVQSGSELKKPGASVKVSCKASGYAFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41680 - protein, 117 aa, Artificial Sequence
  Description of Artificial Sequence: Synthetic polypeptide
  VH of XenD22107
QIQLVQSGSELKKPGASVKVSCKASGYAFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41681 - protein, 5 aa, Artificial Sequence
  Description of Artificial Sequence: Synthetic peptide
  XenD22107 vhCDR1
HYGMN

SEQ ID NO: 41682 - protein, 17 aa, Artificial Sequence
  Description of Artificial Sequence: Synthetic peptide
  XenD22107 vhCDR2
WINTYTGEPTYADGFTG

SEQ ID NO: 41683 - protein, 8 aa, Artificial Sequence
  Description of Artificial Sequence: Synthetic peptide
  XenD22107 vhCDR3
DYYGSSPY

SEQ ID NO: 41684 - protein, 446 aa, Artificial Sequence
  Description of Artificial Sequence: Synthetic polypeptide
  XenD22108 1C11_H3.253_IgG1_PVA_/S267K
QIQLVQSGSELKKPGASVKVSCKASGYIFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41685 - protein, 117 aa, Artificial Sequence
  Description of Artificial Sequence: Synthetic polypeptide
  VH of XenD22108
QIQLVQSGSELKKPGASVKVSCKASGYIFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41686 - protein, 5 aa, Artificial Sequence
  Description of Artificial Sequence: Synthetic peptide
  XenD22108 vhCDR1
HYGMN

SEQ ID NO: 41687 - protein, 17 aa, Artificial Sequence
  Description of Artificial Sequence: Synthetic peptide
  XenD22108 vhCDR2
WINTYTGEPTYADGFTG

SEQ ID NO: 41688 - protein, 8 aa, Artificial Sequence
  Description of Artificial Sequence: Synthetic peptide
  XenD22108 vhCDR3
DYYGSSPY

SEQ ID NO: 41689 - protein, 446 aa, Artificial Sequence
  Description of Artificial Sequence: Synthetic polypeptide
  XenD22109 1C11_H3.254_IgG1_PVA_/S267K
QIQLVQSGSELKKPGASVKVSCKASGYQFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41690 - protein, 117 aa, Artificial Sequence
  Description of Artificial Sequence: Synthetic polypeptide
  VH of XenD22109
QIQLVQSGSELKKPGASVKVSCKASGYQFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41691 - protein, 5 aa, Artificial Sequence
  Description of Artificial Sequence: Synthetic peptide
  XenD22109 vhCDR1
HYGMN

SEQ ID NO: 41692 - protein, 17 aa, Artificial Sequence
  Description of Artificial Sequence: Synthetic peptide
  XenD22109 vhCDR2
WINTYTGEPTYADGFTG

SEQ ID NO: 41693 - protein, 8 aa, Artificial Sequence
  Description of Artificial Sequence: Synthetic peptide
  XenD22109 vhCDR3
DYYGSSPY

SEQ ID NO: 41694 - protein, 446 aa, Artificial Sequence
  Description of Artificial Sequence: Synthetic polypeptide
  XenD22110 1C11_H3.255_IgG1_PVA_/S267K
QIQLVQSGSELKKPGASVKVSCKASGYTYTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41695 - protein, 117 aa, Artificial Sequence
  Description of Artificial Sequence: Synthetic polypeptide
  VH of XenD22110
QIQLVQSGSELKKPGASVKVSCKASGYTYTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41696 - protein, 5 aa, Artificial Sequence
  Description of Artificial Sequence: Synthetic peptide
  XenD22110 vhCDR1
HYGMN

SEQ ID NO: 41697 - protein, 17 aa, Artificial Sequence
  Description of Artificial Sequence: Synthetic peptide
  XenD22110 vhCDR2
WINTYTGEPTYADGFTG

SEQ ID NO: 41698 - protein, 8 aa, Artificial Sequence
  Description of Artificial Sequence: Synthetic peptide
  XenD22110 vhCDR3
DYYGSSPY

SEQ ID NO: 41699 - protein, 446 aa, Artificial Sequence
  Description of Artificial Sequence: Synthetic polypeptide
  XenD22111 1C11_H3.256_IgG1_PVA_/S267K
QIQLVQSGSELKKPGASVKVSCKASGYTWTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41700 - protein, 117 aa, Artificial Sequence
  Description of Artificial Sequence: Synthetic polypeptide
  VH of XenD22111
QIQLVQSGSELKKPGASVKVSCKASGYTWTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41701 - protein, 5 aa, Artificial Sequence
  Description of Artificial Sequence: Synthetic peptide
  XenD22111 vhCDR1
HYGMN

SEQ ID NO: 41702 - protein, 17 aa, Artificial Sequence
  Description of Artificial Sequence: Synthetic peptide
  XenD22111 vhCDR2
WINTYTGEPTYADGFTG

SEQ ID NO: 41703 - protein, 8 aa, Artificial Sequence
  Description of Artificial Sequence: Synthetic peptide
  XenD22111 vhCDR3
DYYGSSPY

SEQ ID NO: 41704 - protein, 446 aa, Artificial Sequence
  Description of Artificial Sequence: Synthetic polypeptide
  XenD22112 1C11_H3.257_IgG1_PVA_/S267K
QIQLVQSGSELKKPGASVKVSCKASGYTHTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41705 - protein, 117 aa, Artificial Sequence
  Description of Artificial Sequence: Synthetic polypeptide
  VH of XenD22112
QIQLVQSGSELKKPGASVKVSCKASGYTHTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41706 - protein, 5 aa, Artificial Sequence
  Description of Artificial Sequence: Synthetic peptide
  XenD22112 vhCDR1
HYGMN

SEQ ID NO: 41707 - protein, 17 aa, Artificial Sequence
  Description of Artificial Sequence: Synthetic peptide
  XenD22112 vhCDR2
WINTYTGEPTYADGFTG

SEQ ID NO: 41708 - protein, 8 aa, Artificial Sequence
  Description of Artificial Sequence: Synthetic peptide
  XenD22112 vhCDR3
DYYGSSPY

SEQ ID NO: 41709 - protein, 446 aa, Artificial Sequence
  Description of Artificial Sequence: Synthetic polypeptide
  XenD22113 1C11_H3.258_IgG1_PVA_/S267K
QIQLVQSGSELKKPGASVKVSCKASGYTFVHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41710 - protein, 117 aa, Artificial Sequence
  Description of Artificial Sequence: Synthetic polypeptide
  VH of XenD22113
QIQLVQSGSELKKPGASVKVSCKASGYTFVHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41711 - protein, 5 aa, Artificial Sequence
  Description of Artificial Sequence: Synthetic peptide
  XenD22113 vhCDR1
HYGMN

SEQ ID NO: 41712 - protein, 17 aa, Artificial Sequence
  Description of Artificial Sequence: Synthetic peptide
  XenD22113 vhCDR2
WINTYTGEPTYADGFTG

SEQ ID NO: 41713 - protein, 8 aa, Artificial Sequence
  Description of Artificial Sequence: Synthetic peptide
  XenD22113 vhCDR3
DYYGSSPY

SEQ ID NO: 41714 - protein, 446 aa, Artificial Sequence
  Description of Artificial Sequence: Synthetic polypeptide
  XenD22114 1C11_H3.259_IgG1_PVA_/S267K
QIQLVQSGSELKKPGASVKVSCKASGYTFAHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41715 - protein, 117 aa, Artificial Sequence
  Description of Artificial Sequence: Synthetic polypeptide
  VH of XenD22114
QIQLVQSGSELKKPGASVKVSCKASGYTFAHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41716 - protein, 5 aa, Artificial Sequence
  Description of Artificial Sequence: Synthetic peptide
  XenD22114 vhCDR1
HYGMN

SEQ ID NO: 41717 - protein, 17 aa, Artificial Sequence
  Description of Artificial Sequence: Synthetic peptide
  XenD22114 vhCDR2
WINTYTGEPTYADGFTG

SEQ ID NO: 41718 - protein, 8 aa, Artificial Sequence
  Description of Artificial Sequence: Synthetic peptide
  XenD22114 vhCDR3
DYYGSSPY

SEQ ID NO: 41719 - protein, 446 aa, Artificial Sequence
  Description of Artificial Sequence: Synthetic polypeptide
  XenD22115 1C11_H3.260_IgG1_PVA_/S267K
QIQLVQSGSELKKPGASVKVSCKASGYTFIHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41720 - protein, 117 aa, Artificial Sequence
  Description of Artificial Sequence: Synthetic polypeptide
  VH of XenD22115
QIQLVQSGSELKKPGASVKVSCKASGYTFIHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41721 - protein, 5 aa, Artificial Sequence
  Description of Artificial Sequence: Synthetic peptide
  XenD22115 vhCDR1
HYGMN

SEQ ID NO: 41722 - protein, 17 aa, Artificial Sequence
  Description of Artificial Sequence: Synthetic peptide
  XenD22115 vhCDR2
WINTYTGEPTYADGFTG

SEQ ID NO: 41723 - protein, 8 aa, Artificial Sequence
  Description of Artificial Sequence: Synthetic peptide
  XenD22115 vhCDR3
DYYGSSPY

SEQ ID NO: 41724 - protein, 446 aa, Artificial Sequence
  Description of Artificial Sequence: Synthetic polypeptide
  XenD22116 1C11_H3.261_IgG1_PVA_/S267K
QIQLVQSGSELKKPGASVKVSCKASGYTFQHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41725 - protein, 117 aa, Artificial Sequence
  Description of Artificial Sequence: Synthetic polypeptide
  VH of XenD22116
QIQLVQSGSELKKPGASVKVSCKASGYTFQHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41726 - protein, 5 aa, Artificial Sequence
  Description of Artificial Sequence: Synthetic peptide
  XenD22116 vhCDR1
HYGMN

SEQ ID NO: 41727 - protein, 17 aa, Artificial Sequence
  Description of Artificial Sequence: Synthetic peptide
  XenD22116 vhCDR2
WINTYTGEPTYADGFTG

SEQ ID NO: 41728 - protein, 8 aa, Artificial Sequence
  Description of Artificial Sequence: Synthetic peptide
  XenD22116 vhCDR3
DYYGSSPY

SEQ ID NO: 41729 - protein, 446 aa, Artificial Sequence
  Description of Artificial Sequence: Synthetic polypeptide
  XenD22117 1C11_H3.262_IgG1_PVA_/S267K
QIQLVQSGSELKKPGASVKVSCKASGYTFTYYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41730 - protein, 117 aa, Artificial Sequence
  Description of Artificial Sequence: Synthetic polypeptide
  VH of XenD22117
QIQLVQSGSELKKPGASVKVSCKASGYTFTYYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41731 - protein, 5 aa, Artificial Sequence
  Description of Artificial Sequence: Synthetic peptide
  XenD22117 vhCDR1
YYGMN

SEQ ID NO: 41732 - protein, 17 aa, Artificial Sequence
  Description of Artificial Sequence: Synthetic peptide
  XenD22117 vhCDR2
WINTYTGEPTYADGFTG

SEQ ID NO: 41733 - protein, 8 aa, Artificial Sequence
  Description of Artificial Sequence: Synthetic peptide
  XenD22117 vhCDR3
DYYGSSPY

SEQ ID NO: 41734 - protein, 446 aa, Artificial Sequence
  Description of Artificial Sequence: Synthetic polypeptide
  XenD22118 1C11_H3.263_IgG1_PVA_/S267K
QIQLVQSGSELKKPGASVKVSCKASGYTFTQYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41735 - protein, 117 aa, Artificial Sequence
  Description of Artificial Sequence: Synthetic polypeptide
  VH of XenD22118
QIQLVQSGSELKKPGASVKVSCKASGYTFTQYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41736 - protein, 5 aa, Artificial Sequence
  Description of Artificial Sequence: Synthetic peptide
  XenD22118 vhCDR1
QYGMN

SEQ ID NO: 41737 - protein, 17 aa, Artificial Sequence
  Description of Artificial Sequence: Synthetic peptide
  XenD22118 vhCDR2
WINTYTGEPTYADGFTG

SEQ ID NO: 41738 - protein, 8 aa, Artificial Sequence
  Description of Artificial Sequence: Synthetic peptide
  XenD22118 vhCDR3
DYYGSSPY

SEQ ID NO: 41739 - protein, 446 aa, Artificial Sequence
  Description of Artificial Sequence: Synthetic polypeptide
  XenD22119 1C11_H3.264_IgG1_PVA_/S267K
QIQLVQSGSELKKPGASVKVSCKASGYTFTDYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41740 - protein, 117 aa, Artificial Sequence
  Description of Artificial Sequence: Synthetic polypeptide
  VH of XenD22119
QIQLVQSGSELKKPGASVKVSCKASGYTFTDYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41741 - protein, 5 aa, Artificial Sequence
  Description of Artificial Sequence: Synthetic peptide
  XenD22119 vhCDR1
DYGMN

SEQ ID NO: 41742 - protein, 17 aa, Artificial Sequence
  Description of Artificial Sequence: Synthetic peptide
  XenD22119 vhCDR2
WINTYTGEPTYADGFTG

SEQ ID NO: 41743 - protein, 8 aa, Artificial Sequence
  Description of Artificial Sequence: Synthetic peptide
  XenD22119 vhCDR3
DYYGSSPY

SEQ ID NO: 41744 - protein, 446 aa, Artificial Sequence
  Description of Artificial Sequence: Synthetic polypeptide
  XenD22120 1C11_H3.265_IgG1_PVA_/S267K
QIQLVQSGSELKKPGASVKVSCKASGYTFTRYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41745 - protein, 117 aa, Artificial Sequence
  Description of Artificial Sequence: Synthetic polypeptide
  VH of XenD22120
QIQLVQSGSELKKPGASVKVSCKASGYTFTRYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41746 - protein, 5 aa, Artificial Sequence
  Description of Artificial Sequence: Synthetic peptide
  XenD22120 vhCDR1
RYGMN

SEQ ID NO: 41747 - protein, 17 aa, Artificial Sequence
  Description of Artificial Sequence: Synthetic peptide
  XenD22120 vhCDR2
WINTYTGEPTYADGFTG

SEQ ID NO: 41748 - protein, 8 aa, Artificial Sequence
  Description of Artificial Sequence: Synthetic peptide
  XenD22120 vhCDR3
DYYGSSPY

SEQ ID NO: 41749 - protein, 446 aa, Artificial Sequence
  Description of Artificial Sequence: Synthetic polypeptide
  XenD22121 1C11_H3.266_IgG1_PVA_/S267K
QIQLVQSGSELKKPGASVKVSCKASGYTFTFYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41750 - protein, 117 aa, Artificial Sequence
  Description of Artificial Sequence: Synthetic polypeptide
  VH of XenD22121
QIQLVQSGSELKKPGASVKVSCKASGYTFTFYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41751 - protein, 5 aa, Artificial Sequence
  Description of Artificial Sequence: Synthetic peptide
  XenD22121 vhCDR1
FYGMN

SEQ ID NO: 41752 - protein, 17 aa, Artificial Sequence
  Description of Artificial Sequence: Synthetic peptide
  XenD22121 vhCDR2
WINTYTGEPTYADGFTG

SEQ ID NO: 41753 - protein, 8 aa, Artificial Sequence
  Description of Artificial Sequence: Synthetic peptide
  XenD22121 vhCDR3
DYYGSSPY

SEQ ID NO: 41754 - protein, 446 aa, Artificial Sequence
  Description of Artificial Sequence: Synthetic polypeptide
  XenD22122 1C11_H3.267_IgG1_PVA_/S267K
QIQLVQSGSELKKPGASVKVSCKASGYTFTHFGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41755 - protein, 117 aa, Artificial Sequence
  Description of Artificial Sequence: Synthetic polypeptide
  VH of XenD22122
QIQLVQSGSELKKPGASVKVSCKASGYTFTHFGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41756 - protein, 5 aa, Artificial Sequence
  Description of Artificial Sequence: Synthetic peptide
  XenD22122 vhCDR1
HFGMN

SEQ ID NO: 41757 - protein, 17 aa, Artificial Sequence
  Description of Artificial Sequence: Synthetic peptide
  XenD22122 vhCDR2
WINTYTGEPTYADGFTG

SEQ ID NO: 41758 - protein, 8 aa, Artificial Sequence
  Description of Artificial Sequence: Synthetic peptide
  XenD22122 vhCDR3
DYYGSSPY

SEQ ID NO: 41759 - protein, 446 aa, Artificial Sequence
  Description of Artificial Sequence: Synthetic polypeptide
  XenD22123 1C11_H3.268_IgG1_PVA_/S267K
QIQLVQSGSELKKPGASVKVSCKASGYTFTHHGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41760 - protein, 117 aa, Artificial Sequence
  Description of Artificial Sequence: Synthetic polypeptide
  VH of XenD22123
QIQLVQSGSELKKPGASVKVSCKASGYTFTHHGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41761 - protein, 5 aa, Artificial Sequence
  Description of Artificial Sequence: Synthetic peptide
  XenD22123 vhCDR1
HHGMN

SEQ ID NO: 41762 - protein, 17 aa, Artificial Sequence
  Description of Artificial Sequence: Synthetic peptide
  XenD22123 vhCDR2
WINTYTGEPTYADGFTG

SEQ ID NO: 41763 - protein, 8 aa, Artificial Sequence
  Description of Artificial Sequence: Synthetic peptide
  XenD22123 vhCDR3
DYYGSSPY

SEQ ID NO: 41764 - protein, 446 aa, Artificial Sequence
  Description of Artificial Sequence: Synthetic polypeptide
  XenD22124 1C11_H3.269_IgG1_PVA_/S267K
QIQLVQSGSELKKPGASVKVSCKASGYTFTHLGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41765 - protein, 117 aa, Artificial Sequence
  Description of Artificial Sequence: Synthetic polypeptide
  VH of XenD22124
QIQLVQSGSELKKPGASVKVSCKASGYTFTHLGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41766 - protein, 5 aa, Artificial Sequence
  Description of Artificial Sequence: Synthetic peptide
  XenD22124 vhCDR1
HLGMN

SEQ ID NO: 41767 - protein, 17 aa, Artificial Sequence
  Description of Artificial Sequence: Synthetic peptide
  XenD22124 vhCDR2
WINTYTGEPTYADGFTG

SEQ ID NO: 41768 - protein, 8 aa, Artificial Sequence
  Description of Artificial Sequence: Synthetic peptide
  XenD22124 vhCDR3
DYYGSSPY

SEQ ID NO: 41769 - protein, 446 aa, Artificial Sequence
  Description of Artificial Sequence: Synthetic polypeptide
  XenD22125 1C11_H3.270_IgG1_PVA_/S267K
QIQLVQSGSELKKPGASVKVSCKASGYTFTHWGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41770 - protein, 117 aa, Artificial Sequence
  Description of Artificial Sequence: Synthetic polypeptide
  VH of XenD22125
QIQLVQSGSELKKPGASVKVSCKASGYTFTHWGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41771 - protein, 5 aa, Artificial Sequence
  Description of Artificial Sequence: Synthetic peptide
  XenD22125 vhCDR1
HWGMN

SEQ ID NO: 41772 - protein, 17 aa, Artificial Sequence
  Description of Artificial Sequence: Synthetic peptide
  XenD22125 vhCDR2
WINTYTGEPTYADGFTG

SEQ ID NO: 41773 - protein, 8 aa, Artificial Sequence
  Description of Artificial Sequence: Synthetic peptide
  XenD22125 vhCDR3
DYYGSSPY

SEQ ID NO: 41774 - protein, 446 aa, Artificial Sequence
  Description of Artificial Sequence: Synthetic polypeptide
  XenD22126 1C11_H3.271_IgG1_PVA_/S267K
QIQLVQSGSELKKPGASVKVSCKASGYTFTHYTMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41775 - protein, 117 aa, Artificial Sequence
  Description of Artificial Sequence: Synthetic polypeptide
  VH of XenD22126
QIQLVQSGSELKKPGASVKVSCKASGYTFTHYTMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41776 - protein, 5 aa, Artificial Sequence
  Description of Artificial Sequence: Synthetic peptide
  XenD22126 vhCDR1
HYTMN

SEQ ID NO: 41777 - protein, 17 aa, Artificial Sequence
  Description of Artificial Sequence: Synthetic peptide
  XenD22126 vhCDR2
WINTYTGEPTYADGFTG

SEQ ID NO: 41778 - protein, 8 aa, Artificial Sequence
  Description of Artificial Sequence: Synthetic peptide
  XenD22126 vhCDR3
DYYGSSPY

SEQ ID NO: 41779 - protein, 446 aa, Artificial Sequence
  Description of Artificial Sequence: Synthetic polypeptide
  XenD22127 1C11_H3.272_IgG1_PVA_/S267K
QIQLVQSGSELKKPGASVKVSCKASGYTFTHYQMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41780 - protein, 117 aa, Artificial Sequence
  Description of Artificial Sequence: Synthetic polypeptide
  VH of XenD22127
QIQLVQSGSELKKPGASVKVSCKASGYTFTHYQMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41781 - protein, 5 aa, Artificial Sequence
  Description of Artificial Sequence: Synthetic peptide
  XenD22127 vhCDR1
HYQMN

SEQ ID NO: 41782 - protein, 17 aa, Artificial Sequence
  Description of Artificial Sequence: Synthetic peptide
  XenD22127 vhCDR2
WINTYTGEPTYADGFTG

SEQ ID NO: 41783 - protein, 8 aa, Artificial Sequence
  Description of Artificial Sequence: Synthetic peptide
  XenD22127 vhCDR3
DYYGSSPY

SEQ ID NO: 41784 - protein, 446 aa, Artificial Sequence
  Description of Artificial Sequence: Synthetic polypeptide
  XenD22128 1C11_H3.273_IgG1_PVA_/S267K
QIQLVQSGSELKKPGASVKVSCKASGYTFTHYGLNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41785 - protein, 117 aa, Artificial Sequence
  Description of Artificial Sequence: Synthetic polypeptide
  VH of XenD22128
QIQLVQSGSELKKPGASVKVSCKASGYTFTHYGLNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 41786 - protein, 5 aa, Artificial Sequence
  Description of Artificial Sequence: Synthetic peptide
  XenD22128 vhCDR1
HYGLN

SEQ ID NO: 41787 - protein, 17 aa, Artificial Sequence
  Description of Artificial Sequence: Synthetic peptide
  XenD22128 vhCDR2
WINTYTGEPTYADGFTG

SEQ ID NO: 41788 - protein, 8 aa, Artificial Sequence
  Description of Artificial Sequence: Synthetic peptide
  XenD22128 vhCDR3
DYYGSSPY

SEQ ID NO: 41789 - protein, 446 aa, Artificial Sequence
  Description of Artificial Sequence: Synthetic polypeptide
  XenD22129 1C11_H3.274_IgG1_PVA_/S267K
QIQLVQSGSELKKPGASVKVSCKASGYTFTHYGMNWLRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41790 - protein, 117 aa, Artificial Sequence
  Description of Artificial Sequence: Synthetic polypeptide
  VH of XenD22129
QIQLVQSGSELKKPGASVKVSCKASGYTFTHYGMNWLRQAPGQGLEWMGWINTYTGEPTYADGFTGRFVFSLDTSVSTAYLQISSLKAEDTAVYFCARDYYGSSPYWGQGTLVTVSS

SEQ ID NO: 41791 - protein, 5 aa, Artificial Sequence
  Description of Artificial Sequence: Synthetic peptide
  XenD22129 vhCDR1
HYGMN

SEQ ID NO: 41792 - protein, 17 aa, Artificial Sequence
  Description of Artificial Sequence: Synthetic peptide
  XenD22129 vhCDR2
WINTYTGEPTYADGFTG

SEQ ID NO: 41793 - protein, 8 aa, Artificial Sequence
  Description of Artificial Sequence: Synthetic peptide
  XenD22129 vhCDR3
DYYGSSPY

SEQ ID NO: 41794 - protein, 446 aa, Artificial Sequence
  Description of Artificial Sequence: Synthetic polypeptide
  XenD22130 1C11_H3.275_IgG1_PVA_/S267K
QIQLVQSGSELKKPGASVKVSCKASGYTFTHYGMNWTRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41795 - protein, 117 aa, Artificial Sequence
  Description of Artificial Sequence: Synthetic polypeptide
  VH of XenD22130
QIQLVQSGSELKKPGASVKVSCKASGYTFTHYGMNWTRQAPGQGLEWMGWINTYTGEPTYADGFTGRFVFSLDTSVSTAYLQISSLKAEDTAVYFCARDYYGSSPYWGQGTLVTVSS

SEQ ID NO: 41796 - protein, 5 aa, Artificial Sequence
  Description of Artificial Sequence: Synthetic peptide
  XenD22130 vhCDR1
HYGMN

SEQ ID NO: 41797 - protein, 17 aa, Artificial Sequence
  Description of Artificial Sequence: Synthetic peptide
  XenD22130 vhCDR2
WINTYTGEPTYADGFTG

SEQ ID NO: 41798 - protein, 8 aa, Artificial Sequence
  Description of Artificial Sequence: Synthetic peptide
  XenD22130 vhCDR3
DYYGSSPY

SEQ ID NO: 41799 - protein, 446 aa, Artificial Sequence
  Description of Artificial Sequence: Synthetic polypeptide
  XenD22131 1C11_H3.276_IgG1_PVA_/S267K
QIQLVQSGSELKKPGASVKVSCKASGYTFTHYGMNWFRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41800 - protein, 117 aa, Artificial Sequence
  Description of Artificial Sequence: Synthetic polypeptide
  VH of XenD22131
QIQLVQSGSELKKPGASVKVSCKASGYTFTHYGMNWFRQAPGQGLEWMGWINTYTGEPTYADGFTGRFVFSLDTSVSTAYLQISSLKAEDTAVYFCARDYYGSSPYWGQGTLVTVSS

SEQ ID NO: 41801 - protein, 5 aa, Artificial Sequence
  Description of Artificial Sequence: Synthetic peptide
  XenD22131 vhCDR1
HYGMN

SEQ ID NO: 41802 - protein, 17 aa, Artificial Sequence
  Description of Artificial Sequence: Synthetic peptide
  XenD22131 vhCDR2
WINTYTGEPTYADGFTG

SEQ ID NO: 41803 - protein, 8 aa, Artificial Sequence
  Description of Artificial Sequence: Synthetic peptide
  XenD22131 vhCDR3
DYYGSSPY

SEQ ID NO: 41804 - protein, 446 aa, Artificial Sequence
  Description of Artificial Sequence: Synthetic polypeptide
  XenD22132 1C11_H3.277_IgG1_PVA_/S267K
QIQLVQSGSELKKPGASVKVSCKASGYTFTHYGMNWVRQAPGQGLEWMTWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41805 - protein, 117 aa, Artificial Sequence
  Description of Artificial Sequence: Synthetic polypeptide
  VH of XenD22132
QIQLVQSGSELKKPGASVKVSCKASGYTFTHYGMNWVRQAPGQGLEWMTWINTYTGEPTYADGFTGRFVFSLDTSVSTAYLQISSLKAEDTAVYFCARDYYGSSPYWGQGTLVTVSS

SEQ ID NO: 41806 - protein, 5 aa, Artificial Sequence
  Description of Artificial Sequence: Synthetic peptide
  XenD22132 vhCDR1
HYGMN

SEQ ID NO: 41807 - protein, 17 aa, Artificial Sequence
  Description of Artificial Sequence: Synthetic peptide
  XenD22132 vhCDR2
WINTYTGEPTYADGFTG

SEQ ID NO: 41808 - protein, 8 aa, Artificial Sequence
  Description of Artificial Sequence: Synthetic peptide
  XenD22132 vhCDR3
DYYGSSPY

SEQ ID NO: 41809 - protein, 446 aa, Artificial Sequence
  Description of Artificial Sequence: Synthetic polypeptide
  XenD22133 1C11_H3.278_IgG1_PVA_/S267K
QIQLVQSGSELKKPGASVKVSCKASGYTFTHYGMNWVRQAPGQGLEWMDWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41810 - protein, 117 aa, Artificial Sequence
  Description of Artificial Sequence: Synthetic polypeptide
  VH of XenD22133
QIQLVQSGSELKKPGASVKVSCKASGYTFTHYGMNWVRQAPGQGLEWMDWINTYTGEPTYADGFTGRFVFSLDTSVSTAYLQISSLKAEDTAVYFCARDYYGSSPYWGQGTLVTVSS

SEQ ID NO: 41811 - protein, 5 aa, Artificial Sequence
  Description of Artificial Sequence: Synthetic peptide
  XenD22133 vhCDR1
HYGMN

SEQ ID NO: 41812 - protein, 17 aa, Artificial Sequence
  Description of Artificial Sequence: Synthetic peptide
  XenD22133 vhCDR2
WINTYTGEPTYADGFTG

SEQ ID NO: 41813 - protein, 8 aa, Artificial Sequence
  Description of Artificial Sequence: Synthetic peptide
  XenD22133 vhCDR3
DYYGSSPY

SEQ ID NO: 41814 - protein, 446 aa, Artificial Sequence
  Description of Artificial Sequence: Synthetic polypeptide
  XenD22134 1C11_H3.279_IgG1_PVA_/S267K
QIQLVQSGSELKKPGASVKVSCKASGYTFTHYGMNWVRQAPGQGLEWMQWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41815 - protein, 117 aa, Artificial Sequence
  Description of Artificial Sequence: Synthetic polypeptide
  VH of XenD22134
QIQLVQSGSELKKPGASVKVSCKASGYTFTHYGMNWVRQAPGQGLEWMQWINTYTGEPTYADGFTGRFVFSLDTSVSTAYLQISSLKAEDTAVYFCARDYYGSSPYWGQGTLVTVSS

SEQ ID NO: 41816 - protein, 5 aa, Artificial Sequence
  Description of Artificial Sequence: Synthetic peptide
  XenD22134 vhCDR1
HYGMN

SEQ ID NO: 41817 - protein, 17 aa, Artificial Sequence
  Description of Artificial Sequence: Synthetic peptide
  XenD22134 vhCDR2
WINTYTGEPTYADGFTG

SEQ ID NO: 41818 - protein, 8 aa, Artificial Sequence
  Description of Artificial Sequence: Synthetic peptide
  XenD22134 vhCDR3
DYYGSSPY

SEQ ID NO: 41819 - protein, 446 aa, Artificial Sequence
  Description of Artificial Sequence: Synthetic polypeptide
  XenD22135 1C11_H3.280_IgG1_PVA_/S267K
QIQLVQSGSELKKPGASVKVSCKASGYTFTHYGMNWVRQAPGQGLEWMEWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41820 - protein, 117 aa, Artificial Sequence
  Description of Artificial Sequence: Synthetic polypeptide
  VH of XenD22135
QIQLVQSGSELKKPGASVKVSCKASGYTFTHYGMNWVRQAPGQGLEWMEWINTYTGEPTYADGFTGRFVFSLDTSVSTAYLQISSLKAEDTAVYFCARDYYGSSPYWGQGTLVTVSS

SEQ ID NO: 41821 - protein, 5 aa, Artificial Sequence
  Description of Artificial Sequence: Synthetic peptide
  XenD22135 vhCDR1
HYGMN

SEQ ID NO: 41822 - protein, 17 aa, Artificial Sequence
  Description of Artificial Sequence: Synthetic peptide
  XenD22135 vhCDR2
WINTYTGEPTYADGFTG

SEQ ID NO: 41823 - protein, 8 aa, Artificial Sequence
  Description of Artificial Sequence: Synthetic peptide
  XenD22135 vhCDR3
DYYGSSPY

SEQ ID NO: 41824 - protein, 446 aa, Artificial Sequence
  Description of Artificial Sequence: Synthetic polypeptide
  XenD22136 1C11_H3.281_IgG1_PVA_/S267K
QIQLVQSGSELKKPGASVKVSCKASGYTFTHYGMNWVRQAPGQGLEWMGFINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41825 - protein, 117 aa, Artificial Sequence
  Description of Artificial Sequence: Synthetic polypeptide
  VH of XenD22136
QIQLVQSGSELKKPGASVKVSCKASGYTFTHYGMNWVRQAPGQGLEWMGFINTYTGEPTYADGFTGRFVFSLDTSVSTAYLQISSLKAEDTAVYFCARDYYGSSPYWGQGTLVTVSS

SEQ ID NO: 41826 - protein, 5 aa, Artificial Sequence
  Description of Artificial Sequence: Synthetic peptide
  XenD22136 vhCDR1
HYGMN

SEQ ID NO: 41827 - protein, 17 aa, Artificial Sequence
  Description of Artificial Sequence: Synthetic peptide
  XenD22136 vhCDR2
FINTYTGEPTYADGFTG

SEQ ID NO: 41828 - protein, 8 aa, Artificial Sequence
  Description of Artificial Sequence: Synthetic peptide
  XenD22136 vhCDR3
DYYGSSPY

SEQ ID NO: 41829 - protein, 446 aa, Artificial Sequence
  Description of Artificial Sequence: Synthetic polypeptide
  XenD22137 1C11_H3.282_IgG1_PVA_/S267K
QIQLVQSGSELKKPGASVKVSCKASGYTFTHYGMNWVRQAPGQGLEWMGHINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41830 - protein, 117 aa, Artificial Sequence
  Description of Artificial Sequence: Synthetic polypeptide
  VH of XenD22137
QIQLVQSGSELKKPGASVKVSCKASGYTFTHYGMNWVRQAPGQGLEWMGHINTYTGEPTYADGFTGRFVFSLDTSVSTAYLQISSLKAEDTAVYFCARDYYGSSPYWGQGTLVTVSS

SEQ ID NO: 41831 - protein, 5 aa, Artificial Sequence
  Description of Artificial Sequence: Synthetic peptide
  XenD22137 vhCDR1
HYGMN

SEQ ID NO: 41832 - protein, 17 aa, Artificial Sequence
  Description of Artificial Sequence: Synthetic peptide
  XenD22137 vhCDR2
HINTYTGEPTYADGFTG

SEQ ID NO: 41833 - protein, 8 aa, Artificial Sequence
  Description of Artificial Sequence: Synthetic peptide
  XenD22137 vhCDR3
DYYGSSPY

SEQ ID NO: 41834 - protein, 446 aa, Artificial Sequence
  Description of Artificial Sequence: Synthetic polypeptide
  XenD22138 1C11_H3.283_IgG1_PVA_/S267K
QIQLVQSGSELKKPGASVKVSCKASGYTFTHYGMNWVRQAPGQGLEWMGWIQTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41835 - protein, 117 aa, Artificial Sequence
  Description of Artificial Sequence: Synthetic polypeptide
  VH of XenD22138
QIQLVQSGSELKKPGASVKVSCKASGYTFTHYGMNWVRQAPGQGLEWMGWIQTYTGEPTYADGFTGRFVFSLDTSVSTAYLQISSLKAEDTAVYFCARDYYGSSPYWGQGTLVTVSS

SEQ ID NO: 41836 - protein, 5 aa, Artificial Sequence
  Description of Artificial Sequence: Synthetic peptide
  XenD22138 vhCDR1
HYGMN

SEQ ID NO: 41837 - protein, 17 aa, Artificial Sequence
  Description of Artificial Sequence: Synthetic peptide
  XenD22138 vhCDR2
WIQTYTGEPTYADGFTG

SEQ ID NO: 41838 - protein, 8 aa, Artificial Sequence
  Description of Artificial Sequence: Synthetic peptide
  XenD22138 vhCDR3
DYYGSSPY

SEQ ID NO: 41839 - protein, 446 aa, Artificial Sequence
  Description of Artificial Sequence: Synthetic polypeptide
  XenD22139 1C11_H3.284_IgG1_PVA_/S267K
QIQLVQSGSELKKPGASVKVSCKASGYTFTHYGMNWVRQAPGQGLEWMGWIETYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41840 - protein, 117 aa, Artificial Sequence
  Description of Artificial Sequence: Synthetic polypeptide
  VH of XenD22139
QIQLVQSGSELKKPGASVKVSCKASGYTFTHYGMNWVRQAPGQGLEWMGWIETYTGEPTYADGFTGRFVFSLDTSVSTAYLQISSLKAEDTAVYFCARDYYGSSPYWGQGTLVTVSS

SEQ ID NO: 41841 - protein, 5 aa, Artificial Sequence
  Description of Artificial Sequence: Synthetic peptide
  XenD22139 vhCDR1
HYGMN

SEQ ID NO: 41842 - protein, 17 aa, Artificial Sequence
  Description of Artificial Sequence: Synthetic peptide
  XenD22139 vhCDR2
WIETYTGEPTYADGFTG

SEQ ID NO: 41843 - protein, 8 aa, Artificial Sequence
  Description of Artificial Sequence: Synthetic peptide
  XenD22139 vhCDR3
DYYGSSPY

SEQ ID NO: 41844 - protein, 446 aa, Artificial Sequence
  Description of Artificial Sequence: Synthetic polypeptide
  XenD22140 1C11_H3.285_IgG1_PVA_/S267K
QIQLVQSGSELKKPGASVKVSCKASGYTFTHYGMNWVRQAPGQGLEWMGWIHTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41845 - protein, 117 aa, Artificial Sequence
  Description of Artificial Sequence: Synthetic polypeptide
  VH of XenD22140
QIQLVQSGSELKKPGASVKVSCKASGYTFTHYGMNWVRQAPGQGLEWMGWIHTYTGEPTYADGFTGRFVFSLDTSVSTAYLQISSLKAEDTAVYFCARDYYGSSPYWGQGTLVTVSS

SEQ ID NO: 41846 - protein, 5 aa, Artificial Sequence
  Description of Artificial Sequence: Synthetic peptide
  XenD22140 vhCDR1
HYGMN

SEQ ID NO: 41847 - protein, 17 aa, Artificial Sequence
  Description of Artificial Sequence: Synthetic peptide
  XenD22140 vhCDR2
WIHTYTGEPTYADGFTG

SEQ ID NO: 41848 - protein, 8 aa, Artificial Sequence
  Description of Artificial Sequence: Synthetic peptide
  XenD22140 vhCDR3
DYYGSSPY

SEQ ID NO: 41849 - protein, 446 aa, Artificial Sequence
  Description of Artificial Sequence: Synthetic polypeptide
  XenD22141 1C11_H3.286_IgG1_PVA_/S267K
QIQLVQSGSELKKPGASVKVSCKASGYTFTHYGMNWVRQAPGQGLEWMGWISTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41850 - protein, 117 aa, Artificial Sequence
  Description of Artificial Sequence: Synthetic polypeptide
  VH of XenD22141
QIQLVQSGSELKKPGASVKVSCKASGYTFTHYGMNWVRQAPGQGLEWMGWISTYTGEPTYADGFTGRFVFSLDTSVSTAYLQISSLKAEDTAVYFCARDYYGSSPYWGQGTLVTVSS

SEQ ID NO: 41851 - protein, 5 aa, Artificial Sequence
  Description of Artificial Sequence: Synthetic peptide
  XenD22141 vhCDR1
HYGMN

SEQ ID NO: 41852 - protein, 17 aa, Artificial Sequence
  Description of Artificial Sequence: Synthetic peptide
  XenD22141 vhCDR2
WISTYTGEPTYADGFTG

SEQ ID NO: 41853 - protein, 8 aa, Artificial Sequence
  Description of Artificial Sequence: Synthetic peptide
  XenD22141 vhCDR3
DYYGSSPY

SEQ ID NO: 41854 - protein, 446 aa, Artificial Sequence
  Description of Artificial Sequence: Synthetic polypeptide
  XenD22142 1C11_H3.287_IgG1_PVA_/S267K
QIQLVQSGSELKKPGASVKVSCKASGYTFTHYGMNWVRQAPGQGLEWMGWINTFTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41855 - protein, 117 aa, Artificial Sequence
  Description of Artificial Sequence: Synthetic polypeptide
  VH of XenD22142
QIQLVQSGSELKKPGASVKVSCKASGYTFTHYGMNWVRQAPGQGLEWMGWINTFTGEPTYADGFTGRFVFSLDTSVSTAYLQISSLKAEDTAVYFCARDYYGSSPYWGQGTLVTVSS

SEQ ID NO: 41856 - protein, 5 aa, Artificial Sequence
  Description of Artificial Sequence: Synthetic peptide
  XenD22142 vhCDR1
HYGMN

SEQ ID NO: 41857 - protein, 17 aa, Artificial Sequence
  Description of Artificial Sequence: Synthetic peptide
  XenD22142 vhCDR2
WINTFTGEPTYADGFTG

SEQ ID NO: 41858 - protein, 8 aa, Artificial Sequence
  Description of Artificial Sequence: Synthetic peptide
  XenD22142 vhCDR3
DYYGSSPY

SEQ ID NO: 41859 - protein, 446 aa, Artificial Sequence
  Description of Artificial Sequence: Synthetic polypeptide
  XenD22143 1C11_H3.288_IgG1_PVA_/S267K
QIQLVQSGSELKKPGASVKVSCKASGYTFTHYGMNWVRQAPGQGLEWMGWINTHTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41860 - protein, 117 aa, Artificial Sequence
  Description of Artificial Sequence: Synthetic polypeptide
  VH of XenD22143
QIQLVQSGSELKKPGASVKVSCKASGYTFTHYGMNWVRQAPGQGLEWMGWINTHTGEPTYADGFTGRFVFSLDTSVSTAYLQISSLKAEDTAVYFCARDYYGSSPYWGQGTLVTVSS

SEQ ID NO: 41861 - protein, 5 aa, Artificial Sequence
  Description of Artificial Sequence: Synthetic peptide
  XenD22143 vhCDR1
HYGMN

SEQ ID NO: 41862 - protein, 17 aa, Artificial Sequence
  Description of Artificial Sequence: Synthetic peptide
  XenD22143 vhCDR2
WINTHTGEPTYADGFTG

SEQ ID NO: 41863 - protein, 8 aa, Artificial Sequence
  Description of Artificial Sequence: Synthetic peptide
  XenD22143 vhCDR3
DYYGSSPY

SEQ ID NO: 41864 - protein, 446 aa, Artificial Sequence
  Description of Artificial Sequence: Synthetic polypeptide
  XenD22144 1C11_H3.289_IgG1_PVA_/S267K
QIQLVQSGSELKKPGASVKVSCKASGYTFTHYGMNWVRQAPGQGLEWMGWINTLTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41865 - protein, 117 aa, Artificial Sequence
  Description of Artificial Sequence: Synthetic polypeptide
  VH of XenD22144
QIQLVQSGSELKKPGASVKVSCKASGYTFTHYGMNWVRQAPGQGLEWMGWINTLTGEPTYADGFTGRFVFSLDTSVSTAYLQISSLKAEDTAVYFCARDYYGSSPYWGQGTLVTVSS

SEQ ID NO: 41866 - protein, 5 aa, Artificial Sequence
  Description of Artificial Sequence: Synthetic peptide
  XenD22144 vhCDR1
HYGMN

SEQ ID NO: 41867 - protein, 17 aa, Artificial Sequence
  Description of Artificial Sequence: Synthetic peptide
  XenD22144 vhCDR2
WINTLTGEPTYADGFTG

SEQ ID NO: 41868 - protein, 8 aa, Artificial Sequence
  Description of Artificial Sequence: Synthetic peptide
  XenD22144 vhCDR3
DYYGSSPY

SEQ ID NO: 41869 - protein, 446 aa, Artificial Sequence
  Description of Artificial Sequence: Synthetic polypeptide
  XenD22145 1C11_H3.290_IgG1_PVA_/S267K
QIQLVQSGSELKKPGASVKVSCKASGYTFTHYGMNWVRQAPGQGLEWMGWINTWTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41870 - protein, 117 aa, Artificial Sequence
  Description of Artificial Sequence: Synthetic polypeptide
  VH of XenD22145
QIQLVQSGSELKKPGASVKVSCKASGYTFTHYGMNWVRQAPGQGLEWMGWINTWTGEPTYADGFTGRFVFSLDTSVSTAYLQISSLKAEDTAVYFCARDYYGSSPYWGQGTLVTVSS

SEQ ID NO: 41871 - protein, 5 aa, Artificial Sequence
  Description of Artificial Sequence: Synthetic peptide
  XenD22145 vhCDR1
HYGMN

SEQ ID NO: 41872 - protein, 17 aa, Artificial Sequence
  Description of Artificial Sequence: Synthetic peptide
  XenD22145 vhCDR2
WINTWTGEPTYADGFTG

SEQ ID NO: 41873 - protein, 8 aa, Artificial Sequence
  Description of Artificial Sequence: Synthetic peptide
  XenD22145 vhCDR3
DYYGSSPY

SEQ ID NO: 41874 - protein, 446 aa, Artificial Sequence
  Description of Artificial Sequence: Synthetic polypeptide
  XenD22146 1C11_H3.291_IgG1_PVA_/S267K
QIQLVQSGSELKKPGASVKVSCKASGYTFTHYGMNWVRQAPGQGLEWMGWINTYVGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41875 - protein, 117 aa, Artificial Sequence
  Description of Artificial Sequence: Synthetic polypeptide
  VH of XenD22146
QIQLVQSGSELKKPGASVKVSCKASGYTFTHYGMNWVRQAPGQGLEWMGWINTYVGEPTYADGFTGRFVFSLDTSVSTAYLQISSLKAEDTAVYFCARDYYGSSPYWGQGTLVTVSS

SEQ ID NO: 41876 - protein, 5 aa, Artificial Sequence
  Description of Artificial Sequence: Synthetic peptide
  XenD22146 vhCDR1
HYGMN

SEQ ID NO: 41877 - protein, 17 aa, Artificial Sequence
  Description of Artificial Sequence: Synthetic peptide
  XenD22146 vhCDR2
WINTYVGEPTYADGFTG

SEQ ID NO: 41878 - protein, 8 aa, Artificial Sequence
  Description of Artificial Sequence: Synthetic peptide
  XenD22146 vhCDR3
DYYGSSPY

SEQ ID NO: 41879 - protein, 446 aa, Artificial Sequence
  Description of Artificial Sequence: Synthetic polypeptide
  XenD22147 1C11_H3.292_IgG1_PVA_/S267K
QIQLVQSGSELKKPGASVKVSCKASGYTFTHYGMNWVRQAPGQGLEWMGWINTYSGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41880 - protein, 117 aa, Artificial Sequence
  Description of Artificial Sequence: Synthetic polypeptide
  VH of XenD22147
QIQLVQSGSELKKPGASVKVSCKASGYTFTHYGMNWVRQAPGQGLEWMGWINTYSGEPTYADGFTGRFVFSLDTSVSTAYLQISSLKAEDTAVYFCARDYYGSSPYWGQGTLVTVSS

SEQ ID NO: 41881 - protein, 5 aa, Artificial Sequence
  Description of Artificial Sequence: Synthetic peptide
  XenD22147 vhCDR1
HYGMN

SEQ ID NO: 41882 - protein, 17 aa, Artificial Sequence
  Description of Artificial Sequence: Synthetic peptide
  XenD22147 vhCDR2
WINTYSGEPTYADGFTG

SEQ ID NO: 41883 - protein, 8 aa, Artificial Sequence
  Description of Artificial Sequence: Synthetic peptide
  XenD22147 vhCDR3
DYYGSSPY

SEQ ID NO: 41884 - protein, 446 aa, Artificial Sequence
  Description of Artificial Sequence: Synthetic polypeptide
  XenD22148 1C11_H3.293_IgG1_PVA_/S267K
QIQLVQSGSELKKPGASVKVSCKASGYTFTHYGMNWVRQAPGQGLEWMGWINTYAGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41885 - protein, 117 aa, Artificial Sequence
  Description of Artificial Sequence: Synthetic polypeptide
  VH of XenD22148
QIQLVQSGSELKKPGASVKVSCKASGYTFTHYGMNWVRQAPGQGLEWMGWINTYAGEPTYADGFTGRFVFSLDTSVSTAYLQISSLKAEDTAVYFCARDYYGSSPYWGQGTLVTVSS

SEQ ID NO: 41886 - protein, 5 aa, Artificial Sequence
  Description of Artificial Sequence: Synthetic peptide
  XenD22148 vhCDR1
HYGMN

SEQ ID NO: 41887 - protein, 17 aa, Artificial Sequence
  Description of Artificial Sequence: Synthetic peptide
  XenD22148 vhCDR2
WINTYAGEPTYADGFTG

SEQ ID NO: 41888 - protein, 8 aa, Artificial Sequence
  Description of Artificial Sequence: Synthetic peptide
  XenD22148 vhCDR3
DYYGSSPY

SEQ ID NO: 41889 - protein, 446 aa, Artificial Sequence
  Description of Artificial Sequence: Synthetic polypeptide
  XenD22149 1C11_H3.294_IgG1_PVA_/S267K
QIQLVQSGSELKKPGASVKVSCKASGYTFTHYGMNWVRQAPGQGLEWMGWINTYIGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41890 - protein, 117 aa, Artificial Sequence
  Description of Artificial Sequence: Synthetic polypeptide
  VH of XenD22149
QIQLVQSGSELKKPGASVKVSCKASGYTFTHYGMNWVRQAPGQGLEWMGWINTYIGEPTYADGFTGRFVFSLDTSVSTAYLQISSLKAEDTAVYFCARDYYGSSPYWGQGTLVTVSS

SEQ ID NO: 41891 - protein, 5 aa, Artificial Sequence
  Description of Artificial Sequence: Synthetic peptide
  XenD22149 vhCDR1
HYGMN

SEQ ID NO: 41892 - protein, 17 aa, Artificial Sequence
  Description of Artificial Sequence: Synthetic peptide
  XenD22149 vhCDR2
WINTYIGEPTYADGFTG

SEQ ID NO: 41893 - protein, 8 aa, Artificial Sequence
  Description of Artificial Sequence: Synthetic peptide
  XenD22149 vhCDR3
DYYGSSPY

SEQ ID NO: 41894 - protein, 446 aa, Artificial Sequence
  Description of Artificial Sequence: Synthetic polypeptide
  XenD22150 1C11_H3.295_IgG1_PVA_/S267K
QIQLVQSGSELKKPGASVKVSCKASGYTFTHYGMNWVRQAPGQGLEWMGWINTYTGQPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41895 - protein, 117 aa, Artificial Sequence
  Description of Artificial Sequence: Synthetic polypeptide
  VH of XenD22150
QIQLVQSGSELKKPGASVKVSCKASGYTFTHYGMNWVRQAPGQGLEWMGWINTYTGQPTYADGFTGRFVFSLDTSVSTAYLQISSLKAEDTAVYFCARDYYGSSPYWGQGTLVTVSS

SEQ ID NO: 41896 - protein, 5 aa, Artificial Sequence
  Description of Artificial Sequence: Synthetic peptide
  XenD22150 vhCDR1
HYGMN

SEQ ID NO: 41897 - protein, 17 aa, Artificial Sequence
  Description of Artificial Sequence: Synthetic peptide
  XenD22150 vhCDR2
WINTYTGQPTYADGFTG

SEQ ID NO: 41898 - protein, 8 aa, Artificial Sequence
  Description of Artificial Sequence: Synthetic peptide
  XenD22150 vhCDR3
DYYGSSPY

SEQ ID NO: 41899 - protein, 446 aa, Artificial Sequence
  Description of Artificial Sequence: Synthetic polypeptide
  XenD22151 1C11_H3.296_IgG1_PVA_/S267K
QIQLVQSGSELKKPGASVKVSCKASGYTFTHYGMNWVRQAPGQGLEWMGWINTYTGKPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41900 - protein, 117 aa, Artificial Sequence
  Description of Artificial Sequence: Synthetic polypeptide
  VH of XenD22151
QIQLVQSGSELKKPGASVKVSCKASGYTFTHYGMNWVRQAPGQGLEWMGWINTYTGKPTYADGFTGRFVFSLDTSVSTAYLQISSLKAEDTAVYFCARDYYGSSPYWGQGTLVTVSS

SEQ ID NO: 41901 - protein, 5 aa, Artificial Sequence
  Description of Artificial Sequence: Synthetic peptide
  XenD22151 vhCDR1
HYGMN

SEQ ID NO: 41902 - protein, 17 aa, Artificial Sequence
  Description of Artificial Sequence: Synthetic peptide
  XenD22151 vhCDR2
WINTYTGKPTYADGFTG

SEQ ID NO: 41903 - protein, 8 aa, Artificial Sequence
  Description of Artificial Sequence: Synthetic peptide
  XenD22151 vhCDR3
DYYGSSPY

SEQ ID NO: 41904 - protein, 446 aa, Artificial Sequence
  Description of Artificial Sequence: Synthetic polypeptide
  XenD22152 1C11_H3.297_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDFYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41905 - protein, 117 aa, Artificial Sequence
  Description of Artificial Sequence: Synthetic polypeptide
  VH of XenD22152
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDFYGSSPYWGQGTLVTVSS

SEQ ID NO: 41906 - protein, 5 aa, Artificial Sequence
  Description of Artificial Sequence: Synthetic peptide
  XenD22152 vhCDR1
HYGMN

SEQ ID NO: 41907 - protein, 17 aa, Artificial Sequence
  Description of Artificial Sequence: Synthetic peptide
  XenD22152 vhCDR2
WINTYTGEPTYADGFTG

SEQ ID NO: 41908 - protein, 8 aa, Artificial Sequence
  Description of Artificial Sequence: Synthetic peptide
  XenD22152 vhCDR3
DFYGSSPY

SEQ ID NO: 41909 - protein, 446 aa, Artificial Sequence
  Description of Artificial Sequence: Synthetic polypeptide
  XenD22153 1C11_H3.298_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDQYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41910 - protein, 117 aa, Artificial Sequence
  Description of Artificial Sequence: Synthetic polypeptide
  VH of XenD22153
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDQYGSSPYWGQGTLVTVSS

SEQ ID NO: 41911 - protein, 5 aa, Artificial Sequence
  Description of Artificial Sequence: Synthetic peptide
  XenD22153 vhCDR1
HYGMN

SEQ ID NO: 41912 - protein, 17 aa, Artificial Sequence
  Description of Artificial Sequence: Synthetic peptide
  XenD22153 vhCDR2
WINTYTGEPTYADGFTG

SEQ ID NO: 41913 - protein, 8 aa, Artificial Sequence
  Description of Artificial Sequence: Synthetic peptide
  XenD22153 vhCDR3
DQYGSSPY

SEQ ID NO: 41914 - protein, 446 aa, Artificial Sequence
  Description of Artificial Sequence: Synthetic polypeptide
  XenD22154 1C11_H3.299_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDHYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41915 - protein, 117 aa, Artificial Sequence
  Description of Artificial Sequence: Synthetic polypeptide
  VH of XenD22154
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDHYGSSPYWGQGTLVTVSS

SEQ ID NO: 41916 - protein, 5 aa, Artificial Sequence
  Description of Artificial Sequence: Synthetic peptide
  XenD22154 vhCDR1
HYGMN

SEQ ID NO: 41917 - protein, 17 aa, Artificial Sequence
  Description of Artificial Sequence: Synthetic peptide
  XenD22154 vhCDR2
WINTYTGEPTYADGFTG

SEQ ID NO: 41918 - protein, 8 aa, Artificial Sequence
  Description of Artificial Sequence: Synthetic peptide
  XenD22154 vhCDR3
DHYGSSPY

SEQ ID NO: 41919 - protein, 446 aa, Artificial Sequence
  Description of Artificial Sequence: Synthetic polypeptide
  XenD22155 1C11_H3.300_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDRYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41920 - protein, 117 aa, Artificial Sequence
  Description of Artificial Sequence: Synthetic polypeptide
  VH of XenD22155
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDRYGSSPYWGQGTLVTVSS

SEQ ID NO: 41921 - protein, 5 aa, Artificial Sequence
  Description of Artificial Sequence: Synthetic peptide
  XenD22155 vhCDR1
HYGMN

SEQ ID NO: 41922 - protein, 17 aa, Artificial Sequence
  Description of Artificial Sequence: Synthetic peptide
  XenD22155 vhCDR2
WINTYTGEPTYADGFTG

SEQ ID NO: 41923 - protein, 8 aa, Artificial Sequence
  Description of Artificial Sequence: Synthetic peptide
  XenD22155 vhCDR3
DRYGSSPY

SEQ ID NO: 41924 - protein, 446 aa, Artificial Sequence
  Description of Artificial Sequence: Synthetic polypeptide
  XenD22156 1C11_H3.301_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDKYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41925 - protein, 117 aa, Artificial Sequence
  Description of Artificial Sequence: Synthetic polypeptide
  VH of XenD22156
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDKYGSSPYWGQGTLVTVSS

SEQ ID NO: 41926 - protein, 5 aa, Artificial Sequence
  Description of Artificial Sequence: Synthetic peptide
  XenD22156 vhCDR1
HYGMN

SEQ ID NO: 41927 - protein, 17 aa, Artificial Sequence
  Description of Artificial Sequence: Synthetic peptide
  XenD22156 vhCDR2
WINTYTGEPTYADGFTG

SEQ ID NO: 41928 - protein, 8 aa, Artificial Sequence
  Description of Artificial Sequence: Synthetic peptide
  XenD22156 vhCDR3
DKYGSSPY

SEQ ID NO: 41929 - protein, 446 aa, Artificial Sequence
  Description of Artificial Sequence: Synthetic polypeptide
  XenD22157 1C11_H3.302_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYWGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41930 - protein, 117 aa, Artificial Sequence
  Description of Artificial Sequence: Synthetic polypeptide
  VH of XenD22157
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYWGSSPYWGQGTLVTVSS

SEQ ID NO: 41931 - protein, 5 aa, Artificial Sequence
  Description of Artificial Sequence: Synthetic peptide
  XenD22157 vhCDR1
HYGMN

SEQ ID NO: 41932 - protein, 17 aa, Artificial Sequence
  Description of Artificial Sequence: Synthetic peptide
  XenD22157 vhCDR2
WINTYTGEPTYADGFTG

SEQ ID NO: 41933 - protein, 8 aa, Artificial Sequence
  Description of Artificial Sequence: Synthetic peptide
  XenD22157 vhCDR3
DYWGSSPY

SEQ ID NO: 41934 - protein, 446 aa, Artificial Sequence
  Description of Artificial Sequence: Synthetic polypeptide
  XenD22158 1C11_H3.303_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41935 - protein, 117 aa, Artificial Sequence
  Description of Artificial Sequence: Synthetic polypeptide
  VH of XenD22158
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSS

SEQ ID NO: 41936 - protein, 5 aa, Artificial Sequence
  Description of Artificial Sequence: Synthetic peptide
  XenD22158 vhCDR1
HYGMN

SEQ ID NO: 41937 - protein, 17 aa, Artificial Sequence
  Description of Artificial Sequence: Synthetic peptide
  XenD22158 vhCDR2
WINTYTGEPTYADGFTG

SEQ ID NO: 41938 - protein, 8 aa, Artificial Sequence
  Description of Artificial Sequence: Synthetic peptide
  XenD22158 vhCDR3
DYFGSSPY

SEQ ID NO: 41939 - protein, 446 aa, Artificial Sequence
  Description of Artificial Sequence: Synthetic polypeptide
  XenD22159 1C11_H3.304_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYASSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41940 - protein, 117 aa, Artificial Sequence
  Description of Artificial Sequence: Synthetic polypeptide
  VH of XenD22159
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYASSPYWGQGTLVTVSS

SEQ ID NO: 41941 - protein, 5 aa, Artificial Sequence
  Description of Artificial Sequence: Synthetic peptide
  XenD22159 vhCDR1
HYGMN

SEQ ID NO: 41942 - protein, 17 aa, Artificial Sequence
  Description of Artificial Sequence: Synthetic peptide
  XenD22159 vhCDR2
WINTYTGEPTYADGFTG

SEQ ID NO: 41943 - protein, 8 aa, Artificial Sequence
  Description of Artificial Sequence: Synthetic peptide
  XenD22159 vhCDR3
DYYASSPY

SEQ ID NO: 41944 - protein, 446 aa, Artificial Sequence
  Description of Artificial Sequence: Synthetic polypeptide
  XenD22160 1C11_H3.305_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYSSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41945 - protein, 117 aa, Artificial Sequence
  Description of Artificial Sequence: Synthetic polypeptide
  VH of XenD22160
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYSSSPYWGQGTLVTVSS

SEQ ID NO: 41946 - protein, 5 aa, Artificial Sequence
  Description of Artificial Sequence: Synthetic peptide
  XenD22160 vhCDR1
HYGMN

SEQ ID NO: 41947 - protein, 17 aa, Artificial Sequence
  Description of Artificial Sequence: Synthetic peptide
  XenD22160 vhCDR2
WINTYTGEPTYADGFTG

SEQ ID NO: 41948 - protein, 8 aa, Artificial Sequence
  Description of Artificial Sequence: Synthetic peptide
  XenD22160 vhCDR3
DYYSSSPY

SEQ ID NO: 41949 - protein, 446 aa, Artificial Sequence
  Description of Artificial Sequence: Synthetic polypeptide
  XenD22161 1C11_H3.306_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41950 - protein, 117 aa, Artificial Sequence
  Description of Artificial Sequence: Synthetic polypeptide
  VH of XenD22161
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPFWGQGTLVTVSS

SEQ ID NO: 41951 - protein, 5 aa, Artificial Sequence
  Description of Artificial Sequence: Synthetic peptide
  XenD22161 vhCDR1
HYGMN

SEQ ID NO: 41952 - protein, 17 aa, Artificial Sequence
  Description of Artificial Sequence: Synthetic peptide
  XenD22161 vhCDR2
WINTYTGEPTYADGFTG

SEQ ID NO: 41953 - protein, 8 aa, Artificial Sequence
  Description of Artificial Sequence: Synthetic peptide
  XenD22161 vhCDR3
DYYGSSPF

SEQ ID NO: 41954 - protein, 446 aa, Artificial Sequence
  Description of Artificial Sequence: Synthetic polypeptide
  XenD22162 1C11_H3.307_IgG1_PVA_/S267K
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41955 - protein, 117 aa, Artificial Sequence
  Description of Artificial Sequence: Synthetic polypeptide
  VH of XenD22162
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPWWGQGTLVTVSS

SEQ ID NO: 41956 - protein, 5 aa, Artificial Sequence
  Description of Artificial Sequence: Synthetic peptide
  XenD22162 vhCDR1
HYGMN

SEQ ID NO: 41957 - protein, 17 aa, Artificial Sequence
  Description of Artificial Sequence: Synthetic peptide
  XenD22162 vhCDR2
WINTYTGEPTYADGFTG

SEQ ID NO: 41958 - protein, 8 aa, Artificial Sequence
  Description of Artificial Sequence: Synthetic peptide
  XenD22162 vhCDR3
DYYGSSPW

SEQ ID NO: 41959 - protein, 219 aa, Artificial Sequence; identical to SEQ ID NO: 33008
  Description of Artificial Sequence: Synthetic polypeptide
  XenD17482 1C11[PD-1]_L3

SEQ ID NO: 41960 - protein, 112 aa, Artificial Sequence; identical to SEQ ID NO: 33009
  Description of Artificial Sequence: Synthetic polypeptide
  VL of XenD17482

SEQ ID NO: 41961 - protein, 16 aa, Artificial Sequence
  Description of Artificial Sequence: Synthetic peptide
  XenD17482 vlCDR1
KSSQSIVHSNGNTYLE

SEQ ID NO: 41962 - protein, 7 aa, Artificial Sequence
  Description of Artificial Sequence: Synthetic peptide
  XenD17482 vlCDR2
KVSNRFS

SEQ ID NO: 41963 - protein, 9 aa, Artificial Sequence
  Description of Artificial Sequence: Synthetic peptide
  XenD17482 vlCDR3
FQGSHVPNT

SEQ ID NO: 41964 - protein, 219 aa, Artificial Sequence; identical to SEQ ID NO: 41394
  Description of Artificial Sequence: Synthetic polypeptide
  XenD18472 1C11_L3.38

SEQ ID NO: 41965 - protein, 112 aa, Artificial Sequence; identical to SEQ ID NO: 41395
  Description of Artificial Sequence: Synthetic polypeptide
  VL of XenD18472

SEQ ID NO: 41966 - protein, 16 aa, Artificial Sequence
  Description of Artificial Sequence: Synthetic peptide
  XenD18472 vlCDR1
KSSQSIVHSNGNNYLE

SEQ ID NO: 41967 - protein, 7 aa, Artificial Sequence
  Description of Artificial Sequence: Synthetic peptide
  XenD18472 vlCDR2
KVSNRFS

SEQ ID NO: 41968 - protein, 9 aa, Artificial Sequence
  Description of Artificial Sequence: Synthetic peptide
  XenD18472 vlCDR3
FQGSHVPNT

SEQ ID NO: 41969 - protein, 219 aa, Artificial Sequence
  Description of Artificial Sequence: Synthetic polypeptide
  XenD22163 1C11[PD-1]_L3.149
DVLMTQSPDSLAVSLGERATINCKSSQSIVYSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41970 - protein, 112 aa, Artificial Sequence
  Description of Artificial Sequence: Synthetic polypeptide
  VL of XenD22163
DVLMTQSPDSLAVSLGERATINCKSSQSIVYSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 41971 - protein, 16 aa, Artificial Sequence
  Description of Artificial Sequence: Synthetic peptide
  XenD22163 vlCDR1
KSSQSIVYSNGNTYLE

SEQ ID NO: 41972 - protein, 7 aa, Artificial Sequence
  Description of Artificial Sequence: Synthetic peptide
  XenD22163 vlCDR2
KVSNRFS

SEQ ID NO: 41973 - protein, 9 aa, Artificial Sequence
  Description of Artificial Sequence: Synthetic peptide
  XenD22163 vlCDR3
FQGSHVPNT

SEQ ID NO: 41974 - protein, 219 aa, Artificial Sequence
  Description of Artificial Sequence: Synthetic polypeptide
  XenD22164 1C11[PD-1]_L3.150
DVLMTQSPDSLAVSLGERATINCKSSQSIVQSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41975 - protein, 112 aa, Artificial Sequence
  Description of Artificial Sequence: Synthetic polypeptide
  VL of XenD22164
DVLMTQSPDSLAVSLGERATINCKSSQSIVQSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 41976 - protein, 16 aa, Artificial Sequence
  Description of Artificial Sequence: Synthetic peptide
  XenD22164 vlCDR1
KSSQSIVQSNGNTYLE

SEQ ID NO: 41977 - protein, 7 aa, Artificial Sequence
  Description of Artificial Sequence: Synthetic peptide
  XenD22164 vlCDR2
KVSNRFS

SEQ ID NO: 41978 - protein, 9 aa, Artificial Sequence
  Description of Artificial Sequence: Synthetic peptide
  XenD22164 vlCDR3
FQGSHVPNT

SEQ ID NO: 41979 - protein, 219 aa, Artificial Sequence
  Description of Artificial Sequence: Synthetic polypeptide
  XenD22165 1C11[PD-1]_L3.151
DVLMTQSPDSLAVSLGERATINCKSSQSIVDSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41980 - protein, 112 aa, Artificial Sequence
  Description of Artificial Sequence: Synthetic polypeptide
  VL of XenD22165
DVLMTQSPDSLAVSLGERATINCKSSQSIVDSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 41981 - protein, 16 aa, Artificial Sequence
  Description of Artificial Sequence: Synthetic peptide
  XenD22165 vlCDR1
KSSQSIVDSNGNTYLE

SEQ ID NO: 41982 - protein, 7 aa, Artificial Sequence
  Description of Artificial Sequence: Synthetic peptide
  XenD22165 vlCDR2
KVSNRFS

SEQ ID NO: 41983 - protein, 9 aa, Artificial Sequence
  Description of Artificial Sequence: Synthetic peptide
  XenD22165 vlCDR3
FQGSHVPNT

SEQ ID NO: 41984 - protein, 219 aa, Artificial Sequence
  Description of Artificial Sequence: Synthetic polypeptide
  XenD22166 1C11[PD-1]_L3.152
DVLMTQSPDSLAVSLGERATINCKSSQSIVFSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41985 - protein, 112 aa, Artificial Sequence
  Description of Artificial Sequence: Synthetic polypeptide
  VL of XenD22166
DVLMTQSPDSLAVSLGERATINCKSSQSIVFSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 41986 - protein, 16 aa, Artificial Sequence
  Description of Artificial Sequence: Synthetic peptide
  XenD22166 vlCDR1
KSSQSIVFSNGNTYLE

SEQ ID NO: 41987 - protein, 7 aa, Artificial Sequence
  Description of Artificial Sequence: Synthetic peptide
  XenD22166 vlCDR2
KVSNRFS

SEQ ID NO: 41988 - protein, 9 aa, Artificial Sequence
  Description of Artificial Sequence: Synthetic peptide
  XenD22166 vlCDR3
FQGSHVPNT

SEQ ID NO: 41989 - protein, 219 aa, Artificial Sequence
  Description of Artificial Sequence: Synthetic polypeptide
  XenD22167 1C11[PD-1]_L3.153
DVLMTQSPDSLAVSLGERATINCKSSQSIVTSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41990 - protein, 112 aa, Artificial Sequence
  Description of Artificial Sequence: Synthetic polypeptide
  VL of XenD22167
DVLMTQSPDSLAVSLGERATINCKSSQSIVTSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 41991 - protein, 16 aa, Artificial Sequence
  Description of Artificial Sequence: Synthetic peptide
  XenD22167 vlCDR1
KSSQSIVTSNGNTYLE

SEQ ID NO: 41992 - protein, 7 aa, Artificial Sequence
  Description of Artificial Sequence: Synthetic peptide
  XenD22167 vlCDR2
KVSNRFS

SEQ ID NO: 41993 - protein, 9 aa, Artificial Sequence
  Description of Artificial Sequence: Synthetic peptide
  XenD22167 vlCDR3
FQGSHVPNT

SEQ ID NO: 41994 - protein, 219 aa, Artificial Sequence
  Description of Artificial Sequence: Synthetic polypeptide
  XenD22168 1C11[PD-1]_L3.154
DVLMTQSPDSLAVSLGERATINCKSSQSIVKSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41995 - protein, 112 aa, Artificial Sequence
  Description of Artificial Sequence: Synthetic polypeptide
  VL of XenD22168
DVLMTQSPDSLAVSLGERATINCKSSQSIVKSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 41996 - protein, 16 aa, Artificial Sequence
  Description of Artificial Sequence: Synthetic peptide
  XenD22168 vlCDR1
KSSQSIVKSNGNTYLE

SEQ ID NO: 41997 - protein, 7 aa, Artificial Sequence
  Description of Artificial Sequence: Synthetic peptide
  XenD22168 vlCDR2
KVSNRFS

SEQ ID NO: 41998 - protein, 9 aa, Artificial Sequence
  Description of Artificial Sequence: Synthetic peptide
  XenD22168 vlCDR3
FQGSHVPNT

SEQ ID NO: 41999 - protein, 219 aa, Artificial Sequence
  Description of Artificial Sequence: Synthetic polypeptide
  XenD22169 1C11[PD-1]_L3.155
DVLMTQSPDSLAVSLGERATINCKSSQSIVHTNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42000 - protein, 112 aa, Artificial Sequence
  Description of Artificial Sequence: Synthetic polypeptide
  VL of XenD22169
DVLMTQSPDSLAVSLGERATINCKSSQSIVHTNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42001 - protein, 16 aa, Artificial Sequence
  Description of Artificial Sequence: Synthetic peptide
  XenD22169 vlCDR1
KSSQSIVHTNGNTYLE

SEQ ID NO: 42002 - protein, 7 aa, Artificial Sequence
  Description of Artificial Sequence: Synthetic peptide
  XenD22169 vlCDR2
KVSNRFS

SEQ ID NO: 42003 - protein, 9 aa, Artificial Sequence
  Description of Artificial Sequence: Synthetic peptide
  XenD22169 vlCDR3
FQGSHVPNT

SEQ ID NO: 42004 - protein, 219 aa, Artificial Sequence
  Description of Artificial Sequence: Synthetic polypeptide
  XenD22170 1C11[PD-1]_L3.156
DVLMTQSPDSLAVSLGERATINCKSSQSIVHANGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42005 - protein, 112 aa, Artificial Sequence
  Description of Artificial Sequence: Synthetic polypeptide
  VL of XenD22170
DVLMTQSPDSLAVSLGERATINCKSSQSIVHANGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42006 - protein, 16 aa, Artificial Sequence
  Description of Artificial Sequence: Synthetic peptide
  XenD22170 vlCDR1
KSSQSIVHANGNTYLE

SEQ ID NO: 42007 - protein, 7 aa, Artificial Sequence
  Description of Artificial Sequence: Synthetic peptide
  XenD22170 vlCDR2
KVSNRFS

SEQ ID NO: 42008 - protein, 9 aa, Artificial Sequence
  Description of Artificial Sequence: Synthetic peptide
  XenD22170 vlCDR3
FQGSHVPNT

SEQ ID NO: 42009 - protein, 219 aa, Artificial Sequence
  Description of Artificial Sequence: Synthetic polypeptide
  XenD22171 1C11[PD-1]_L3.157
DVLMTQSPDSLAVSLGERATINCKSSQSIVHQNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42010 - protein, 112 aa, Artificial Sequence
  Description of Artificial Sequence: Synthetic polypeptide
  VL of XenD22171
DVLMTQSPDSLAVSLGERATINCKSSQSIVHQNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42011 - protein, 16 aa, Artificial Sequence
  Description of Artificial Sequence: Synthetic peptide
  XenD22171 vlCDR1
KSSQSIVHQNGNTYLE

SEQ ID NO: 42012 - protein, 7 aa, Artificial Sequence
  Description of Artificial Sequence: Synthetic peptide
  XenD22171 vlCDR2
KVSNRFS

SEQ ID NO: 42013 - protein, 9 aa, Artificial Sequence
  Description of Artificial Sequence: Synthetic peptide
  XenD22171 vlCDR3
FQGSHVPNT

SEQ ID NO: 42014 - protein, 219 aa, Artificial Sequence
  Description of Artificial Sequence: Synthetic polypeptide
  XenD22172 1C11[PD-1]_L3.158
DVLMTQSPDSLAVSLGERATINCKSSQSIVHGNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42015 - protein, 112 aa, Artificial Sequence
  Description of Artificial Sequence: Synthetic polypeptide
  VL of XenD22172
DVLMTQSPDSLAVSLGERATINCKSSQSIVHGNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42016 - protein, 16 aa, Artificial Sequence
  Description of Artificial Sequence: Synthetic peptide
  XenD22172 vlCDR1
KSSQSIVHGNGNTYLE

SEQ ID NO: 42017 - protein, 7 aa, Artificial Sequence
  Description of Artificial Sequence: Synthetic peptide
  XenD22172 vlCDR2
KVSNRFS

SEQ ID NO: 42018 - protein, 9 aa, Artificial Sequence
  Description of Artificial Sequence: Synthetic peptide
  XenD22172 vlCDR3
FQGSHVPNT

SEQ ID NO: 42019 - protein, 219 aa, Artificial Sequence
  Description of Artificial Sequence: Synthetic polypeptide
  XenD22173 1C11[PD-1]_L3.159
DVLMTQSPDSLAVSLGERATINCKSSQSIVHVNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42020 - protein, 112 aa, Artificial Sequence
  Description of Artificial Sequence: Synthetic polypeptide
  VL of XenD22173
DVLMTQSPDSLAVSLGERATINCKSSQSIVHVNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42021 - protein, 16 aa, Artificial Sequence
  Description of Artificial Sequence: Synthetic peptide
  XenD22173 vlCDR1
KSSQSIVHVNGNTYLE

SEQ ID NO: 42022 - protein, 7 aa, Artificial Sequence
  Description of Artificial Sequence: Synthetic peptide
  XenD22173 vlCDR2
KVSNRFS

SEQ ID NO: 42023 - protein, 9 aa, Artificial Sequence
  Description of Artificial Sequence: Synthetic peptide
  XenD22173 vlCDR3
FQGSHVPNT

SEQ ID NO: 42024 - protein, 219 aa, Artificial Sequence
  Description of Artificial Sequence: Synthetic polypeptide
  XenD22174 1C11[PD-1]_L3.160
DVLMTQSPDSLAVSLGERATINCKSSQSIVHSHGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42025 - protein, 112 aa, Artificial Sequence
  Description of Artificial Sequence: Synthetic polypeptide
  VL of XenD22174
DVLMTQSPDSLAVSLGERATINCKSSQSIVHSHGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42026 - protein, 16 aa, Artificial Sequence
  Description of Artificial Sequence: Synthetic peptide
  XenD22174 vlCDR1
KSSQSIVHSHGNTYLE

SEQ ID NO: 42027 - protein, 7 aa, Artificial Sequence
  Description of Artificial Sequence: Synthetic peptide
  XenD22174 vlCDR2
KVSNRFS

SEQ ID NO: 42028 - protein, 9 aa, Artificial Sequence
  Description of Artificial Sequence: Synthetic peptide
  XenD22174 vlCDR3
FQGSHVPNT

SEQ ID NO: 42029 - protein, 219 aa, Artificial Sequence
  Description of Artificial Sequence: Synthetic polypeptide
  XenD22175 1C11[PD-1]_L3.161
DVLMTQSPDSLAVSLGERATINCKSSQSIVHSEGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42030 - protein, 112 aa, Artificial Sequence
  Description of Artificial Sequence: Synthetic polypeptide
  VL of XenD22175
DVLMTQSPDSLAVSLGERATINCKSSQSIVHSEGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42031 - protein, 16 aa, Artificial Sequence
  Description of Artificial Sequence: Synthetic peptide
  XenD22175 vlCDR1
KSSQSIVHSEGNTYLE

SEQ ID NO: 42032 - protein, 7 aa, Artificial Sequence
  Description of Artificial Sequence: Synthetic peptide
  XenD22175 vlCDR2
KVSNRFS

SEQ ID NO: 42033 - protein, 9 aa, Artificial Sequence
  Description of Artificial Sequence: Synthetic peptide
  XenD22175 vlCDR3
FQGSHVPNT

SEQ ID NO: 42034 - protein, 219 aa, Artificial Sequence
  Description of Artificial Sequence: Synthetic polypeptide
  XenD22176 1C11[PD-1]_L3.162
DVLMTQSPDSLAVSLGERATINCKSSQSIVHSSGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42035 - protein, 112 aa, Artificial Sequence
  Description of Artificial Sequence: Synthetic polypeptide
  VL of XenD22176
DVLMTQSPDSLAVSLGERATINCKSSQSIVHSSGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42036 - protein, 16 aa, Artificial Sequence
  Description of Artificial Sequence: Synthetic peptide
  XenD22176 vlCDR1
KSSQSIVHSSGNTYLE

SEQ ID NO: 42037 - protein, 7 aa, Artificial Sequence
  Description of Artificial Sequence: Synthetic peptide
  XenD22176 vlCDR2
KVSNRFS

SEQ ID NO: 42038 - protein, 9 aa, Artificial Sequence
  Description of Artificial Sequence: Synthetic peptide
  XenD22176 vlCDR3
FQGSHVPNT

SEQ ID NO: 42039 - protein, 219 aa, Artificial Sequence
  Description of Artificial Sequence: Synthetic polypeptide
  XenD22177 1C11[PD-1]_L3.163
DVLMTQSPDSLAVSLGERATINCKSSQSIVHSRGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42040 - protein, 112 aa, Artificial Sequence
  Description of Artificial Sequence: Synthetic polypeptide
  VL of XenD22177
DVLMTQSPDSLAVSLGERATINCKSSQSIVHSRGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42041 - protein, 16 aa, Artificial Sequence
  Description of Artificial Sequence: Synthetic peptide
  XenD22177 vlCDR1
KSSQSIVHSRGNTYLE

SEQ ID NO: 42042 - protein, 7 aa, Artificial Sequence
  Description of Artificial Sequence: Synthetic peptide
  XenD22177 vlCDR2
KVSNRFS

SEQ ID NO: 42043 - protein, 9 aa, Artificial Sequence
  Description of Artificial Sequence: Synthetic peptide
  XenD22177 vlCDR3
FQGSHVPNT

SEQ ID NO: 42044 - protein, 219 aa, Artificial Sequence
  Description of Artificial Sequence: Synthetic polypeptide
  XenD22178 1C11[PD-1]_L3.164
DVLMTQSPDSLAVSLGERATINCKSSQSIVHSLGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42045 - protein, 112 aa, Artificial Sequence
  Description of Artificial Sequence: Synthetic polypeptide
  VL of XenD22178
DVLMTQSPDSLAVSLGERATINCKSSQSIVHSLGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42046 - protein, 16 aa, Artificial Sequence
  Description of Artificial Sequence: Synthetic peptide
  XenD22178 vlCDR1
KSSQSIVHSLGNTYLE

SEQ ID NO: 42047 - protein, 7 aa, Artificial Sequence
  Description of Artificial Sequence: Synthetic peptide
  XenD22178 vlCDR2
KVSNRFS

SEQ ID NO: 42048 - protein, 9 aa, Artificial Sequence
  Description of Artificial Sequence: Synthetic peptide
  XenD22178 vlCDR3
FQGSHVPNT

SEQ ID NO: 42049 - protein, 219 aa, Artificial Sequence
  Description of Artificial Sequence: Synthetic polypeptide
  XenD22179 1C11[PD-1]_L3.165
DVLMTQSPDSLAVSLGERATINCKSSQSIVHSNANTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42050 - protein, 112 aa, Artificial Sequence
  Description of Artificial Sequence: Synthetic polypeptide
  VL of XenD22179
DVLMTQSPDSLAVSLGERATINCKSSQSIVHSNANTYLEWYQQKPGQSPKLLIYKVSNRFSGVPDRFSGSGSGTDFTLTISSLQAEDVAVYYCFQGSHVPNTFGGGTKVEIK

SEQ ID NO: 42051 - protein, 16 aa, Artificial Sequence
  Description of Artificial Sequence: Synthetic peptide
  XenD22179 vlCDR1
KSSQSIVHSNANTYLE

SEQ ID NO: 42052 - protein, 7 aa, Artificial Sequence
  Description of Artificial Sequence: Synthetic peptide
  XenD22179 vlCDR2
KVSNRFS

SEQ ID NO: 42053 - protein, 9 aa, Artificial Sequence
  Description of Artificial Sequence: Synthetic peptide
  XenD22179 vlCDR3
FQGSHVPNT

SEQ ID NO: 42054 - protein, 219 aa, Artificial Sequence
  Description of Artificial Sequence: Synthetic polypeptide
  XenD22180 1C11[PD-1]_L3.166
DVLMTQSPDSLAVSLGERATINCKSSQSIVHSNSNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42055 - protein, 112 aa, Artificial Sequence
  Description of Artificial Sequence: Synthetic polypeptide
  VL of XenD22180
DVLMTQSPDSLAVSLGERATINCKSSQSIVHSNSNTYLEWYQQKPGQSPKLLIYKVSNRFSGVPDRFSGSGSGTDFTLTISSLQAEDVAVYYCFQGSHVPNTFGGGTKVEIK

SEQ ID NO: 42056 - protein, 16 aa, Artificial Sequence
  Description of Artificial Sequence: Synthetic peptide
  XenD22180 vlCDR1
KSSQSIVHSNSNTYLE

SEQ ID NO: 42057 - protein, 7 aa, Artificial Sequence
  Description of Artificial Sequence: Synthetic peptide
  XenD22180 vlCDR2
KVSNRFS

SEQ ID NO: 42058 - protein, 9 aa, Artificial Sequence
  Description of Artificial Sequence: Synthetic peptide
  XenD22180 vlCDR3
FQGSHVPNT

SEQ ID NO: 42059 - protein, 219 aa, Artificial Sequence
  Description of Artificial Sequence: Synthetic polypeptide
  XenD22181 1C11[PD-1]_L3.167
DVLMTQSPDSLAVSLGERATINCKSSQSIVHSNTNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42060 - protein, 112 aa, Artificial Sequence
  Description of Artificial Sequence: Synthetic polypeptide
  VL of XenD22181
DVLMTQSPDSLAVSLGERATINCKSSQSIVHSNTNTYLEWYQQKPGQSPKLLIYKVSNRFSGVPDRFSGSGSGTDFTLTISSLQAEDVAVYYCFQGSHVPNTFGGGTKVEIK

SEQ ID NO: 42061 - protein, 16 aa, Artificial Sequence
  Description of Artificial Sequence: Synthetic peptide
  XenD22181 vlCDR1
KSSQSIVHSNTNTYLE

SEQ ID NO: 42062 - protein, 7 aa, Artificial Sequence
  Description of Artificial Sequence: Synthetic peptide
  XenD22181 vlCDR2
KVSNRFS

SEQ ID NO: 42063 - protein, 9 aa, Artificial Sequence
  Description of Artificial Sequence: Synthetic peptide
  XenD22181 vlCDR3
FQGSHVPNT

SEQ ID NO: 42064 - protein, 219 aa, Artificial Sequence
  Description of Artificial Sequence: Synthetic polypeptide
  XenD22182 1C11[PD-1]_L3.168
DVLMTQSPDSLAVSLGERATINCKSSQSIVHSNQNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42065 - protein, 112 aa, Artificial Sequence
  Description of Artificial Sequence: Synthetic polypeptide
  VL of XenD22182
DVLMTQSPDSLAVSLGERATINCKSSQSIVHSNQNTYLEWYQQKPGQSPKLLIYKVSNRFSGVPDRFSGSGSGTDFTLTISSLQAEDVAVYYCFQGSHVPNTFGGGTKVEIK

SEQ ID NO: 42066 - protein, 16 aa, Artificial Sequence
  Description of Artificial Sequence: Synthetic peptide
  XenD22182 vlCDR1
KSSQSIVHSNQNTYLE

SEQ ID NO: 42067 - protein, 7 aa, Artificial Sequence
  Description of Artificial Sequence: Synthetic peptide
  XenD22182 vlCDR2
KVSNRFS

SEQ ID NO: 42068 - protein, 9 aa, Artificial Sequence
  Description of Artificial Sequence: Synthetic peptide
  XenD22182 vlCDR3
FQGSHVPNT

SEQ ID NO: 42069 - protein, 219 aa, Artificial Sequence
  Description of Artificial Sequence: Synthetic polypeptide
  XenD22183 1C11[PD-1]_L3.169
DVLMTQSPDSLAVSLGERATINCKSSQSIVHSNGDTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42070 - protein, 112 aa, Artificial Sequence
  Description of Artificial Sequence: Synthetic polypeptide
  VL of XenD22183
DVLMTQSPDSLAVSLGERATINCKSSQSIVHSNGDTYLEWYQQKPGQSPKLLIYKVSNRFSGVPDRFSGSGSGTDFTLTISSLQAEDVAVYYCFQGSHVPNTFGGGTKVEIK

SEQ ID NO: 42071 - protein, 16 aa, Artificial Sequence
  Description of Artificial Sequence: Synthetic peptide
  XenD22183 vlCDR1
KSSQSIVHSNGDTYLE

SEQ ID NO: 42072 - protein, 7 aa, Artificial Sequence
  Description of Artificial Sequence: Synthetic peptide
  XenD22183 vlCDR2
KVSNRFS

SEQ ID NO: 42073 - protein, 9 aa, Artificial Sequence
  Description of Artificial Sequence: Synthetic peptide
  XenD22183 vlCDR3
FQGSHVPNT

SEQ ID NO: 42074 - protein, 219 aa, Artificial Sequence
  Description of Artificial Sequence: Synthetic polypeptide
  XenD22184 1C11[PD-1]_L3.170
DVLMTQSPDSLAVSLGERATINCKSSQSIVHSNGHTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42075 - protein, 112 aa, Artificial Sequence
  Description of Artificial Sequence: Synthetic polypeptide
  VL of XenD22184
DVLMTQSPDSLAVSLGERATINCKSSQSIVHSNGHTYLEWYQQKPGQSPKLLIYKVSNRFSGVPDRFSGSGSGTDFTLTISSLQAEDVAVYYCFQGSHVPNTFGGGTKVEIK

SEQ ID NO: 42076 - protein, 16 aa, Artificial Sequence
  Description of Artificial Sequence: Synthetic peptide
  XenD22184 vlCDR1
KSSQSIVHSNGHTYLE

SEQ ID NO: 42077 - protein, 7 aa, Artificial Sequence
  Description of Artificial Sequence: Synthetic peptide
  XenD22184 vlCDR2
KVSNRFS

SEQ ID NO: 42078 - protein, 9 aa, Artificial Sequence
  Description of Artificial Sequence: Synthetic peptide
  XenD22184 vlCDR3
FQGSHVPNT

SEQ ID NO: 42079 - protein, 219 aa, Artificial Sequence
  Description of Artificial Sequence: Synthetic polypeptide
  XenD22185 1C11[PD-1]_L3.171
DVLMTQSPDSLAVSLGERATINCKSSQSIVHSNGETYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42080 - protein, 112 aa, Artificial Sequence
  Description of Artificial Sequence: Synthetic polypeptide
  VL of XenD22185
DVLMTQSPDSLAVSLGERATINCKSSQSIVHSNGETYLEWYQQKPGQSPKLLIYKVSNRFSGVPDRFSGSGSGTDFTLTISSLQAEDVAVYYCFQGSHVPNTFGGGTKVEIK

SEQ ID NO: 42081 - protein, 16 aa, Artificial Sequence
  Description of Artificial Sequence: Synthetic peptide
  XenD22185 vlCDR1
KSSQSIVHSNGETYLE

SEQ ID NO: 42082 - protein, 7 aa, Artificial Sequence
  Description of Artificial Sequence: Synthetic peptide
  XenD22185 vlCDR2
KVSNRFS

SEQ ID NO: 42083 - protein, 9 aa, Artificial Sequence
  Description of Artificial Sequence: Synthetic peptide
  XenD22185 vlCDR3
FQGSHVPNT

SEQ ID NO: 42084 - protein, 219 aa, Artificial Sequence
  Description of Artificial Sequence: Synthetic polypeptide
  XenD22186 1C11[PD-1]_L3.172
DVLMTQSPDSLAVSLGERATINCKSSQSIVHSNGRTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42085 - protein, 112 aa, Artificial Sequence
  Description of Artificial Sequence: Synthetic polypeptide
  VL of XenD22186
DVLMTQSPDSLAVSLGERATINCKSSQSIVHSNGRTYLEWYQQKPGQSPKLLIYKVSNRFSGVPDRFSGSGSGTDFTLTISSLQAEDVAVYYCFQGSHVPNTFGGGTKVEIK

SEQ ID NO: 42086 - protein, 16 aa, Artificial Sequence
  Description of Artificial Sequence: Synthetic peptide
  XenD22186 vlCDR1
KSSQSIVHSNGRTYLE

SEQ ID NO: 42087 - protein, 7 aa, Artificial Sequence
  Description of Artificial Sequence: Synthetic peptide
  XenD22186 vlCDR2
KVSNRFS

SEQ ID NO: 42088 - protein, 9 aa, Artificial Sequence
  Description of Artificial Sequence: Synthetic peptide
  XenD22186 vlCDR3
FQGSHVPNT

SEQ ID NO: 42089 - protein, 219 aa, Artificial Sequence
  Description of Artificial Sequence: Synthetic polypeptide
  XenD22187 1C11[PD-1]_L3.173
DVLMTQSPDSLAVSLGERATINCKSSQSIVHSNGNTFLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42090 - protein, 112 aa, Artificial Sequence
  Description of Artificial Sequence: Synthetic polypeptide
  VL of XenD22187
DVLMTQSPDSLAVSLGERATINCKSSQSIVHSNGNTFLEWYQQKPGQSPKLLIYKVSNRFSGVPDRFSGSGSGTDFTLTISSLQAEDVAVYYCFQGSHVPNTFGGGTKVEIK

SEQ ID NO: 42091 - protein, 16 aa, Artificial Sequence
  Description of Artificial Sequence: Synthetic peptide
  XenD22187 vlCDR1
KSSQSIVHSNGNTFLE

SEQ ID NO: 42092 - protein, 7 aa, Artificial Sequence
  Description of Artificial Sequence: Synthetic peptide
  XenD22187 vlCDR2
KVSNRFS

SEQ ID NO: 42093 - protein, 9 aa, Artificial Sequence
  Description of Artificial Sequence: Synthetic peptide
  XenD22187 vlCDR3
FQGSHVPNT

SEQ ID NO: 42094 - protein, 219 aa, Artificial Sequence
  Description of Artificial Sequence: Synthetic polypeptide
  XenD22188 1C11[PD-1]_L3.174
DVLMTQSPDSLAVSLGERATINCKSSQSIVHSNGNTHLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42095 - protein, 112 aa, Artificial Sequence
  Description of Artificial Sequence: Synthetic polypeptide
  VL of XenD22188
DVLMTQSPDSLAVSLGERATINCKSSQSIVHSNGNTHLEWYQQKPGQSPKLLIYKVSNRFSGVPDRFSGSGSGTDFTLTISSLQAEDVAVYYCFQGSHVPNTFGGGTKVEIK

SEQ ID NO: 42096 - protein, 16 aa, Artificial Sequence
  Description of Artificial Sequence: Synthetic peptide
  XenD22188 vlCDR1
KSSQSIVHSNGNTHLE

SEQ ID NO: 42097 - protein, 7 aa, Artificial Sequence
  Description of Artificial Sequence: Synthetic peptide
  XenD22188 vlCDR2
KVSNRFS

SEQ ID NO: 42098 - protein, 9 aa, Artificial Sequence
  Description of Artificial Sequence: Synthetic peptide
  XenD22188 vlCDR3
FQGSHVPNT

SEQ ID NO: 42099 - protein, 219 aa, Artificial Sequence
  Description of Artificial Sequence: Synthetic polypeptide
  XenD22189 1C11[PD-1]_L3.175
DVLMTQSPDSLAVSLGERATINCKSSQSIVHSNGNTLLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42100 - protein, 112 aa, Artificial Sequence
  Description of Artificial Sequence: Synthetic polypeptide
  VL of XenD22189
DVLMTQSPDSLAVSLGERATINCKSSQSIVHSNGNTLLEWYQQKPGQSPKLLIYKVSNRFSGVPDRFSGSGSGTDFTLTISSLQAEDVAVYYCFQGSHVPNTFGGGTKVEIK

SEQ ID NO: 42101 - protein, 16 aa, Artificial Sequence
  Description of Artificial Sequence: Synthetic peptide
  XenD22189 vlCDR1
KSSQSIVHSNGNTLLE

SEQ ID NO: 42102 - protein, 7 aa, Artificial Sequence
  Description of Artificial Sequence: Synthetic peptide
  XenD22189 vlCDR2
KVSNRFS

SEQ ID NO: 42103 - protein, 9 aa, Artificial Sequence
  Description of Artificial Sequence: Synthetic peptide
  XenD22189 vlCDR3
FQGSHVPNT

SEQ ID NO: 42104 - protein, 219 aa, Artificial Sequence
  Description of Artificial Sequence: Synthetic polypeptide
  XenD22190 1C11[PD-1]_L3.176
DVLMTQSPDSLAVSLGERATINCKSSQSIVHSNGNTWLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42105 - protein, 112 aa, Artificial Sequence
  Description of Artificial Sequence: Synthetic polypeptide
  VL of XenD22190
DVLMTQSPDSLAVSLGERATINCKSSQSIVHSNGNTWLEWYQQKPGQSPKLLIYKVSNRFSGVPDRFSGSGSGTDFTLTISSLQAEDVAVYYCFQGSHVPNTFGGGTKVEIK

SEQ ID NO: 42106 - protein, 16 aa, Artificial Sequence
  Description of Artificial Sequence: Synthetic peptide
  XenD22190 vlCDR1
KSSQSIVHSNGNTWLE

SEQ ID NO: 42107 - protein, 7 aa, Artificial Sequence
  Description of Artificial Sequence: Synthetic peptide
  XenD22190 vlCDR2
KVSNRFS

SEQ ID NO: 42108 - protein, 9 aa, Artificial Sequence
  Description of Artificial Sequence: Synthetic peptide
  XenD22190 vlCDR3
FQGSHVPNT

SEQ ID NO: 42109 - protein, 219 aa, Artificial Sequence
  Description of Artificial Sequence: Synthetic polypeptide
  XenD22191 1C11[PD-1]_L3.177
DVLMTQSPDSLAVSLGERATINCKSSQSIVHSNGNTQLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42110 - protein, 112 aa, Artificial Sequence
  Description of Artificial Sequence: Synthetic polypeptide
  VL of XenD22191
DVLMTQSPDSLAVSLGERATINCKSSQSIVHSNGNTQLEWYQQKPGQSPKLLIYKVSNRFSGVPDRFSGSGSGTDFTLTISSLQAEDVAVYYCFQGSHVPNTFGGGTKVEIK

SEQ ID NO: 42111 - protein, 16 aa, Artificial Sequence
  Description of Artificial Sequence: Synthetic peptide
  XenD22191 vlCDR1
KSSQSIVHSNGNTQLE

SEQ ID NO: 42112 - protein, 7 aa, Artificial Sequence
  Description of Artificial Sequence: Synthetic peptide
  XenD22191 vlCDR2
KVSNRFS

SEQ ID NO: 42113 - protein, 9 aa, Artificial Sequence
  Description of Artificial Sequence: Synthetic peptide
  XenD22191 vlCDR3
FQGSHVPNT

SEQ ID NO: 42114 - protein, 219 aa, Artificial Sequence
  Description of Artificial Sequence: Synthetic polypeptide
  XenD22192 1C11[PD-1]_L3.178
DVLMTQSPDSLAVSLGERATINCKSSQSIVHSNGNTYLEWYQQKPGQSPKLLIFKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42115 - protein, 112 aa, Artificial Sequence
  Description of Artificial Sequence: Synthetic polypeptide
  VL of XenD22192
DVLMTQSPDSLAVSLGERATINCKSSQSIVHSNGNTYLEWYQQKPGQSPKLLIFKVSNRFSGVPDRFSGSGSGTDFTLTISSLQAEDVAVYYCFQGSHVPNTFGGGTKVEIK

SEQ ID NO: 42116 - protein, 16 aa, Artificial Sequence
  Description of Artificial Sequence: Synthetic peptide
  XenD22192 vlCDR1
KSSQSIVHSNGNTYLE

SEQ ID NO: 42117 - protein, 7 aa, Artificial Sequence
  Description of Artificial Sequence: Synthetic peptide
  XenD22192 vlCDR2
KVSNRFS

SEQ ID NO: 42118 - protein, 9 aa, Artificial Sequence
  Description of Artificial Sequence: Synthetic peptide
  XenD22192 vlCDR3
FQGSHVPNT

SEQ ID NO: 42119 - protein, 219 aa, Artificial Sequence
  Description of Artificial Sequence: Synthetic polypeptide
  XenD22193 1C11[PD-1]_L3.179
DVLMTQSPDSLAVSLGERATINCKSSQSIVHSNGNTYLEWYQQKPGQSPKLLIHKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42120 - protein, 112 aa, Artificial Sequence
  Description of Artificial Sequence: Synthetic polypeptide
  VL of XenD22193
DVLMTQSPDSLAVSLGERATINCKSSQSIVHSNGNTYLEWYQQKPGQSPKLLIHKVSNRFSGVPDRFSGSGSGTDFTLTISSLQAEDVAVYYCFQGSHVPNTFGGGTKVEIK

SEQ ID NO: 42121 - protein, 16 aa, Artificial Sequence
  Description of Artificial Sequence: Synthetic peptide
  XenD22193 vlCDR1
KSSQSIVHSNGNTYLE

SEQ ID NO: 42122 - protein, 7 aa, Artificial Sequence
  Description of Artificial Sequence: Synthetic peptide
  XenD22193 vlCDR2
KVSNRFS

SEQ ID NO: 42123 - protein, 9 aa, Artificial Sequence
  Description of Artificial Sequence: Synthetic peptide
  XenD22193 vlCDR3
FQGSHVPNT

SEQ ID NO: 42124 - protein, 219 aa, Artificial Sequence
  Description of Artificial Sequence: Synthetic polypeptide
  XenD22194 1C11[PD-1]_L3.180
DVLMTQSPDSLAVSLGERATINCKSSQSIVHSNGNTYLEWYQQKPGQSPKLLILKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42125 - protein, 112 aa, Artificial Sequence
  Description of Artificial Sequence: Synthetic polypeptide
  VL of XenD22194
DVLMTQSPDSLAVSLGERATINCKSSQSIVHSNGNTYLEWYQQKPGQSPKLLILKVSNRFSGVPDRFSGSGSGTDFTLTISSLQAEDVAVYYCFQGSHVPNTFGGGTKVEIK

SEQ ID NO: 42126 - protein, 16 aa, Artificial Sequence
  Description of Artificial Sequence: Synthetic peptide
  XenD22194 vlCDR1
KSSQSIVHSNGNTYLE

SEQ ID NO: 42127 - protein, 7 aa, Artificial Sequence
  Description of Artificial Sequence: Synthetic peptide
  XenD22194 vlCDR2
KVSNRFS

SEQ ID NO: 42128 - protein, 9 aa, Artificial Sequence
  Description of Artificial Sequence: Synthetic peptide
  XenD22194 vlCDR3
FQGSHVPNT

SEQ ID NO: 42129 - protein, 219 aa, Artificial Sequence
  Description of Artificial Sequence: Synthetic polypeptide
  XenD22195 1C11[PD-1]_L3.181
DVLMTQSPDSLAVSLGERATINCKSSQSIVHSNGNTYLEWYQQKPGQSPKLLIWKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42130 - protein, 112 aa, Artificial Sequence
  Description of Artificial Sequence: Synthetic polypeptide
  VL of XenD22195
DVLMTQSPDSLAVSLGERATINCKSSQSIVHSNGNTYLEWYQQKPGQSPKLLIWKVSNRFSGVPDRFSGSGSGTDFTLTISSLQAEDVAVYYCFQGSHVPNTFGGGTKVEIK

SEQ ID NO: 42131 - protein, 16 aa, Artificial Sequence
  Description of Artificial Sequence: Synthetic peptide
  XenD22195 vlCDR1
KSSQSIVHSNGNTYLE

SEQ ID NO: 42132 - protein, 7 aa, Artificial Sequence
  Description of Artificial Sequence: Synthetic peptide
  XenD22195 vlCDR2
KVSNRFS

SEQ ID NO: 42133 - protein, 9 aa, Artificial Sequence
  Description of Artificial Sequence: Synthetic peptide
  XenD22195 vlCDR3
FQGSHVPNT

SEQ ID NO: 42134 - protein, 219 aa, Artificial Sequence
  Description of Artificial Sequence: Synthetic polypeptide
  XenD22196 1C11[PD-1]_L3.182
DVLMTQSPDSLAVSLGERATINCKSSQSIVHSNGNTYLEWYQQKPGQSPKLLIQKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42135 - protein, 112 aa, Artificial Sequence
  Description of Artificial Sequence: Synthetic polypeptide
  VL of XenD22196
DVLMTQSPDSLAVSLGERATINCKSSQSIVHSNGNTYLEWYQQKPGQSPKLLIQKVSNRFSGVPDRFSGSGSGTDFTLTISSLQAEDVAVYYCFQGSHVPNTFGGGTKVEIK

SEQ ID NO: 42136 - protein, 16 aa, Artificial Sequence
  Description of Artificial Sequence: Synthetic peptide
  XenD22196 vlCDR1
KSSQSIVHSNGNTYLE

SEQ ID NO: 42137 - protein, 7 aa, Artificial Sequence
  Description of Artificial Sequence: Synthetic peptide
  XenD22196 vlCDR2
KVSNRFS

SEQ ID NO: 42138 - protein, 9 aa, Artificial Sequence
  Description of Artificial Sequence: Synthetic peptide
  XenD22196 vlCDR3
FQGSHVPNT

SEQ ID NO: 42139 - protein, 219 aa, Artificial Sequence
  Description of Artificial Sequence: Synthetic polypeptide
  XenD22197 1C11[PD-1]_L3.183
DVLMTQSPDSLAVSLGERATINCKSSQSIVHSNGNTYLEWYQQKPGQSPKLLIYKISNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42140 - protein, 112 aa, Artificial Sequence
  Description of Artificial Sequence: Synthetic polypeptide
  VL of XenD22197
DVLMTQSPDSLAVSLGERATINCKSSQSIVHSNGNTYLEWYQQKPGQSPKLLIYKISNRFSGVPDRFSGSGSGTDFTLTISSLQAEDVAVYYCFQGSHVPNTFGGGTKVEIK

SEQ ID NO: 42141 - protein, 16 aa, Artificial Sequence
  Description of Artificial Sequence: Synthetic peptide
  XenD22197 vlCDR1
KSSQSIVHSNGNTYLE

SEQ ID NO: 42142 - protein, 7 aa, Artificial Sequence
  Description of Artificial Sequence: Synthetic peptide
  XenD22197 vlCDR2
KISNRFS

SEQ ID NO: 42143 - protein, 9 aa, Artificial Sequence
  Description of Artificial Sequence: Synthetic peptide
  XenD22197 vlCDR3
FQGSHVPNT

SEQ ID NO: 42144 - protein, 219 aa, Artificial Sequence
  Description of Artificial Sequence: Synthetic polypeptide
  XenD22198 1C11[PD-1]_L3.184
DVLMTQSPDSLAVSLGERATINCKSSQSIVHSNGNTYLEWYQQKPGQSPKLLIYKLSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42145 - protein, 112 aa, Artificial Sequence
  Description of Artificial Sequence: Synthetic polypeptide
  VL of XenD22198
DVLMTQSPDSLAVSLGERATINCKSSQSIVHSNGNTYLEWYQQKPGQSPKLLIYKLSNRFSGVPDRFSGSGSGTDFTLTISSLQAEDVAVYYCFQGSHVPNTFGGGTKVEIK

SEQ ID NO: 42146 - protein, 16 aa, Artificial Sequence
  Description of Artificial Sequence: Synthetic peptide
  XenD22198 vlCDR1
KSSQSIVHSNGNTYLE

SEQ ID NO: 42147 - protein, 7 aa, Artificial Sequence
  Description of Artificial Sequence: Synthetic peptide
  XenD22198 vlCDR2
KLSNRFS

SEQ ID NO: 42148 - protein, 9 aa, Artificial Sequence
  Description of Artificial Sequence: Synthetic peptide
  XenD22198 vlCDR3
FQGSHVPNT

SEQ ID NO: 42149 - protein, 219 aa, Artificial Sequence
  Description of Artificial Sequence: Synthetic polypeptide
  XenD22199 1C11[PD-1]_L3.185
DVLMTQSPDSLAVSLGERATINCKSSQSIVHSNGNTYLEWYQQKPGQSPKLLIYKSSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42150 - protein, 112 aa, Artificial Sequence
  Description of Artificial Sequence: Synthetic polypeptide
  VL of XenD22199
DVLMTQSPDSLAVSLGERATINCKSSQSIVHSNGNTYLEWYQQKPGQSPKLLIYKSSNRFSGVPDRFSGSGSGTDFTLTISSLQAEDVAVYYCFQGSHVPNTFGGGTKVEIK

SEQ ID NO: 42151 - protein, 16 aa, Artificial Sequence
  Description of Artificial Sequence: Synthetic peptide
  XenD22199 vlCDR1
KSSQSIVHSNGNTYLE

SEQ ID NO: 42152 - protein, 7 aa, Artificial Sequence
  Description of Artificial Sequence: Synthetic peptide
  XenD22199 vlCDR2
KSSNRFS

SEQ ID NO: 42153 - protein, 9 aa, Artificial Sequence
  Description of Artificial Sequence: Synthetic peptide
  XenD22199 vlCDR3
FQGSHVPNT

SEQ ID NO: 42154 - protein, 219 aa, Artificial Sequence
  Description of Artificial Sequence: Synthetic polypeptide
  XenD22200 1C11[PD-1]_L3.186
DVLMTQSPDSLAVSLGERATINCKSSQSIVHSNGNTYLEWYQQKPGQSPKLLIYKVSDRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42155 - protein, 112 aa, Artificial Sequence
  Description of Artificial Sequence: Synthetic polypeptide
  VL of XenD22200
DVLMTQSPDSLAVSLGERATINCKSSQSIVHSNGNTYLEWYQQKPGQSPKLLIYKVSDRFSGVPDRFSGSGSGTDFTLTISSLQAEDVAVYYCFQGSHVPNTFGGGTKVEIK

SEQ ID NO: 42156 - protein, 16 aa, Artificial Sequence
  Description of Artificial Sequence: Synthetic peptide
  XenD22200 vlCDR1
KSSQSIVHSNGNTYLE

SEQ ID NO: 42157 - protein, 7 aa, Artificial Sequence
  Description of Artificial Sequence: Synthetic peptide
  XenD22200 vlCDR2
KVSDRFS

SEQ ID NO: 42158 - protein, 9 aa, Artificial Sequence
  Description of Artificial Sequence: Synthetic peptide
  XenD22200 vlCDR3
FQGSHVPNT

SEQ ID NO: 42159 - protein, 219 aa, Artificial Sequence
  Description of Artificial Sequence: Synthetic polypeptide
  XenD22201 1C11[PD-1]_L3.187
DVLMTQSPDSLAVSLGERATINCKSSQSIVHSNGNTYLEWYQQKPGQSPKLLIYKVSHRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42160 - protein, 112 aa, Artificial Sequence
  Description of Artificial Sequence: Synthetic polypeptide
  VL of XenD22201
DVLMTQSPDSLAVSLGERATINCKSSQSIVHSNGNTYLEWYQQKPGQSPKLLIYKVSHRFSGVPDRFSGSGSGTDFTLTISSLQAEDVAVYYCFQGSHVPNTFGGGTKVEIK

SEQ ID NO: 42161 - protein, 16 aa, Artificial Sequence
  Description of Artificial Sequence: Synthetic peptide
  XenD22201 vlCDR1
KSSQSIVHSNGNTYLE

SEQ ID NO: 42162 - protein, 7 aa, Artificial Sequence
  Description of Artificial Sequence: Synthetic peptide
  XenD22201 vlCDR2
KVSHRFS

SEQ ID NO: 42163 - protein, 9 aa, Artificial Sequence
  Description of Artificial Sequence: Synthetic peptide
  XenD22201 vlCDR3
FQGSHVPNT

SEQ ID NO: 42164 - protein, 219 aa, Artificial Sequence
  Description of Artificial Sequence: Synthetic polypeptide
  XenD22202 1C11[PD-1]_L3.188
DVLMTQSPDSLAVSLGERATINCKSSQSIVHSNGNTYLEWYQQKPGQSPKLLIYKVSERFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42165 - protein, 112 aa, Artificial Sequence
  Description of Artificial Sequence: Synthetic polypeptide
  VL of XenD22202
DVLMTQSPDSLAVSLGERATINCKSSQSIVHSNGNTYLEWYQQKPGQSPKLLIYKVSERFSGVPDRFSGSGSGTDFTLTISSLQAEDVAVYYCFQGSHVPNTFGGGTKVEIK

SEQ ID NO: 42166 - protein, 16 aa, Artificial Sequence
  Description of Artificial Sequence: Synthetic peptide
  XenD22202 vlCDR1
KSSQSIVHSNGNTYLE

SEQ ID NO: 42167 - protein, 7 aa, Artificial Sequence
  Description of Artificial Sequence: Synthetic peptide
  XenD22202 vlCDR2
KVSERFS

SEQ ID NO: 42168 - protein, 9 aa, Artificial Sequence
  Description of Artificial Sequence: Synthetic peptide
  XenD22202 vlCDR3
FQGSHVPNT

SEQ ID NO: 42169 - protein, 219 aa, Artificial Sequence
  Description of Artificial Sequence: Synthetic polypeptide
  XenD22203 1C11[PD-1]_L3.189
DVLMTQSPDSLAVSLGERATINCKSSQSIVHSNGNTYLEWYQQKPGQSPKLLIYKVSRRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42170 - protein, 112 aa, Artificial Sequence
  Description of Artificial Sequence: Synthetic polypeptide
  VL of XenD22203
DVLMTQSPDSLAVSLGERATINCKSSQSIVHSNGNTYLEWYQQKPGQSPKLLIYKVSRRFSGVPDRFSGSGSGTDFTLTISSLQAEDVAVYYCFQGSHVPNTFGGGTKVEIK

SEQ ID NO: 42171 - protein, 16 aa, Artificial Sequence
  Description of Artificial Sequence: Synthetic peptide
  XenD22203 vlCDR1
KSSQSIVHSNGNTYLE

SEQ ID NO: 42172 - protein, 7 aa, Artificial Sequence
  Description of Artificial Sequence: Synthetic peptide
  XenD22203 vlCDR2
KVSRRFS

SEQ ID NO: 42173 - protein, 9 aa, Artificial Sequence
  Description of Artificial Sequence: Synthetic peptide
  XenD22203 vlCDR3
FQGSHVPNT

SEQ ID NO: 42174 - protein, 219 aa, Artificial Sequence
  Description of Artificial Sequence: Synthetic polypeptide
  XenD22204 1C11[PD-1]_L3.190
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCMQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42175 - protein, 112 aa, Artificial Sequence
  Description of Artificial Sequence: Synthetic polypeptide
  VL of XenD22204
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCMQGSHVPNTFGGGTKVEIK

SEQ ID NO: 42176 - protein, 16 aa, Artificial Sequence
  Description of Artificial Sequence: Synthetic peptide
  XenD22204 vlCDR1
KSSQSIVHSNGNTYLE

SEQ ID NO: 42177 - protein, 7 aa, Artificial Sequence
  Description of Artificial Sequence: Synthetic peptide
  XenD22204 vlCDR2
KVSNRFS

SEQ ID NO: 42178 - protein, 9 aa, Artificial Sequence
  Description of Artificial Sequence: Synthetic peptide
  XenD22204 vlCDR3
MQGSHVPNT

SEQ ID NO: 42179 - protein, 219 aa, Artificial Sequence
  Description of Artificial Sequence: Synthetic polypeptide
  XenD22205 1C11[PD-1]_L3.191
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCEQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42180 - protein, 112 aa, Artificial Sequence
  Description of Artificial Sequence: Synthetic polypeptide
  VL of XenD22205
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCEQGSHVPNTFGGGTKVEIK

SEQ ID NO: 42181 - protein, 16 aa, Artificial Sequence
  Description of Artificial Sequence: Synthetic peptide
  XenD22205 vlCDR1
KSSQSIVHSNGNTYLE

SEQ ID NO: 42182 - protein, 7 aa, Artificial Sequence
  Description of Artificial Sequence: Synthetic peptide
  XenD22205 vlCDR2
KVSNRFS

SEQ ID NO: 42183 - protein, 9 aa, Artificial Sequence
  Description of Artificial Sequence: Synthetic peptide
  XenD22205 vlCDR3
EQGSHVPNT

SEQ ID NO: 42184 - protein, 219 aa, Artificial Sequence
  Description of Artificial Sequence: Synthetic polypeptide
  XenD22206 1C11[PD-1]_L3.192
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQASHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42185 - protein, 112 aa, Artificial Sequence
  Description of Artificial Sequence: Synthetic polypeptide
  VL of XenD22206
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQASHVPNTFGGGTKVEIK

SEQ ID NO: 42186 - protein, 16 aa, Artificial Sequence
  Description of Artificial Sequence: Synthetic peptide
  XenD22206 vlCDR1
KSSQSIVHSNGNTYLE

SEQ ID NO: 42187 - protein, 7 aa, Artificial Sequence
  Description of Artificial Sequence: Synthetic peptide
  XenD22206 vlCDR2
KVSNRFS

SEQ ID NO: 42188 - protein, 9 aa, Artificial Sequence
  Description of Artificial Sequence: Synthetic peptide
  XenD22206 vlCDR3
FQASHVPNT

SEQ ID NO: 42189 - protein, 219 aa, Artificial Sequence
  Description of Artificial Sequence: Synthetic polypeptide
  XenD22207 1C11[PD-1]_L3.193
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQSSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42190 - protein, 112 aa, Artificial Sequence
  Description of Artificial Sequence: Synthetic polypeptide
  VL of XenD22207
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQSSHVPNTFGGGTKVEIK

SEQ ID NO: 42191 - protein, 16 aa, Artificial Sequence
  Description of Artificial Sequence: Synthetic peptide
  XenD22207 vlCDR1
KSSQSIVHSNGNTYLE

SEQ ID NO: 42192 - protein, 7 aa, Artificial Sequence
  Description of Artificial Sequence: Synthetic peptide
  XenD22207 vlCDR2
KVSNRFS

SEQ ID NO: 42193 - protein, 9 aa, Artificial Sequence
  Description of Artificial Sequence: Synthetic peptide
  XenD22207 vlCDR3
FQSSHVPNT

SEQ ID NO: 42194 - protein, 219 aa, Artificial Sequence
  Description of Artificial Sequence: Synthetic polypeptide
  XenD22208 1C11[PD-1]_L3.194
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQDSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42195 - protein, 112 aa, Artificial Sequence
  Description of Artificial Sequence: Synthetic polypeptide
  VL of XenD22208
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQDSHVPNTFGGGTKVEIK

SEQ ID NO: 42196 - protein, 16 aa, Artificial Sequence
  Description of Artificial Sequence: Synthetic peptide
  XenD22208 vlCDR1
KSSQSIVHSNGNTYLE

SEQ ID NO: 42197 - protein, 7 aa, Artificial Sequence
  Description of Artificial Sequence: Synthetic peptide
  XenD22208 vlCDR2
KVSNRFS

SEQ ID NO: 42198 - protein, 9 aa, Artificial Sequence
  Description of Artificial Sequence: Synthetic peptide
  XenD22208 vlCDR3
FQDSHVPNT

SEQ ID NO: 42199 - protein, 219 aa, Artificial Sequence
  Description of Artificial Sequence: Synthetic polypeptide
  XenD22209 1C11[PD-1]_L3.195
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQTSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42200 - protein, 112 aa, Artificial Sequence
  Description of Artificial Sequence: Synthetic polypeptide
  VL of XenD22209
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQTSHVPNTFGGGTKVEIK

SEQ ID NO: 42201 - protein, 16 aa, Artificial Sequence
  Description of Artificial Sequence: Synthetic peptide
  XenD22209 vlCDR1
KSSQSIVHSNGNTYLE

SEQ ID NO: 42202 - protein, 7 aa, Artificial Sequence
  Description of Artificial Sequence: Synthetic peptide
  XenD22209 vlCDR2
KVSNRFS

SEQ ID NO: 42203 - protein, 9 aa, Artificial Sequence
  Description of Artificial Sequence: Synthetic peptide
  XenD22209 vlCDR3
FQTSHVPNT

SEQ ID NO: 42204 - protein, 219 aa, Artificial Sequence
  Description of Artificial Sequence: Synthetic polypeptide
  XenD22210 1C11[PD-1]_L3.196
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQQSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42205 - protein, 112 aa, Artificial Sequence
  Description of Artificial Sequence: Synthetic polypeptide
  VL of XenD22210
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQQSHVPNTFGGGTKVEIK

SEQ ID NO: 42206 - protein, 16 aa, Artificial Sequence
  Description of Artificial Sequence: Synthetic peptide
  XenD22210 vlCDR1
KSSQSIVHSNGNTYLE

SEQ ID NO: 42207 - protein, 7 aa, Artificial Sequence
  Description of Artificial Sequence: Synthetic peptide
  XenD22210 vlCDR2
KVSNRFS

SEQ ID NO: 42208 - protein, 9 aa, Artificial Sequence
  Description of Artificial Sequence: Synthetic peptide
  XenD22210 vlCDR3
FQQSHVPNT

SEQ ID NO: 42209 - protein, 219 aa, Artificial Sequence
  Description of Artificial Sequence: Synthetic polypeptide
  XenD22211 1C11[PD-1]_L3.197
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQHSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42210 - protein, 112 aa, Artificial Sequence
  Description of Artificial Sequence: Synthetic polypeptide
  VL of XenD22211
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQHSHVPNTFGGGTKVEIK

SEQ ID NO: 42211 - protein, 16 aa, Artificial Sequence
  Description of Artificial Sequence: Synthetic peptide
  XenD22211 vlCDR1
KSSQSIVHSNGNTYLE

SEQ ID NO: 42212 - protein, 7 aa, Artificial Sequence
  Description of Artificial Sequence: Synthetic peptide
  XenD22211 vlCDR2
KVSNRFS

SEQ ID NO: 42213 - protein, 9 aa, Artificial Sequence
  Description of Artificial Sequence: Synthetic peptide
  XenD22211 vlCDR3
FQHSHVPNT

SEQ ID NO: 42214 - protein, 219 aa, Artificial Sequence
  Description of Artificial Sequence: Synthetic polypeptide
  XenD22212 1C11[PD-1]_L3.198
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQLSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42215 - protein, 112 aa, Artificial Sequence
  Description of Artificial Sequence: Synthetic polypeptide
  VL of XenD22212
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQLSHVPNTFGGGTKVEIK

SEQ ID NO: 42216 - protein, 16 aa, Artificial Sequence
  Description of Artificial Sequence: Synthetic peptide
  XenD22212 vlCDR1
KSSQSIVHSNGNTYLE

SEQ ID NO: 42217 - protein, 7 aa, Artificial Sequence
  Description of Artificial Sequence: Synthetic peptide
  XenD22212 vlCDR2
KVSNRFS

SEQ ID NO: 42218 - protein, 9 aa, Artificial Sequence
  Description of Artificial Sequence: Synthetic peptide
  XenD22212 vlCDR3
FQLSHVPNT

SEQ ID NO: 42219 - protein, 219 aa, Artificial Sequence
  Description of Artificial Sequence: Synthetic polypeptide
  XenD22213 1C11[PD-1]_L3.199
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQRSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42220 - protein, 112 aa, Artificial Sequence
  Description of Artificial Sequence: Synthetic polypeptide
  VL of XenD22213
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQRSHVPNTFGGGTKVEIK

SEQ ID NO: 42221 - protein, 16 aa, Artificial Sequence
  Description of Artificial Sequence: Synthetic peptide
  XenD22213 vlCDR1
KSSQSIVHSNGNTYLE

SEQ ID NO: 42222 - protein, 7 aa, Artificial Sequence
  Description of Artificial Sequence: Synthetic peptide
  XenD22213 vlCDR2
KVSNRFS

SEQ ID NO: 42223 - protein, 9 aa, Artificial Sequence
  Description of Artificial Sequence: Synthetic peptide
  XenD22213 vlCDR3
FQRSHVPNT

SEQ ID NO: 42224 - protein, 219 aa, Artificial Sequence
  Description of Artificial Sequence: Synthetic polypeptide
  XenD22214 1C11[PD-1]_L3.200
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQFSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42225 - protein, 112 aa, Artificial Sequence
  Description of Artificial Sequence: Synthetic polypeptide
  VL of XenD22214
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQFSHVPNTFGGGTKVEIK

SEQ ID NO: 42226 - protein, 16 aa, Artificial Sequence
  Description of Artificial Sequence: Synthetic peptide
  XenD22214 vlCDR1
KSSQSIVHSNGNTYLE

SEQ ID NO: 42227 - protein, 7 aa, Artificial Sequence
  Description of Artificial Sequence: Synthetic peptide
  XenD22214 vlCDR2
KVSNRFS

SEQ ID NO: 42228 - protein, 9 aa, Artificial Sequence
  Description of Artificial Sequence: Synthetic peptide
  XenD22214 vlCDR3
FQFSHVPNT

SEQ ID NO: 42229 - protein, 219 aa, Artificial Sequence
  Description of Artificial Sequence: Synthetic polypeptide
  XenD22215 1C11[PD-1]_L3.201
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGTHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42230 - protein, 112 aa, Artificial Sequence
  Description of Artificial Sequence: Synthetic polypeptide
  VL of XenD22215
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGTHVPNTFGGGTKVEIK

SEQ ID NO: 42231 - protein, 16 aa, Artificial Sequence
  Description of Artificial Sequence: Synthetic peptide
  XenD22215 vlCDR1
KSSQSIVHSNGNTYLE

SEQ ID NO: 42232 - protein, 7 aa, Artificial Sequence
  Description of Artificial Sequence: Synthetic peptide
  XenD22215 vlCDR2
KVSNRFS

SEQ ID NO: 42233 - protein, 9 aa, Artificial Sequence
  Description of Artificial Sequence: Synthetic peptide
  XenD22215 vlCDR3
FQGTHVPNT

SEQ ID NO: 42234 - protein, 219 aa, Artificial Sequence
  Description of Artificial Sequence: Synthetic polypeptide
  XenD22216 1C11[PD-1]_L3.202
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGAHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42235 - protein, 112 aa, Artificial Sequence
  Description of Artificial Sequence: Synthetic polypeptide
  VL of XenD22216
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGAHVPNTFGGGTKVEIK

SEQ ID NO: 42236 - protein, 16 aa, Artificial Sequence
  Description of Artificial Sequence: Synthetic peptide
  XenD22216 vlCDR1
KSSQSIVHSNGNTYLE

SEQ ID NO: 42237 - protein, 7 aa, Artificial Sequence
  Description of Artificial Sequence: Synthetic peptide
  XenD22216 vlCDR2
KVSNRFS

SEQ ID NO: 42238 - protein, 9 aa, Artificial Sequence
  Description of Artificial Sequence: Synthetic peptide
  XenD22216 vlCDR3
FQGAHVPNT

SEQ ID NO: 42239 - protein, 219 aa, Artificial Sequence
  Description of Artificial Sequence: Synthetic polypeptide
  XenD22217 1C11[PD-1]_L3.203
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGQHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42240 - protein, 112 aa, Artificial Sequence
  Description of Artificial Sequence: Synthetic polypeptide
  VL of XenD22217
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGQHVPNTFGGGTKVEIK

SEQ ID NO: 42241 - protein, 16 aa, Artificial Sequence
  Description of Artificial Sequence: Synthetic peptide
  XenD22217 vlCDR1
KSSQSIVHSNGNTYLE

SEQ ID NO: 42242 - protein, 7 aa, Artificial Sequence
  Description of Artificial Sequence: Synthetic peptide
  XenD22217 vlCDR2
KVSNRFS

SEQ ID NO: 42243 - protein, 9 aa, Artificial Sequence
  Description of Artificial Sequence: Synthetic peptide
  XenD22217 vlCDR3
FQGQHVPNT

SEQ ID NO: 42244 - protein, 219 aa, Artificial Sequence
  Description of Artificial Sequence: Synthetic polypeptide
  XenD22218 1C11[PD-1]_L3.204
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGVHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42245 - protein, 112 aa, Artificial Sequence
  Description of Artificial Sequence: Synthetic polypeptide
  VL of XenD22218
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGVHVPNTFGGGTKVEIK

SEQ ID NO: 42246 - protein, 16 aa, Artificial Sequence
  Description of Artificial Sequence: Synthetic peptide
  XenD22218 vlCDR1
KSSQSIVHSNGNTYLE

SEQ ID NO: 42247 - protein, 7 aa, Artificial Sequence
  Description of Artificial Sequence: Synthetic peptide
  XenD22218 vlCDR2
KVSNRFS

SEQ ID NO: 42248 - protein, 9 aa, Artificial Sequence
  Description of Artificial Sequence: Synthetic peptide
  XenD22218 vlCDR3
FQGVHVPNT

SEQ ID NO: 42249 - protein, 219 aa, Artificial Sequence
  Description of Artificial Sequence: Synthetic polypeptide
  XenD22219 1C11[PD-1]_L3.205
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSYVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42250 - protein, 112 aa, Artificial Sequence
  Description of Artificial Sequence: Synthetic polypeptide
  VL of XenD22219
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSYVPNTFGGGTKVEIK

SEQ ID NO: 42251 - protein, 16 aa, Artificial Sequence
  Description of Artificial Sequence: Synthetic peptide
  XenD22219 vlCDR1
KSSQSIVHSNGNTYLE

SEQ ID NO: 42252 - protein, 7 aa, Artificial Sequence
  Description of Artificial Sequence: Synthetic peptide
  XenD22219 vlCDR2
KVSNRFS

SEQ ID NO: 42253 - protein, 9 aa, Artificial Sequence
  Description of Artificial Sequence: Synthetic peptide
  XenD22219 vlCDR3
FQGSYVPNT

SEQ ID NO: 42254 - protein, 219 aa, Artificial Sequence
  Description of Artificial Sequence: Synthetic polypeptide
  XenD22220 1C11[PD-1]_L3.206
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSQVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42255 - protein, 112 aa, Artificial Sequence
  Description of Artificial Sequence: Synthetic polypeptide
  VL of XenD22220
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSQVPNTFGGGTKVEIK

SEQ ID NO: 42256 - protein, 16 aa, Artificial Sequence
  Description of Artificial Sequence: Synthetic peptide
  XenD22220 vlCDR1
KSSQSIVHSNGNTYLE

SEQ ID NO: 42257 - protein, 7 aa, Artificial Sequence
  Description of Artificial Sequence: Synthetic peptide
  XenD22220 vlCDR2
KVSNRFS

SEQ ID NO: 42258 - protein, 9 aa, Artificial Sequence
  Description of Artificial Sequence: Synthetic peptide
  XenD22220 vlCDR3
FQGSQVPNT

SEQ ID NO: 42259 - protein, 219 aa, Artificial Sequence
  Description of Artificial Sequence: Synthetic polypeptide
  XenD22221 1C11[PD-1]_L3.207
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSDVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42260 - protein, 112 aa, Artificial Sequence
  Description of Artificial Sequence: Synthetic polypeptide
  VL of XenD22221
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSDVPNTFGGGTKVEIK

SEQ ID NO: 42261 - protein, 16 aa, Artificial Sequence
  Description of Artificial Sequence: Synthetic peptide
  XenD22221 vlCDR1
KSSQSIVHSNGNTYLE

SEQ ID NO: 42262 - protein, 7 aa, Artificial Sequence
  Description of Artificial Sequence: Synthetic peptide
  XenD22221 vlCDR2
KVSNRFS

SEQ ID NO: 42263 - protein, 9 aa, Artificial Sequence
  Description of Artificial Sequence: Synthetic peptide
  XenD22221 vlCDR3
FQGSDVPNT

SEQ ID NO: 42264 - protein, 219 aa, Artificial Sequence
  Description of Artificial Sequence: Synthetic polypeptide
  XenD22222 1C11[PD-1]_L3.208
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSFVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42265 - protein, 112 aa, Artificial Sequence
  Description of Artificial Sequence: Synthetic polypeptide
  VL of XenD22222
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSFVPNTFGGGTKVEIK

SEQ ID NO: 42266 - protein, 16 aa, Artificial Sequence
  Description of Artificial Sequence: Synthetic peptide
  XenD22222 vlCDR1
KSSQSIVHSNGNTYLE

SEQ ID NO: 42267 - protein, 7 aa, Artificial Sequence
  Description of Artificial Sequence: Synthetic peptide
  XenD22222 vlCDR2
KVSNRFS

SEQ ID NO: 42268 - protein, 9 aa, Artificial Sequence
  Description of Artificial Sequence: Synthetic peptide
  XenD22222 vlCDR3
FQGSFVPNT

SEQ ID NO: 42269 - protein, 219 aa, Artificial Sequence
  Description of Artificial Sequence: Synthetic polypeptide
  XenD22223 1C11[PD-1]_L3.209
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSTVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42270 - protein, 112 aa, Artificial Sequence
  Description of Artificial Sequence: Synthetic polypeptide
  VL of XenD22223
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSTVPNTFGGGTKVEIK

SEQ ID NO: 42271 - protein, 16 aa, Artificial Sequence
  Description of Artificial Sequence: Synthetic peptide
  XenD22223 vlCDR1
KSSQSIVHSNGNTYLE

SEQ ID NO: 42272 - protein, 7 aa, Artificial Sequence
  Description of Artificial Sequence: Synthetic peptide
  XenD22223 vlCDR2
KVSNRFS

SEQ ID NO: 42273 - protein, 9 aa, Artificial Sequence
  Description of Artificial Sequence: Synthetic peptide
  XenD22223 vlCDR3
FQGSTVPNT

SEQ ID NO: 42274 - protein, 446 aa, Artificial Sequence; identical to SEQ ID NO: 41639
  Description of Artificial Sequence: Synthetic polypeptide
  XENP026917 1C11[PD-1]_H3.244_L3_IgG1_PVA_/S267K Heavy Chain

SEQ ID NO: 42275 - protein, 117 aa, Artificial Sequence; identical to SEQ ID NO: 41640
  Description of Artificial Sequence: Synthetic polypeptide
  VH of XENP026917

SEQ ID NO: 42276 - protein, 5 aa, Artificial Sequence
  Description of Artificial Sequence: Synthetic peptide
  XENP026917 vhCDR1
HYGMN

SEQ ID NO: 42277 - protein, 17 aa, Artificial Sequence
  Description of Artificial Sequence: Synthetic peptide
  XENP026917 vhCDR2
WINTYTGEPTYADGFTG

SEQ ID NO: 42278 - protein, 8 aa, Artificial Sequence
  Description of Artificial Sequence: Synthetic peptide
  XENP026917 vhCDR3
DYYGSSPY

SEQ ID NO: 42279 - protein, 219 aa, Artificial Sequence; identical to SEQ ID NO: 33008
  Description of Artificial Sequence: Synthetic polypeptide
  XENP026917 1C11[PD-1]_H3.244_L3_IgG1_PVA_/S267K Light Chain

SEQ ID NO: 42280 - protein, 112 aa, Artificial Sequence; identical to SEQ ID NO: 33009
  Description of Artificial Sequence: Synthetic polypeptide
  VL of XENP026917

SEQ ID NO: 42281 - protein, 16 aa, Artificial Sequence
  Description of Artificial Sequence: Synthetic peptide
  XENP026917 vlCDR1
KSSQSIVHSNGNTYLE

SEQ ID NO: 42282 - protein, 7 aa, Artificial Sequence
  Description of Artificial Sequence: Synthetic peptide
  XENP026917 vlCDR2
KVSNRFS

SEQ ID NO: 42283 - protein, 9 aa, Artificial Sequence
  Description of Artificial Sequence: Synthetic peptide
  XENP026917 vlCDR3
FQGSHVPNT

SEQ ID NO: 42284 - protein, 446 aa, Artificial Sequence; identical to SEQ ID NO: 41664
  Description of Artificial Sequence: Synthetic polypeptide
  XENP026918 1C11[PD-1]_H3.249_L3_IgG1_PVA_/S267K Heavy Chain

SEQ ID NO: 42285 - protein, 117 aa, Artificial Sequence; identical to SEQ ID NO: 41665
  Description of Artificial Sequence: Synthetic polypeptide
  VH of XENP026918

SEQ ID NO: 42286 - protein, 5 aa, Artificial Sequence
  Description of Artificial Sequence: Synthetic peptide
  XENP026918 vhCDR1
HYGMN

SEQ ID NO: 42287 - protein, 17 aa, Artificial Sequence
  Description of Artificial Sequence: Synthetic peptide
  XENP026918 vhCDR2
WINTYTGEPTYADGFTG

SEQ ID NO: 42288 - protein, 8 aa, Artificial Sequence
  Description of Artificial Sequence: Synthetic peptide
  XENP026918 vhCDR3
DYYGSSPY

SEQ ID NO: 42289 - protein, 219 aa, Artificial Sequence; identical to SEQ ID NO: 33008
  Description of Artificial Sequence: Synthetic polypeptide
  XENP026918 1C11[PD-1]_H3.249_L3_IgG1_PVA_/S267K Light Chain

SEQ ID NO: 42290 - protein, 112 aa, Artificial Sequence; identical to SEQ ID NO: 33009
  Description of Artificial Sequence: Synthetic polypeptide
  VL of XENP026918

SEQ ID NO: 42291 - protein, 16 aa, Artificial Sequence
  Description of Artificial Sequence: Synthetic peptide
  XENP026918 vlCDR1
KSSQSIVHSNGNTYLE

SEQ ID NO: 42292 - protein, 7 aa, Artificial Sequence
  Description of Artificial Sequence: Synthetic peptide
  XENP026918 vlCDR2
KVSNRFS

SEQ ID NO: 42293 - protein, 9 aa, Artificial Sequence
  Description of Artificial Sequence: Synthetic peptide
  XENP026918 vlCDR3
FQGSHVPNT

SEQ ID NO: 42294 - protein, 446 aa, Artificial Sequence; identical to SEQ ID NO: 41669
  Description of Artificial Sequence: Synthetic polypeptide
  XENP026919 1C11[PD-1]_H3.250_L3_IgG1_PVA_/S267K Heavy Chain

SEQ ID NO: 42295 - protein, 117 aa, Artificial Sequence; identical to SEQ ID NO: 41670
  Description of Artificial Sequence: Synthetic polypeptide
  VH of XENP026919

SEQ ID NO: 42296 - protein, 5 aa, Artificial Sequence
  Description of Artificial Sequence: Synthetic peptide
  XENP026919 vhCDR1
HYGMN

SEQ ID NO: 42297 - protein, 17 aa, Artificial Sequence
  Description of Artificial Sequence: Synthetic peptide
  XENP026919 vhCDR2
WINTYTGEPTYADGFTG

SEQ ID NO: 42298 - protein, 8 aa, Artificial Sequence
  Description of Artificial Sequence: Synthetic peptide
  XENP026919 vhCDR3
DYYGSSPY

SEQ ID NO: 42299 - protein, 219 aa, Artificial Sequence; identical to SEQ ID NO: 33008
  Description of Artificial Sequence: Synthetic polypeptide
  XENP026919 1C11[PD-1]_H3.250_L3_IgG1_PVA_/S267K Light Chain

SEQ ID NO: 42300 - protein, 112 aa, Artificial Sequence; identical to SEQ ID NO: 33009
  Description of Artificial Sequence: Synthetic polypeptide
  VL of XENP026919

SEQ ID NO: 42301 - protein, 16 aa, Artificial Sequence
  Description of Artificial Sequence: Synthetic peptide
  XENP026919 vlCDR1
KSSQSIVHSNGNTYLE

SEQ ID NO: 42302 - protein, 7 aa, Artificial Sequence
  Description of Artificial Sequence: Synthetic peptide
  XENP026919 vlCDR2
KVSNRFS

SEQ ID NO: 42303 - protein, 9 aa, Artificial Sequence
  Description of Artificial Sequence: Synthetic peptide
  XENP026919 vlCDR3
FQGSHVPNT

SEQ ID NO: 42304 - protein, 446 aa, Artificial Sequence; identical to SEQ ID NO: 41699
  Description of Artificial Sequence: Synthetic polypeptide
  XENP026920 1C11[PD-1]_H3.256_L3_IgG1_PVA_/S267K Heavy Chain

SEQ ID NO: 42305 - protein, 117 aa, Artificial Sequence; identical to SEQ ID NO: 41700
  Description of Artificial Sequence: Synthetic polypeptide
  VH of XENP026920

SEQ ID NO: 42306 - protein, 5 aa, Artificial Sequence
  Description of Artificial Sequence: Synthetic peptide
  XENP026920 vhCDR1
HYGMN

SEQ ID NO: 42307 - protein, 17 aa, Artificial Sequence
  Description of Artificial Sequence: Synthetic peptide
  XENP026920 vhCDR2
WINTYTGEPTYADGFTG

SEQ ID NO: 42308 - protein, 8 aa, Artificial Sequence
  Description of Artificial Sequence: Synthetic peptide
  XENP026920 vhCDR3
DYYGSSPY

SEQ ID NO: 42309 - protein, 219 aa, Artificial Sequence; identical to SEQ ID NO: 33008
  Description of Artificial Sequence: Synthetic polypeptide
  XENP026920 1C11[PD-1]_H3.256_L3_IgG1_PVA_/S267K Light Chain

SEQ ID NO: 42310 - protein, 112 aa, Artificial Sequence; identical to SEQ ID NO: 33009
  Description of Artificial Sequence: Synthetic polypeptide
  VL of XENP026920

SEQ ID NO: 42311 - protein, 16 aa, Artificial Sequence
  Description of Artificial Sequence: Synthetic peptide
  XENP026920 vlCDR1
KSSQSIVHSNGNTYLE

SEQ ID NO: 42312 - protein, 7 aa, Artificial Sequence
  Description of Artificial Sequence: Synthetic peptide
  XENP026920 vlCDR2
KVSNRFS

SEQ ID NO: 42313 - protein, 9 aa, Artificial Sequence
  Description of Artificial Sequence: Synthetic peptide
  XENP026920 vlCDR3
FQGSHVPNT

SEQ ID NO: 42314 - protein, 446 aa, Artificial Sequence; identical to SEQ ID NO: 41709
  Description of Artificial Sequence: Synthetic polypeptide
  XENP026921 1C11[PD-1]_H3.258_L3_IgG1_PVA_/S267K Heavy Chain

SEQ ID NO: 42315 - protein, 117 aa, Artificial Sequence; identical to SEQ ID NO: 41710
  Description of Artificial Sequence: Synthetic polypeptide
  VH of XENP026921

SEQ ID NO: 42316 - protein, 5 aa, Artificial Sequence
  Description of Artificial Sequence: Synthetic peptide
  XENP026921 vhCDR1
HYGMN

SEQ ID NO: 42317 - protein, 17 aa, Artificial Sequence
  Description of Artificial Sequence: Synthetic peptide
  XENP026921 vhCDR2
WINTYTGEPTYADGFTG

SEQ ID NO: 42318 - protein, 8 aa, Artificial Sequence
  Description of Artificial Sequence: Synthetic peptide
  XENP026921 vhCDR3
DYYGSSPY

SEQ ID NO: 42319 - protein, 219 aa, Artificial Sequence; identical to SEQ ID NO: 33008
  Description of Artificial Sequence: Synthetic polypeptide
  XENP026921 1C11[PD-1]_H3.258_L3_IgG1_PVA_/S267K Light Chain

SEQ ID NO: 42320 - protein, 112 aa, Artificial Sequence; identical to SEQ ID NO: 33009
  Description of Artificial Sequence: Synthetic polypeptide
  VL of XENP026921

SEQ ID NO: 42321 - protein, 16 aa, Artificial Sequence
  Description of Artificial Sequence: Synthetic peptide
  XENP026921 vlCDR1
KSSQSIVHSNGNTYLE

SEQ ID NO: 42322 - protein, 7 aa, Artificial Sequence
  Description of Artificial Sequence: Synthetic peptide
  XENP026921 vlCDR2
KVSNRFS

SEQ ID NO: 42323 - protein, 9 aa, Artificial Sequence
  Description of Artificial Sequence: Synthetic peptide
  XENP026921 vlCDR3
FQGSHVPNT

SEQ ID NO: 42324 - protein, 446 aa, Artificial Sequence; identical to SEQ ID NO: 41859
  Description of Artificial Sequence: Synthetic polypeptide
  XENP026922 1C11[PD-1]_H3.288_L3_IgG1_PVA_/S267K Heavy Chain

SEQ ID NO: 42325 - protein, 117 aa, Artificial Sequence; identical to SEQ ID NO: 41860
  Description of Artificial Sequence: Synthetic polypeptide
  VH of XENP026922

SEQ ID NO: 42326 - protein, 5 aa, Artificial Sequence
  Description of Artificial Sequence: Synthetic peptide
  XENP026922 vhCDR1
HYGMN

SEQ ID NO: 42327 - protein, 17 aa, Artificial Sequence
  Description of Artificial Sequence: Synthetic peptide
  XENP026922 vhCDR2
WINTHTGEPTYADGFTG

SEQ ID NO: 42328 - protein, 8 aa, Artificial Sequence
  Description of Artificial Sequence: Synthetic peptide
  XENP026922 vhCDR3
DYYGSSPY

SEQ ID NO: 42329 - protein, 219 aa, Artificial Sequence; identical to SEQ ID NO: 33008
  Description of Artificial Sequence: Synthetic polypeptide
  XENP026922 1C11[PD-1]_H3.288_L3_IgG1_PVA_/S267K Light Chain

SEQ ID NO: 42330 - protein, 112 aa, Artificial Sequence; identical to SEQ ID NO: 33009
  Description of Artificial Sequence: Synthetic polypeptide
  VL of XENP026922

SEQ ID NO: 42331 - protein, 16 aa, Artificial Sequence
  Description of Artificial Sequence: Synthetic peptide
  XENP026922 vlCDR1
KSSQSIVHSNGNTYLE

SEQ ID NO: 42332 - protein, 7 aa, Artificial Sequence
  Description of Artificial Sequence: Synthetic peptide
  XENP026922 vlCDR2
KVSNRFS

SEQ ID NO: 42333 - protein, 9 aa, Artificial Sequence
  Description of Artificial Sequence: Synthetic peptide
  XENP026922 vlCDR3
FQGSHVPNT

SEQ ID NO: 42334 - protein, 446 aa, Artificial Sequence; identical to SEQ ID NO: 41879
  Description of Artificial Sequence: Synthetic polypeptide
  XENP026923 1C11[PD-1]_H3.292_L3_IgG1_PVA_/S267K Heavy Chain

SEQ ID NO: 42335 - protein, 117 aa, Artificial Sequence; identical to SEQ ID NO: 41880
  Description of Artificial Sequence: Synthetic polypeptide
  VH of XENP026923

SEQ ID NO: 42336 - protein, 5 aa, Artificial Sequence
  Description of Artificial Sequence: Synthetic peptide
  XENP026923 vhCDR1
HYGMN

SEQ ID NO: 42337 - protein, 17 aa, Artificial Sequence
  Description of Artificial Sequence: Synthetic peptide
  XENP026923 vhCDR2
WINTYSGEPTYADGFTG

SEQ ID NO: 42338 - protein, 8 aa, Artificial Sequence
  Description of Artificial Sequence: Synthetic peptide
  XENP026923 vhCDR3
DYYGSSPY

SEQ ID NO: 42339 - protein, 219 aa, Artificial Sequence; identical to SEQ ID NO: 33008
  Description of Artificial Sequence: Synthetic polypeptide
  XENP026923 1C11[PD-1]_H3.292_L3_IgG1_PVA_/S267K Light Chain

SEQ ID NO: 42340 - protein, 112 aa, Artificial Sequence; identical to SEQ ID NO: 33009
  Description of Artificial Sequence: Synthetic polypeptide
  VL of XENP026923

SEQ ID NO: 42341 - protein, 16 aa, Artificial Sequence
  Description of Artificial Sequence: Synthetic peptide
  XENP026923 vlCDR1
KSSQSIVHSNGNTYLE

SEQ ID NO: 42342 - protein, 7 aa, Artificial Sequence
  Description of Artificial Sequence: Synthetic peptide
  XENP026923 vlCDR2
KVSNRFS

SEQ ID NO: 42343 - protein, 9 aa, Artificial Sequence
  Description of Artificial Sequence: Synthetic peptide
  XENP026923 vlCDR3
FQGSHVPNT

SEQ ID NO: 42344 - protein, 446 aa, Artificial Sequence; identical to SEQ ID NO: 41934
  Description of Artificial Sequence: Synthetic polypeptide
  XENP026924 1C11[PD-1]_H3.303_L3_IgG1_PVA_/S267K Heavy Chain

SEQ ID NO: 42345 - protein, 117 aa, Artificial Sequence; identical to SEQ ID NO: 41935
  Description of Artificial Sequence: Synthetic polypeptide
  VH of XENP026924

SEQ ID NO: 42346 - protein, 5 aa, Artificial Sequence
  Description of Artificial Sequence: Synthetic peptide
  XENP026924 vhCDR1
HYGMN

SEQ ID NO: 42347 - protein, 17 aa, Artificial Sequence
  Description of Artificial Sequence: Synthetic peptide
  XENP026924 vhCDR2
WINTYTGEPTYADGFTG

SEQ ID NO: 42348 - protein, 8 aa, Artificial Sequence
  Description of Artificial Sequence: Synthetic peptide
  XENP026924 vhCDR3
DYFGSSPY

SEQ ID NO: 42349 - protein, 219 aa, Artificial Sequence; identical to SEQ ID NO: 33008
  Description of Artificial Sequence: Synthetic polypeptide
  XENP026924 1C11[PD-1]_H3.303_L3_IgG1_PVA_/S267K Light Chain

SEQ ID NO: 42350 - protein, 112 aa, Artificial Sequence; identical to SEQ ID NO: 33009
  Description of Artificial Sequence: Synthetic polypeptide
  VL of XENP026924

SEQ ID NO: 42351 - protein, 16 aa, Artificial Sequence
  Description of Artificial Sequence: Synthetic peptide
  XENP026924 vlCDR1
KSSQSIVHSNGNTYLE

SEQ ID NO: 42352 - protein, 7 aa, Artificial Sequence
  Description of Artificial Sequence: Synthetic peptide
  XENP026924 vlCDR2
KVSNRFS

SEQ ID NO: 42353 - protein, 9 aa, Artificial Sequence
  Description of Artificial Sequence: Synthetic peptide
  XENP026924 vlCDR3
FQGSHVPNT

SEQ ID NO: 42354 - protein, 446 aa, Artificial Sequence; identical to SEQ ID NO: 39254
  Description of Artificial Sequence: Synthetic polypeptide
  XENP026925 1C11[PD-1]_H3_L3.149_IgG1_PVA_/S267K Heavy Chain

SEQ ID NO: 42355 - protein, 117 aa, Artificial Sequence; identical to SEQ ID NO: 33034
  Description of Artificial Sequence: Synthetic polypeptide
  VH of XENP026925

SEQ ID NO: 42356 - protein, 5 aa, Artificial Sequence
  Description of Artificial Sequence: Synthetic peptide
  XENP026925 vhCDR1
HYGMN

SEQ ID NO: 42357 - protein, 17 aa, Artificial Sequence
  Description of Artificial Sequence: Synthetic peptide
  XENP026925 vhCDR2
WINTYTGEPTYADGFTG

SEQ ID NO: 42358 - protein, 8 aa, Artificial Sequence
  Description of Artificial Sequence: Synthetic peptide
  XENP026925 vhCDR3
DYYGSSPY

SEQ ID NO: 42359 - protein, 219 aa, Artificial Sequence; identical to SEQ ID NO: 41969
  Description of Artificial Sequence: Synthetic polypeptide
  XENP026925 1C11[PD-1]_H3_L3.149_IgG1_PVA_/S267K Light Chain

SEQ ID NO: 42360 - protein, 112 aa, Artificial Sequence; identical to SEQ ID NO: 41970
  Description of Artificial Sequence: Synthetic polypeptide
  VL of XENP026925

SEQ ID NO: 42361 - protein, 16 aa, Artificial Sequence
  Description of Artificial Sequence: Synthetic peptide
  XENP026925 vlCDR1
KSSQSIVYSNGNTYLE

SEQ ID NO: 42362 - protein, 7 aa, Artificial Sequence
  Description of Artificial Sequence: Synthetic peptide
  XENP026925 vlCDR2
KVSNRFS

SEQ ID NO: 42363 - protein, 9 aa, Artificial Sequence
  Description of Artificial Sequence: Synthetic peptide
  XENP026925 vlCDR3
FQGSHVPNT

SEQ ID NO: 42364 - protein, 446 aa, Artificial Sequence; identical to SEQ ID NO: 39254
  Description of Artificial Sequence: Synthetic polypeptide
  XENP026926 1C11[PD-1]_H3_L3.152_IgG1_PVA_/S267K Heavy Chain

SEQ ID NO: 42365 - protein, 117 aa, Artificial Sequence; identical to SEQ ID NO: 33034
  Description of Artificial Sequence: Synthetic polypeptide
  VH of XENP026926

SEQ ID NO: 42366 - protein, 5 aa, Artificial Sequence
  Description of Artificial Sequence: Synthetic peptide
  XENP026926 vhCDR1
HYGMN

SEQ ID NO: 42367 - protein, 17 aa, Artificial Sequence
  Description of Artificial Sequence: Synthetic peptide
  XENP026926 vhCDR2
WINTYTGEPTYADGFTG

SEQ ID NO: 42368 - protein, 8 aa, Artificial Sequence
  Description of Artificial Sequence: Synthetic peptide
  XENP026926 vhCDR3
DYYGSSPY

SEQ ID NO: 42369 - protein, 219 aa, Artificial Sequence; identical to SEQ ID NO: 41984
  Description of Artificial Sequence: Synthetic polypeptide
  XENP026926 1C11[PD-1]_H3_L3.152_IgG1_PVA_/S267K Light Chain

SEQ ID NO: 42370 - protein, 112 aa, Artificial Sequence; identical to SEQ ID NO: 41985
  Description of Artificial Sequence: Synthetic polypeptide
  VL of XENP026926

SEQ ID NO: 42371 - protein, 16 aa, Artificial Sequence
  Description of Artificial Sequence: Synthetic peptide
  XENP026926 vlCDR1
KSSQSIVFSNGNTYLE

SEQ ID NO: 42372 - protein, 7 aa, Artificial Sequence
  Description of Artificial Sequence: Synthetic peptide
  XENP026926 vlCDR2
KVSNRFS

SEQ ID NO: 42373 - protein, 9 aa, Artificial Sequence
  Description of Artificial Sequence: Synthetic peptide
  XENP026926 vlCDR3
FQGSHVPNT

SEQ ID NO: 42374 - protein, 446 aa, Artificial Sequence; identical to SEQ ID NO: 39254
  Description of Artificial Sequence: Synthetic polypeptide
  XENP026927 1C11[PD-1]_H3_L3.160_IgG1_PVA_/S267K Heavy Chain

SEQ ID NO: 42375 - protein, 117 aa, Artificial Sequence; identical to SEQ ID NO: 33034
  Description of Artificial Sequence: Synthetic polypeptide
  VH of XENP026927

SEQ ID NO: 42376 - protein, 5 aa, Artificial Sequence
  Description of Artificial Sequence: Synthetic peptide
  XENP026927 vhCDR1
HYGMN

SEQ ID NO: 42377 - protein, 17 aa, Artificial Sequence
  Description of Artificial Sequence: Synthetic peptide
  XENP026927 vhCDR2
WINTYTGEPTYADGFTG

SEQ ID NO: 42378 - protein, 8 aa, Artificial Sequence
  Description of Artificial Sequence: Synthetic peptide
  XENP026927 vhCDR3
DYYGSSPY

SEQ ID NO: 42379 - protein, 219 aa, Artificial Sequence; identical to SEQ ID NO: 42024
  Description of Artificial Sequence: Synthetic polypeptide
  XENP026927 1C11[PD-1]_H3_L3.160_IgG1_PVA_/S267K Light Chain

SEQ ID NO: 42380 - protein, 112 aa, Artificial Sequence; identical to SEQ ID NO: 42025
  Description of Artificial Sequence: Synthetic polypeptide
  VL of XENP026927

SEQ ID NO: 42381 - protein, 16 aa, Artificial Sequence
  Description of Artificial Sequence: Synthetic peptide
  XENP026927 vlCDR1
KSSQSIVHSHGNTYLE

SEQ ID NO: 42382 - protein, 7 aa, Artificial Sequence
  Description of Artificial Sequence: Synthetic peptide
  XENP026927 vlCDR2
KVSNRFS

SEQ ID NO: 42383 - protein, 9 aa, Artificial Sequence
  Description of Artificial Sequence: Synthetic peptide
  XENP026927 vlCDR3
FQGSHVPNT

SEQ ID NO: 42384 - protein, 446 aa, Artificial Sequence; identical to SEQ ID NO: 39254
  Description of Artificial Sequence: Synthetic polypeptide
  XENP026928 1C11[PD-1]_H3_L3.161_IgG1_PVA_/S267K Heavy Chain

SEQ ID NO: 42385 - protein, 117 aa, Artificial Sequence; identical to SEQ ID NO: 33034
  Description of Artificial Sequence: Synthetic polypeptide
  VH of XENP026928

SEQ ID NO: 42386 - protein, 5 aa, Artificial Sequence
  Description of Artificial Sequence: Synthetic peptide
  XENP026928 vhCDR1
HYGMN

SEQ ID NO: 42387 - protein, 17 aa, Artificial Sequence
  Description of Artificial Sequence: Synthetic peptide
  XENP026928 vhCDR2
WINTYTGEPTYADGFTG

SEQ ID NO: 42388 - protein, 8 aa, Artificial Sequence
  Description of Artificial Sequence: Synthetic peptide
  XENP026928 vhCDR3
DYYGSSPY

SEQ ID NO: 42389 - protein, 219 aa, Artificial Sequence; identical to SEQ ID NO: 42029
  Description of Artificial Sequence: Synthetic polypeptide
  XENP026928 1C11[PD-1]_H3_L3.161_IgG1_PVA_/S267K Light Chain

SEQ ID NO: 42390 - protein, 112 aa, Artificial Sequence; identical to SEQ ID NO: 42030
  Description of Artificial Sequence: Synthetic polypeptide
  VL of XENP026928

SEQ ID NO: 42391 - protein, 16 aa, Artificial Sequence
  Description of Artificial Sequence: Synthetic peptide
  XENP026928 vlCDR1
KSSQSIVHSEGNTYLE

SEQ ID NO: 42392 - protein, 7 aa, Artificial Sequence
  Description of Artificial Sequence: Synthetic peptide
  XENP026928 vlCDR2
KVSNRFS

SEQ ID NO: 42393 - protein, 9 aa, Artificial Sequence
  Description of Artificial Sequence: Synthetic peptide
  XENP026928 vlCDR3
FQGSHVPNT

SEQ ID NO: 42394 - protein, 446 aa, Artificial Sequence; identical to SEQ ID NO: 39254
  Description of Artificial Sequence: Synthetic polypeptide
  XENP026929 1C11[PD-1]_H3_L3.166_IgG1_PVA_/S267K Heavy Chain

SEQ ID NO: 42395 - protein, 117 aa, Artificial Sequence; identical to SEQ ID NO: 33034
  Description of Artificial Sequence: Synthetic polypeptide
  VH of XENP026929

SEQ ID NO: 42396 - protein, 5 aa, Artificial Sequence
  Description of Artificial Sequence: Synthetic peptide
  XENP026929 vhCDR1
HYGMN

SEQ ID NO: 42397 - protein, 17 aa, Artificial Sequence
  Description of Artificial Sequence: Synthetic peptide
  XENP026929 vhCDR2
WINTYTGEPTYADGFTG

SEQ ID NO: 42398 - protein, 8 aa, Artificial Sequence
  Description of Artificial Sequence: Synthetic peptide
  XENP026929 vhCDR3
DYYGSSPY

SEQ ID NO: 42399 - protein, 219 aa, Artificial Sequence; identical to SEQ ID NO: 42054
  Description of Artificial Sequence: Synthetic polypeptide
  XENP026929 1C11[PD-1]_H3_L3.166_IgG1_PVA_/S267K Light Chain

SEQ ID NO: 42400 - protein, 112 aa, Artificial Sequence; identical to SEQ ID NO: 42055
  Description of Artificial Sequence: Synthetic polypeptide
  VL of XENP026929

SEQ ID NO: 42401 - protein, 16 aa, Artificial Sequence
  Description of Artificial Sequence: Synthetic peptide
  XENP026929 vlCDR1
KSSQSIVHSNSNTYLE

SEQ ID NO: 42402 - protein, 7 aa, Artificial Sequence
  Description of Artificial Sequence: Synthetic peptide
  XENP026929 vlCDR2
KVSNRFS

SEQ ID NO: 42403 - protein, 9 aa, Artificial Sequence
  Description of Artificial Sequence: Synthetic peptide
  XENP026929 vlCDR3
FQGSHVPNT

SEQ ID NO: 42404 - protein, 446 aa, Artificial Sequence; identical to SEQ ID NO: 39254
  Description of Artificial Sequence: Synthetic polypeptide
  XENP026930 1C11[PD-1]_H3_L3.168_IgG1_PVA_/S267K Heavy Chain

SEQ ID NO: 42405 - protein, 117 aa, Artificial Sequence; identical to SEQ ID NO: 33034
  Description of Artificial Sequence: Synthetic polypeptide
  VH of XENP026930

SEQ ID NO: 42406 - protein, 5 aa, Artificial Sequence
  Description of Artificial Sequence: Synthetic peptide
  XENP026930 vhCDR1
HYGMN

SEQ ID NO: 42407 - protein, 17 aa, Artificial Sequence
  Description of Artificial Sequence: Synthetic peptide
  XENP026930 vhCDR2
WINTYTGEPTYADGFTG

SEQ ID NO: 42408 - protein, 8 aa, Artificial Sequence
  Description of Artificial Sequence: Synthetic peptide
  XENP026930 vhCDR3
DYYGSSPY

SEQ ID NO: 42409 - protein, 219 aa, Artificial Sequence; identical to SEQ ID NO: 42064
  Description of Artificial Sequence: Synthetic polypeptide
  XENP026930 1C11[PD-1]_H3_L3.168_IgG1_PVA_/S267K Light Chain

SEQ ID NO: 42410 - protein, 112 aa, Artificial Sequence; identical to SEQ ID NO: 42065
  Description of Artificial Sequence: Synthetic polypeptide
  VL of XENP026930

SEQ ID NO: 42411 - protein, 16 aa, Artificial Sequence
  Description of Artificial Sequence: Synthetic peptide
  XENP026930 vlCDR1
KSSQSIVHSNQNTYLE

SEQ ID NO: 42412 - protein, 7 aa, Artificial Sequence
  Description of Artificial Sequence: Synthetic peptide
  XENP026930 vlCDR2
KVSNRFS

SEQ ID NO: 42413 - protein, 9 aa, Artificial Sequence
  Description of Artificial Sequence: Synthetic peptide
  XENP026930 vlCDR3
FQGSHVPNT

SEQ ID NO: 42414 - protein, 446 aa, Artificial Sequence; identical to SEQ ID NO: 39254
  Description of Artificial Sequence: Synthetic polypeptide
  XENP026931 1C11[PD-1]_H3_L3.180_IgG1_PVA_/S267K Heavy Chain

SEQ ID NO: 42415 - protein, 117 aa, Artificial Sequence; identical to SEQ ID NO: 33034
  Description of Artificial Sequence: Synthetic polypeptide
  VH of XENP026931

SEQ ID NO: 42416 - protein, 5 aa, Artificial Sequence
  Description of Artificial Sequence: Synthetic peptide
  XENP026931 vhCDR1
HYGMN

SEQ ID NO: 42417 - protein, 17 aa, Artificial Sequence
  Description of Artificial Sequence: Synthetic peptide
  XENP026931 vhCDR2
WINTYTGEPTYADGFTG

SEQ ID NO: 42418 - protein, 8 aa, Artificial Sequence
  Description of Artificial Sequence: Synthetic peptide
  XENP026931 vhCDR3
DYYGSSPY

SEQ ID NO: 42419 - protein, 219 aa, Artificial Sequence; identical to SEQ ID NO: 42124
  Description of Artificial Sequence: Synthetic polypeptide
  XENP026931 1C11[PD-1]_H3_L3.180_IgG1_PVA_/S267K Light Chain

SEQ ID NO: 42420 - protein, 112 aa, Artificial Sequence; identical to SEQ ID NO: 42125
  Description of Artificial Sequence: Synthetic polypeptide
  VL of XENP026931

SEQ ID NO: 42421 - protein, 16 aa, Artificial Sequence
  Description of Artificial Sequence: Synthetic peptide
  XENP026931 vlCDR1
KSSQSIVHSNGNTYLE

SEQ ID NO: 42422 - protein, 7 aa, Artificial Sequence
  Description of Artificial Sequence: Synthetic peptide
  XENP026931 vlCDR2
KVSNRFS

SEQ ID NO: 42423 - protein, 9 aa, Artificial Sequence
  Description of Artificial Sequence: Synthetic peptide
  XENP026931 vlCDR3
FQGSHVPNT

SEQ ID NO: 42424 - protein, 446 aa, Artificial Sequence; identical to SEQ ID NO: 39254
  Description of Artificial Sequence: Synthetic polypeptide
  XENP026932 1C11[PD-1]_H3_L3.186_IgG1_PVA_/S267K Heavy Chain

SEQ ID NO: 42425 - protein, 117 aa, Artificial Sequence; identical to SEQ ID NO: 33034
  Description of Artificial Sequence: Synthetic polypeptide
  VH of XENP026932

SEQ ID NO: 42426 - protein, 5 aa, Artificial Sequence
  Description of Artificial Sequence: Synthetic peptide
  XENP026932 vhCDR1
HYGMN

SEQ ID NO: 42427 - protein, 17 aa, Artificial Sequence
  Description of Artificial Sequence: Synthetic peptide
  XENP026932 vhCDR2
WINTYTGEPTYADGFTG

SEQ ID NO: 42428 - protein, 8 aa, Artificial Sequence
  Description of Artificial Sequence: Synthetic peptide
  XENP026932 vhCDR3
DYYGSSPY

SEQ ID NO: 42429 - protein, 219 aa, Artificial Sequence; identical to SEQ ID NO: 42154
  Description of Artificial Sequence: Synthetic polypeptide
  XENP026932 1C11[PD-1]_H3_L3.186_IgG1_PVA_/S267K Light Chain

SEQ ID NO: 42430 - protein, 112 aa, Artificial Sequence; identical to SEQ ID NO: 42155
  Description of Artificial Sequence: Synthetic polypeptide
  VL of XENP026932

SEQ ID NO: 42431 - protein, 16 aa, Artificial Sequence
  Description of Artificial Sequence: Synthetic peptide
  XENP026932 vlCDR1
KSSQSIVHSNGNTYLE

SEQ ID NO: 42432 - protein, 7 aa, Artificial Sequence
  Description of Artificial Sequence: Synthetic peptide
  XENP026932 vlCDR2
KVSDRFS

SEQ ID NO: 42433 - protein, 9 aa, Artificial Sequence
  Description of Artificial Sequence: Synthetic peptide
  XENP026932 vlCDR3
FQGSHVPNT

SEQ ID NO: 42434 - protein, 446 aa, Artificial Sequence; identical to SEQ ID NO: 39254
  Description of Artificial Sequence: Synthetic polypeptide
  XENP026933 1C11[PD-1]_H3_L3.191_IgG1_PVA_/S267K Heavy Chain

SEQ ID NO: 42435 - protein, 117 aa, Artificial Sequence; identical to SEQ ID NO: 33034
  Description of Artificial Sequence: Synthetic polypeptide
  VH of XENP026933

SEQ ID NO: 42436 - protein, 5 aa, Artificial Sequence
  Description of Artificial Sequence: Synthetic peptide
  XENP026933 vhCDR1
HYGMN

SEQ ID NO: 42437 - protein, 17 aa, Artificial Sequence
  Description of Artificial Sequence: Synthetic peptide
  XENP026933 vhCDR2
WINTYTGEPTYADGFTG

SEQ ID NO: 42438 - protein, 8 aa, Artificial Sequence
  Description of Artificial Sequence: Synthetic peptide
  XENP026933 vhCDR3
DYYGSSPY

SEQ ID NO: 42439 - protein, 219 aa, Artificial Sequence; identical to SEQ ID NO: 42179
  Description of Artificial Sequence: Synthetic polypeptide
  XENP026933 1C11[PD-1]_H3_L3.191_IgG1_PVA_/S267K Light Chain

SEQ ID NO: 42440 - protein, 112 aa, Artificial Sequence; identical to SEQ ID NO: 42180
  Description of Artificial Sequence: Synthetic polypeptide
  VL of XENP026933

SEQ ID NO: 42441 - protein, 16 aa, Artificial Sequence
  Description of Artificial Sequence: Synthetic peptide
  XENP026933 vlCDR1
KSSQSIVHSNGNTYLE

SEQ ID NO: 42442 - protein, 7 aa, Artificial Sequence
  Description of Artificial Sequence: Synthetic peptide
  XENP026933 vlCDR2
KVSNRFS

SEQ ID NO: 42443 - protein, 9 aa, Artificial Sequence
  Description of Artificial Sequence: Synthetic peptide
  XENP026933 vlCDR3
EQGSHVPNT

SEQ ID NO: 42444 - protein, 446 aa, Artificial Sequence; identical to SEQ ID NO: 39254
  Description of Artificial Sequence: Synthetic polypeptide
  XENP026934 1C11[PD-1]_H3_L3.194_IgG1_PVA_/S267K Heavy Chain

SEQ ID NO: 42445 - protein, 117 aa, Artificial Sequence; identical to SEQ ID NO: 33034
  Description of Artificial Sequence: Synthetic polypeptide
  VH of XENP026934

SEQ ID NO: 42446 - protein, 5 aa, Artificial Sequence
  Description of Artificial Sequence: Synthetic peptide
  XENP026934 vhCDR1
HYGMN

SEQ ID NO: 42447 - protein, 17 aa, Artificial Sequence
  Description of Artificial Sequence: Synthetic peptide
  XENP026934 vhCDR2
WINTYTGEPTYADGFTG

SEQ ID NO: 42448 - protein, 8 aa, Artificial Sequence
  Description of Artificial Sequence: Synthetic peptide
  XENP026934 vhCDR3
DYYGSSPY

SEQ ID NO: 42449 - protein, 219 aa, Artificial Sequence; identical to SEQ ID NO: 42194
  Description of Artificial Sequence: Synthetic polypeptide
  XENP026934 1C11[PD-1]_H3_L3.194_IgG1_PVA_/S267K Light Chain

SEQ ID NO: 42450 - protein, 112 aa, Artificial Sequence; identical to SEQ ID NO: 42195
  Description of Artificial Sequence: Synthetic polypeptide
  VL of XENP026934

SEQ ID NO: 42451 - protein, 16 aa, Artificial Sequence
  Description of Artificial Sequence: Synthetic peptide
  XENP026934 vlCDR1
KSSQSIVHSNGNTYLE

SEQ ID NO: 42452 - protein, 7 aa, Artificial Sequence
  Description of Artificial Sequence: Synthetic peptide
  XENP026934 vlCDR2
KVSNRFS

SEQ ID NO: 42453 - protein, 9 aa, Artificial Sequence
  Description of Artificial Sequence: Synthetic peptide
  XENP026934 vlCDR3
FQDSHVPNT

SEQ ID NO: 42454 - protein, 446 aa, Artificial Sequence; identical to SEQ ID NO: 39254
  Description of Artificial Sequence: Synthetic polypeptide
  XENP026935 1C11[PD-1]_H3_L3.202_IgG1_PVA_/S267K Heavy Chain

SEQ ID NO: 42455 - protein, 117 aa, Artificial Sequence; identical to SEQ ID NO: 33034
  Description of Artificial Sequence: Synthetic polypeptide
  VH of XENP026935

SEQ ID NO: 42456 - protein, 5 aa, Artificial Sequence
  Description of Artificial Sequence: Synthetic peptide
  XENP026935 vhCDR1
HYGMN

SEQ ID NO: 42457 - protein, 17 aa, Artificial Sequence
  Description of Artificial Sequence: Synthetic peptide
  XENP026935 vhCDR2
WINTYTGEPTYADGFTG

SEQ ID NO: 42458 - protein, 8 aa, Artificial Sequence
  Description of Artificial Sequence: Synthetic peptide
  XENP026935 vhCDR3
DYYGSSPY

SEQ ID NO: 42459 - protein, 219 aa, Artificial Sequence; identical to SEQ ID NO: 42234
  Description of Artificial Sequence: Synthetic polypeptide
  XENP026935 1C11[PD-1]_H3_L3.202_IgG1_PVA_/S267K Light Chain

SEQ ID NO: 42460 - protein, 112 aa, Artificial Sequence; identical to SEQ ID NO: 42235
  Description of Artificial Sequence: Synthetic polypeptide
  VL of XENP026935

SEQ ID NO: 42461 - protein, 16 aa, Artificial Sequence
  Description of Artificial Sequence: Synthetic peptide
  XENP026935 vlCDR1
KSSQSIVHSNGNTYLE

SEQ ID NO: 42462 - protein, 7 aa, Artificial Sequence
  Description of Artificial Sequence: Synthetic peptide
  XENP026935 vlCDR2
KVSNRFS

SEQ ID NO: 42463 - protein, 9 aa, Artificial Sequence
  Description of Artificial Sequence: Synthetic peptide
  XENP026935 vlCDR3
FQGAHVPNT

SEQ ID NO: 42464 - protein, 446 aa, Artificial Sequence; identical to SEQ ID NO: 39254
  Description of Artificial Sequence: Synthetic polypeptide
  XENP026936 1C11[PD-1]_H3_L3.204_IgG1_PVA_/S267K Heavy Chain

SEQ ID NO: 42465 - protein, 117 aa, Artificial Sequence; identical to SEQ ID NO: 33034
  Description of Artificial Sequence: Synthetic polypeptide
  VH of XENP026936

SEQ ID NO: 42466 - protein, 5 aa, Artificial Sequence
  Description of Artificial Sequence: Synthetic peptide
  XENP026936 vhCDR1
HYGMN

SEQ ID NO: 42467 - protein, 17 aa, Artificial Sequence
  Description of Artificial Sequence: Synthetic peptide
  XENP026936 vhCDR2
WINTYTGEPTYADGFTG

SEQ ID NO: 42468 - protein, 8 aa, Artificial Sequence
  Description of Artificial Sequence: Synthetic peptide
  XENP026936 vhCDR3
DYYGSSPY

SEQ ID NO: 42469 - protein, 219 aa, Artificial Sequence; identical to SEQ ID NO: 42244
  Description of Artificial Sequence: Synthetic polypeptide
  XENP026936 1C11[PD-1]_H3_L3.204_IgG1_PVA_/S267K Light Chain

SEQ ID NO: 42470 - protein, 112 aa, Artificial Sequence; identical to SEQ ID NO: 42245
  Description of Artificial Sequence: Synthetic polypeptide
  VL of XENP026936

SEQ ID NO: 42471 - protein, 16 aa, Artificial Sequence
  Description of Artificial Sequence: Synthetic peptide
  XENP026936 vlCDR1
KSSQSIVHSNGNTYLE

SEQ ID NO: 42472 - protein, 7 aa, Artificial Sequence
  Description of Artificial Sequence: Synthetic peptide
  XENP026936 vlCDR2
KVSNRFS

SEQ ID NO: 42473 - protein, 9 aa, Artificial Sequence
  Description of Artificial Sequence: Synthetic peptide
  XENP026936 vlCDR3
FQGVHVPNT

SEQ ID NO: 42474 - protein, 446 aa, Artificial Sequence; identical to SEQ ID NO: 39254
  Description of Artificial Sequence: Synthetic polypeptide
  XENP026937 1C11[PD-1]_H3_L3.207_IgG1_PVA_/S267K Heavy Chain

SEQ ID NO: 42475 - protein, 117 aa, Artificial Sequence; identical to SEQ ID NO: 33034
  Description of Artificial Sequence: Synthetic polypeptide
  VH of XENP026937

SEQ ID NO: 42476 - protein, 5 aa, Artificial Sequence
  Description of Artificial Sequence: Synthetic peptide
  XENP026937 vhCDR1
HYGMN

SEQ ID NO: 42477 - protein, 17 aa, Artificial Sequence
  Description of Artificial Sequence: Synthetic peptide
  XENP026937 vhCDR2
WINTYTGEPTYADGFTG

SEQ ID NO: 42478 - protein, 8 aa, Artificial Sequence
  Description of Artificial Sequence: Synthetic peptide
  XENP026937 vhCDR3
DYYGSSPY

SEQ ID NO: 42479 - protein, 219 aa, Artificial Sequence; identical to SEQ ID NO: 42259
  Description of Artificial Sequence: Synthetic polypeptide
  XENP026937 1C11[PD-1]_H3_L3.207_IgG1_PVA_/S267K Light Chain

SEQ ID NO: 42480 - protein, 112 aa, Artificial Sequence; identical to SEQ ID NO: 42260
  Description of Artificial Sequence: Synthetic polypeptide
  VL of XENP026937

SEQ ID NO: 42481 - protein, 16 aa, Artificial Sequence
  Description of Artificial Sequence: Synthetic peptide
  XENP026937 vlCDR1
KSSQSIVHSNGNTYLE

SEQ ID NO: 42482 - protein, 7 aa, Artificial Sequence
  Description of Artificial Sequence: Synthetic peptide
  XENP026937 vlCDR2
KVSNRFS

SEQ ID NO: 42483 - protein, 9 aa, Artificial Sequence
  Description of Artificial Sequence: Synthetic peptide
  XENP026937 vlCDR3
FQGSDVPNT

SEQ ID NO: 42484 - protein, 446 aa, Artificial Sequence
  Description of Artificial Sequence: Synthetic polypeptide
  XENP026938 1C11[PD-1]_H3.308_L3.152_IgG1_PVA_/S267K Heavy Chain
QIQLVQSGSELKKPGASVKVSCKASGYTFTHYGMNWVRQAPGQGLEWMGWINTYTSEPTYADGFTGRFVFSLDTSQSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42485 - protein, 117 aa, Artificial Sequence
  Description of Artificial Sequence: Synthetic polypeptide
  VH of XENP026938
QIQLVQSGSELKKPGASVKVSCKASGYTFTHYGMNWVRQAPGQGLEWMGWINTYTSEPTYADGFTGRFVFSLDTSQSTAYLQISSLKAEDTAVYFCARDYYGSSPYWGQGTLVTVSS

SEQ ID NO: 42486 - protein, 5 aa, Artificial Sequence
  Description of Artificial Sequence: Synthetic peptide
  XENP026938 vhCDR1
HYGMN

SEQ ID NO: 42487 - protein, 17 aa, Artificial Sequence
  Description of Artificial Sequence: Synthetic peptide
  XENP026938 vhCDR2
WINTYTSEPTYADGFTG

SEQ ID NO: 42488 - protein, 8 aa, Artificial Sequence
  Description of Artificial Sequence: Synthetic peptide
  XENP026938 vhCDR3
DYYGSSPY

SEQ ID NO: 42489 - protein, 219 aa, Artificial Sequence; identical to SEQ ID NO: 41984
  Description of Artificial Sequence: Synthetic polypeptide
  XENP026938 1C11[PD-1]_H3.308_L3.152_IgG1_PVA_/S267K Light Chain

SEQ ID NO: 42490 - protein, 112 aa, Artificial Sequence; identical to SEQ ID NO: 41985
  Description of Artificial Sequence: Synthetic polypeptide
  VL of XENP026938

SEQ ID NO: 42491 - protein, 16 aa, Artificial Sequence
  Description of Artificial Sequence: Synthetic peptide
  XENP026938 vlCDR1
KSSQSIVFSNGNTYLE

SEQ ID NO: 42492 - protein, 7 aa, Artificial Sequence
  Description of Artificial Sequence: Synthetic peptide
  XENP026938 vlCDR2
KVSNRFS

SEQ ID NO: 42493 - protein, 9 aa, Artificial Sequence
  Description of Artificial Sequence: Synthetic peptide
  XENP026938 vlCDR3
FQGSHVPNT

SEQ ID NO: 42494 - protein, 446 aa, Artificial Sequence; identical to SEQ ID NO: 41379
  Description of Artificial Sequence: Synthetic polypeptide
  XENP026939 1C11[PD-1]_H3.59_L3.152_IgG1_PVA_/S267K Heavy Chain

SEQ ID NO: 42495 - protein, 117 aa, Artificial Sequence; identical to SEQ ID NO: 33992
  Description of Artificial Sequence: Synthetic polypeptide
  VH of XENP026939

SEQ ID NO: 42496 - protein, 5 aa, Artificial Sequence
  Description of Artificial Sequence: Synthetic peptide
  XENP026939 vhCDR1
HYGMN

SEQ ID NO: 42497 - protein, 17 aa, Artificial Sequence
  Description of Artificial Sequence: Synthetic peptide
  XENP026939 vhCDR2
WINTYTGEPTYADGFTG

SEQ ID NO: 42498 - protein, 8 aa, Artificial Sequence
  Description of Artificial Sequence: Synthetic peptide
  XENP026939 vhCDR3
DYYGSSPY

SEQ ID NO: 42499 - protein, 219 aa, Artificial Sequence; identical to SEQ ID NO: 41984
  Description of Artificial Sequence: Synthetic polypeptide
  XENP026939 1C11[PD-1]_H3.59_L3.152_IgG1_PVA_/S267K Light Chain

SEQ ID NO: 42500 - protein, 112 aa, Artificial Sequence; identical to SEQ ID NO: 41985
  Description of Artificial Sequence: Synthetic polypeptide
  VL of XENP026939

SEQ ID NO: 42501 - protein, 16 aa, Artificial Sequence
  Description of Artificial Sequence: Synthetic peptide
  XENP026939 vlCDR1
KSSQSIVFSNGNTYLE

SEQ ID NO: 42502 - protein, 7 aa, Artificial Sequence
  Description of Artificial Sequence: Synthetic peptide
  XENP026939 vlCDR2
KVSNRFS

SEQ ID NO: 42503 - protein, 9 aa, Artificial Sequence
  Description of Artificial Sequence: Synthetic peptide
  XENP026939 vlCDR3
FQGSHVPNT

SEQ ID NO: 42504 - protein, 446 aa, Artificial Sequence; identical to SEQ ID NO: 41934
  Description of Artificial Sequence: Synthetic polypeptide
  XENP026940 1C11[PD-1]_H3.303_L3.152_IgG1_PVA_/S267K Heavy Chain

SEQ ID NO: 42505 - protein, 117 aa, Artificial Sequence; identical to SEQ ID NO: 41935
  Description of Artificial Sequence: Synthetic polypeptide
  VH of XENP026940

SEQ ID NO: 42506 - protein, 5 aa, Artificial Sequence
  Description of Artificial Sequence: Synthetic peptide
  XENP026940 vhCDR1
HYGMN

SEQ ID NO: 42507 - protein, 17 aa, Artificial Sequence
  Description of Artificial Sequence: Synthetic peptide
  XENP026940 vhCDR2
WINTYTGEPTYADGFTG

SEQ ID NO: 42508 - protein, 8 aa, Artificial Sequence
  Description of Artificial Sequence: Synthetic peptide
  XENP026940 vhCDR3
DYFGSSPY

SEQ ID NO: 42509 - protein, 219 aa, Artificial Sequence; identical to SEQ ID NO: 41984
  Description of Artificial Sequence: Synthetic polypeptide
  XENP026940 1C11[PD-1]_H3.303_L3.152_IgG1_PVA_/S267K Light Chain

SEQ ID NO: 42510 - protein, 112 aa, Artificial Sequence; identical to SEQ ID NO: 41985
  Description of Artificial Sequence: Synthetic polypeptide
  VL of XENP026940

SEQ ID NO: 42511 - protein, 16 aa, Artificial Sequence
  Description of Artificial Sequence: Synthetic peptide
  XENP026940 vlCDR1
KSSQSIVFSNGNTYLE

SEQ ID NO: 42512 - protein, 7 aa, Artificial Sequence
  Description of Artificial Sequence: Synthetic peptide
  XENP026940 vlCDR2
KVSNRFS

SEQ ID NO: 42513 - protein, 9 aa, Artificial Sequence
  Description of Artificial Sequence: Synthetic peptide
  XENP026940 vlCDR3
FQGSHVPNT

SEQ ID NO: 42514 - protein, 446 aa, Artificial Sequence; identical to SEQ ID NO: 42484
  Description of Artificial Sequence: Synthetic polypeptide
  XENP026941 1C11[PD-1]_H3.308_L3.180_IgG1_PVA_/S267K Heavy Chain

SEQ ID NO: 42515 - protein, 117 aa, Artificial Sequence; identical to SEQ ID NO: 42485
  Description of Artificial Sequence: Synthetic polypeptide
  VH of XENP026941

SEQ ID NO: 42516 - protein, 5 aa, Artificial Sequence
  Description of Artificial Sequence: Synthetic peptide
  XENP026941 vhCDR1
HYGMN

SEQ ID NO: 42517 - protein, 17 aa, Artificial Sequence
  Description of Artificial Sequence: Synthetic peptide
  XENP026941 vhCDR2
WINTYTSEPTYADGFTG

SEQ ID NO: 42518 - protein, 8 aa, Artificial Sequence
  Description of Artificial Sequence: Synthetic peptide
  XENP026941 vhCDR3
DYYGSSPY

SEQ ID NO: 42519 - protein, 219 aa, Artificial Sequence; identical to SEQ ID NO: 42124
  Description of Artificial Sequence: Synthetic polypeptide
  XENP026941 1C11[PD-1]_H3.308_L3.180_IgG1_PVA_/S267K Light Chain

SEQ ID NO: 42520 - protein, 112 aa, Artificial Sequence; identical to SEQ ID NO: 42125
  Description of Artificial Sequence: Synthetic polypeptide
  VL of XENP026941

SEQ ID NO: 42521 - protein, 16 aa, Artificial Sequence
  Description of Artificial Sequence: Synthetic peptide
  XENP026941 vlCDR1
KSSQSIVHSNGNTYLE

SEQ ID NO: 42522 - protein, 7 aa, Artificial Sequence
  Description of Artificial Sequence: Synthetic peptide
  XENP026941 vlCDR2
KVSNRFS

SEQ ID NO: 42523 - protein, 9 aa, Artificial Sequence
  Description of Artificial Sequence: Synthetic peptide
  XENP026941 vlCDR3
FQGSHVPNT

SEQ ID NO: 42524 - protein, 446 aa, Artificial Sequence; identical to SEQ ID NO: 41379
  Description of Artificial Sequence: Synthetic polypeptide
  XENP026942 1C11[PD-1]_H3.59_L3.180_IgG1_PVA_/S267K Heavy Chain

SEQ ID NO: 42525 - protein, 117 aa, Artificial Sequence; identical to SEQ ID NO: 33992
  Description of Artificial Sequence: Synthetic polypeptide
  VH of XENP026942

SEQ ID NO: 42526 - protein, 5 aa, Artificial Sequence
  Description of Artificial Sequence: Synthetic peptide
  XENP026942 vhCDR1
HYGMN

SEQ ID NO: 42527 - protein, 17 aa, Artificial Sequence
  Description of Artificial Sequence: Synthetic peptide
  XENP026942 vhCDR2
WINTYTGEPTYADGFTG

SEQ ID NO: 42528 - protein, 8 aa, Artificial Sequence
  Description of Artificial Sequence: Synthetic peptide
  XENP026942 vhCDR3
DYYGSSPY

SEQ ID NO: 42529 - protein, 219 aa, Artificial Sequence; identical to SEQ ID NO: 42124
  Description of Artificial Sequence: Synthetic polypeptide
  XENP026942 1C11[PD-1]_H3.59_L3.180_IgG1_PVA_/S267K Light Chain

SEQ ID NO: 42530 - protein, 112 aa, Artificial Sequence; identical to SEQ ID NO: 42125
  Description of Artificial Sequence: Synthetic polypeptide
  VL of XENP026942

SEQ ID NO: 42531 - protein, 16 aa, Artificial Sequence
  Description of Artificial Sequence: Synthetic peptide
  XENP026942 vlCDR1
KSSQSIVHSNGNTYLE

SEQ ID NO: 42532 - protein, 7 aa, Artificial Sequence
  Description of Artificial Sequence: Synthetic peptide
  XENP026942 vlCDR2
KVSNRFS

SEQ ID NO: 42533 - protein, 9 aa, Artificial Sequence
  Description of Artificial Sequence: Synthetic peptide
  XENP026942 vlCDR3
FQGSHVPNT

SEQ ID NO: 42534 - protein, 446 aa, Artificial Sequence; identical to SEQ ID NO: 41934
  Description of Artificial Sequence: Synthetic polypeptide
  XENP026943 1C11[PD-1]_H3.303_L3.180_IgG1_PVA_/S267K Heavy Chain

SEQ ID NO: 42535 - protein, 117 aa, Artificial Sequence; identical to SEQ ID NO: 41935
  Description of Artificial Sequence: Synthetic polypeptide
  VH of XENP026943

SEQ ID NO: 42536 - protein, 5 aa, Artificial Sequence
  Description of Artificial Sequence: Synthetic peptide
  XENP026943 vhCDR1
HYGMN

SEQ ID NO: 42537 - protein, 17 aa, Artificial Sequence
  Description of Artificial Sequence: Synthetic peptide
  XENP026943 vhCDR2
WINTYTGEPTYADGFTG

SEQ ID NO: 42538 - protein, 8 aa, Artificial Sequence
  Description of Artificial Sequence: Synthetic peptide
  XENP026943 vhCDR3
DYFGSSPY

SEQ ID NO: 42539 - protein, 219 aa, Artificial Sequence; identical to SEQ ID NO: 42124
  Description of Artificial Sequence: Synthetic polypeptide
  XENP026943 1C11[PD-1]_H3.303_L3.180_IgG1_PVA_/S267K Light Chain

SEQ ID NO: 42540 - protein, 112 aa, Artificial Sequence; identical to SEQ ID NO: 42125
  Description of Artificial Sequence: Synthetic polypeptide
  VL of XENP026943

SEQ ID NO: 42541 - protein, 16 aa, Artificial Sequence
  Description of Artificial Sequence: Synthetic peptide
  XENP026943 vlCDR1
KSSQSIVHSNGNTYLE

SEQ ID NO: 42542 - protein, 7 aa, Artificial Sequence
  Description of Artificial Sequence: Synthetic peptide
  XENP026943 vlCDR2
KVSNRFS

SEQ ID NO: 42543 - protein, 9 aa, Artificial Sequence
  Description of Artificial Sequence: Synthetic peptide
  XENP026943 vlCDR3
FQGSHVPNT

SEQ ID NO: 42544 - protein, 446 aa, Artificial Sequence; identical to SEQ ID NO: 41934
  Description of Artificial Sequence: Synthetic polypeptide
  XENP026944 1C11[PD-1]_H3.303_L3.210_IgG1_PVA_/S267K Heavy Chain

SEQ ID NO: 42545 - protein, 117 aa, Artificial Sequence; identical to SEQ ID NO: 41935
  Description of Artificial Sequence: Synthetic polypeptide
  VH of XENP026944

SEQ ID NO: 42546 - protein, 5 aa, Artificial Sequence
  Description of Artificial Sequence: Synthetic peptide
  XENP026944 vhCDR1
HYGMN

SEQ ID NO: 42547 - protein, 17 aa, Artificial Sequence
  Description of Artificial Sequence: Synthetic peptide
  XENP026944 vhCDR2
WINTYTGEPTYADGFTG

SEQ ID NO: 42548 - protein, 8 aa, Artificial Sequence
  Description of Artificial Sequence: Synthetic peptide
  XENP026944 vhCDR3
DYFGSSPY

SEQ ID NO: 42549 - protein, 219 aa, Artificial Sequence
  Description of Artificial Sequence: Synthetic polypeptide
  XENP026944 1C11[PD-1]_H3.303_L3.210_IgG1_PVA_/S267K Light Chain
DILMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42550 - protein, 112 aa, Artificial Sequence
  Description of Artificial Sequence: Synthetic polypeptide
  VL of XENP026944
DILMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIK

SEQ ID NO: 42551 - protein, 16 aa, Artificial Sequence
  Description of Artificial Sequence: Synthetic peptide
  XENP026944 vlCDR1
KSSQSIVHSNGNNYLE

SEQ ID NO: 42552 - protein, 7 aa, Artificial Sequence
  Description of Artificial Sequence: Synthetic peptide
  XENP026944 vlCDR2
KVSNRFS

SEQ ID NO: 42553 - protein, 9 aa, Artificial Sequence
  Description of Artificial Sequence: Synthetic peptide
  XENP026944 vlCDR3
FQGSHVPNT

SEQ ID NO: 42554 - protein, 446 aa, Artificial Sequence; identical to SEQ ID NO: 42484
  Description of Artificial Sequence: Synthetic polypeptide
  XENP026945 1C11[PD-1]_H3.308_L3_IgG1_PVA_/S267K Heavy Chain

SEQ ID NO: 42555 - protein, 117 aa, Artificial Sequence; identical to SEQ ID NO: 42485
  Description of Artificial Sequence: Synthetic polypeptide
  VH of XENP026945

SEQ ID NO: 42556 - protein, 5 aa, Artificial Sequence
  Description of Artificial Sequence: Synthetic peptide
  XENP026945 vhCDR1
HYGMN

SEQ ID NO: 42557 - protein, 17 aa, Artificial Sequence
  Description of Artificial Sequence: Synthetic peptide
  XENP026945 vhCDR2
WINTYTSEPTYADGFTG

SEQ ID NO: 42558 - protein, 8 aa, Artificial Sequence
  Description of Artificial Sequence: Synthetic peptide
  XENP026945 vhCDR3
DYYGSSPY

SEQ ID NO: 42559 - protein, 219 aa, Artificial Sequence; identical to SEQ ID NO: 33008
  Description of Artificial Sequence: Synthetic polypeptide
  XENP026945 1C11[PD-1]_H3.308_L3_IgG1_PVA_/S267K Light Chain

SEQ ID NO: 42560 - protein, 112 aa, Artificial Sequence; identical to SEQ ID NO: 33009
  Description of Artificial Sequence: Synthetic polypeptide
  VL of XENP026945

SEQ ID NO: 42561 - protein, 16 aa, Artificial Sequence
  Description of Artificial Sequence: Synthetic peptide
  XENP026945 vlCDR1
KSSQSIVHSNGNTYLE

SEQ ID NO: 42562 - protein, 7 aa, Artificial Sequence
  Description of Artificial Sequence: Synthetic peptide
  XENP026945 vlCDR2
KVSNRFS

SEQ ID NO: 42563 - protein, 9 aa, Artificial Sequence
  Description of Artificial Sequence: Synthetic peptide
  XENP026945 vlCDR3
FQGSHVPNT

SEQ ID NO: 42564 - protein, 446 aa, Artificial Sequence; identical to SEQ ID NO: 41379
  Description of Artificial Sequence: Synthetic polypeptide
  XENP026946 1C11[PD-1]_H3.59_L3_IgG1_PVA_/S267K Heavy Chain

SEQ ID NO: 42565 - protein, 117 aa, Artificial Sequence; identical to SEQ ID NO: 33992
  Description of Artificial Sequence: Synthetic polypeptide
  VH of XENP026946

SEQ ID NO: 42566 - protein, 5 aa, Artificial Sequence
  Description of Artificial Sequence: Synthetic peptide
  XENP026946 vhCDR1
HYGMN

SEQ ID NO: 42567 - protein, 17 aa, Artificial Sequence
  Description of Artificial Sequence: Synthetic peptide
  XENP026946 vhCDR2
WINTYTGEPTYADGFTG

SEQ ID NO: 42568 - protein, 8 aa, Artificial Sequence
  Description of Artificial Sequence: Synthetic peptide
  XENP026946 vhCDR3
DYYGSSPY

SEQ ID NO: 42569 - protein, 219 aa, Artificial Sequence; identical to SEQ ID NO: 33008
  Description of Artificial Sequence: Synthetic polypeptide
  XENP026946 1C11[PD-1]_H3.59_L3_IgG1_PVA_/S267K Light Chain

SEQ ID NO: 42570 - protein, 112 aa, Artificial Sequence; identical to SEQ ID NO: 33009
  Description of Artificial Sequence: Synthetic polypeptide
  VL of XENP026946

SEQ ID NO: 42571 - protein, 16 aa, Artificial Sequence
  Description of Artificial Sequence: Synthetic peptide
  XENP026946 vlCDR1
KSSQSIVHSNGNTYLE

SEQ ID NO: 42572 - protein, 7 aa, Artificial Sequence
  Description of Artificial Sequence: Synthetic peptide
  XENP026946 vlCDR2
KVSNRFS

SEQ ID NO: 42573 - protein, 9 aa, Artificial Sequence
  Description of Artificial Sequence: Synthetic peptide
  XENP026946 vlCDR3
FQGSHVPNT

SEQ ID NO: 42574 - protein, 446 aa, Artificial Sequence; identical to SEQ ID NO: 41439
  Description of Artificial Sequence: Synthetic polypeptide
  XENP026947 1C11[PD-1]_H3.135_L3_IgG1_PVA_/S267K Heavy Chain

SEQ ID NO: 42575 - protein, 117 aa, Artificial Sequence; identical to SEQ ID NO: 34694
  Description of Artificial Sequence: Synthetic polypeptide
  VH of XENP026947

SEQ ID NO: 42576 - protein, 5 aa, Artificial Sequence
  Description of Artificial Sequence: Synthetic peptide
  XENP026947 vhCDR1
HYGMN

SEQ ID NO: 42577 - protein, 17 aa, Artificial Sequence
  Description of Artificial Sequence: Synthetic peptide
  XENP026947 vhCDR2
WINTYTSEPTYADGFTG

SEQ ID NO: 42578 - protein, 8 aa, Artificial Sequence
  Description of Artificial Sequence: Synthetic peptide
  XENP026947 vhCDR3
DYYGSSPY

SEQ ID NO: 42579 - protein, 219 aa, Artificial Sequence; identical to SEQ ID NO: 33008
  Description of Artificial Sequence: Synthetic polypeptide
  XENP026947 1C11[PD-1]_H3.135_L3_IgG1_PVA_/S267K Light Chain

SEQ ID NO: 42580 - protein, 112 aa, Artificial Sequence; identical to SEQ ID NO: 33009
  Description of Artificial Sequence: Synthetic polypeptide
  VL of XENP026947

SEQ ID NO: 42581 - protein, 16 aa, Artificial Sequence
  Description of Artificial Sequence: Synthetic peptide
  XENP026947 vlCDR1
KSSQSIVHSNGNTYLE

SEQ ID NO: 42582 - protein, 7 aa, Artificial Sequence
  Description of Artificial Sequence: Synthetic peptide
  XENP026947 vlCDR2
KVSNRFS

SEQ ID NO: 42583 - protein, 9 aa, Artificial Sequence
  Description of Artificial Sequence: Synthetic peptide
  XENP026947 vlCDR3
FQGSHVPNT

SEQ ID NO: 42584 - protein, 446 aa, Artificial Sequence; identical to SEQ ID NO: 42484
  Description of Artificial Sequence: Synthetic polypeptide
  XENP026949 1C11[PD-1]_H3.308_L3.210_IgG1_PVA_/S267K Heavy Chain

SEQ ID NO: 42585 - protein, 117 aa, Artificial Sequence; identical to SEQ ID NO: 42485
  Description of Artificial Sequence: Synthetic polypeptide
  VH of XENP026949

SEQ ID NO: 42586 - protein, 5 aa, Artificial Sequence
  Description of Artificial Sequence: Synthetic peptide
  XENP026949 vhCDR1
HYGMN

SEQ ID NO: 42587 - protein, 17 aa, Artificial Sequence
  Description of Artificial Sequence: Synthetic peptide
  XENP026949 vhCDR2
WINTYTSEPTYADGFTG

SEQ ID NO: 42588 - protein, 8 aa, Artificial Sequence
  Description of Artificial Sequence: Synthetic peptide
  XENP026949 vhCDR3
DYYGSSPY

SEQ ID NO: 42589 - protein, 219 aa, Artificial Sequence; identical to SEQ ID NO: 42549
  Description of Artificial Sequence: Synthetic polypeptide
  XENP026949 1C11[PD-1]_H3.308_L3.210_IgG1_PVA_/S267K Light Chain

SEQ ID NO: 42590 - protein, 112 aa, Artificial Sequence; identical to SEQ ID NO: 42550
  Description of Artificial Sequence: Synthetic polypeptide
  VL of XENP026949

SEQ ID NO: 42591 - protein, 16 aa, Artificial Sequence
  Description of Artificial Sequence: Synthetic peptide
  XENP026949 vlCDR1
KSSQSIVHSNGNNYLE

SEQ ID NO: 42592 - protein, 7 aa, Artificial Sequence
  Description of Artificial Sequence: Synthetic peptide
  XENP026949 vlCDR2
KVSNRFS

SEQ ID NO: 42593 - protein, 9 aa, Artificial Sequence
  Description of Artificial Sequence: Synthetic peptide
  XENP026949 vlCDR3
FQGSHVPNT

SEQ ID NO: 42594 - protein, 446 aa, Artificial Sequence; identical to SEQ ID NO: 39254
  Description of Artificial Sequence: Synthetic polypeptide
  XENP026950 1C11[PD-1]_H3_L3.210_IgG1_PVA_/S267K Heavy Chain

SEQ ID NO: 42595 - protein, 117 aa, Artificial Sequence; identical to SEQ ID NO: 33034
  Description of Artificial Sequence: Synthetic polypeptide
  VH of XENP026950

SEQ ID NO: 42596 - protein, 5 aa, Artificial Sequence
  Description of Artificial Sequence: Synthetic peptide
  XENP026950 vhCDR1
HYGMN

SEQ ID NO: 42597 - protein, 17 aa, Artificial Sequence
  Description of Artificial Sequence: Synthetic peptide
  XENP026950 vhCDR2
WINTYTGEPTYADGFTG

SEQ ID NO: 42598 - protein, 8 aa, Artificial Sequence
  Description of Artificial Sequence: Synthetic peptide
  XENP026950 vhCDR3
DYYGSSPY

SEQ ID NO: 42599 - protein, 219 aa, Artificial Sequence; identical to SEQ ID NO: 42549
  Description of Artificial Sequence: Synthetic polypeptide
  XENP026950 1C11[PD-1]_H3_L3.210_IgG1_PVA_/S267K Light Chain

SEQ ID NO: 42600 - protein, 112 aa, Artificial Sequence; identical to SEQ ID NO: 42550
  Description of Artificial Sequence: Synthetic polypeptide
  VL of XENP026950

SEQ ID NO: 42601 - protein, 16 aa, Artificial Sequence
  Description of Artificial Sequence: Synthetic peptide
  XENP026950 vlCDR1
KSSQSIVHSNGNNYLE

SEQ ID NO: 42602 - protein, 7 aa, Artificial Sequence
  Description of Artificial Sequence: Synthetic peptide
  XENP026950 vlCDR2
KVSNRFS

SEQ ID NO: 42603 - protein, 9 aa, Artificial Sequence
  Description of Artificial Sequence: Synthetic peptide
  XENP026950 vlCDR3
FQGSHVPNT

SEQ ID NO: 42604 - protein, 446 aa, Artificial Sequence; identical to SEQ ID NO: 39254
  Description of Artificial Sequence: Synthetic polypeptide
  XENP026951 1C11[PD-1]_H3_L3.1_IgG1_PVA_/S267K Heavy Chain

SEQ ID NO: 42605 - protein, 117 aa, Artificial Sequence; identical to SEQ ID NO: 33034
  Description of Artificial Sequence: Synthetic polypeptide
  VH of XENP026951

SEQ ID NO: 42606 - protein, 5 aa, Artificial Sequence
  Description of Artificial Sequence: Synthetic peptide
  XENP026951 vhCDR1
HYGMN

SEQ ID NO: 42607 - protein, 17 aa, Artificial Sequence
  Description of Artificial Sequence: Synthetic peptide
  XENP026951 vhCDR2
WINTYTGEPTYADGFTG

SEQ ID NO: 42608 - protein, 8 aa, Artificial Sequence
  Description of Artificial Sequence: Synthetic peptide
  XENP026951 vhCDR3
DYYGSSPY

SEQ ID NO: 42609 - protein, 219 aa, Artificial Sequence; identical to SEQ ID NO: 41384
  Description of Artificial Sequence: Synthetic polypeptide
  XENP026951 1C11[PD-1]_H3_L3.1_IgG1_PVA_/S267K Light Chain

SEQ ID NO: 42610 - protein, 112 aa, Artificial Sequence; identical to SEQ ID NO: 39365
  Description of Artificial Sequence: Synthetic polypeptide
  VL of XENP026951

SEQ ID NO: 42611 - protein, 16 aa, Artificial Sequence
  Description of Artificial Sequence: Synthetic peptide
  XENP026951 vlCDR1
KSSQSIVHSNGNTYLE

SEQ ID NO: 42612 - protein, 7 aa, Artificial Sequence
  Description of Artificial Sequence: Synthetic peptide
  XENP026951 vlCDR2
KVSNRFS

SEQ ID NO: 42613 - protein, 9 aa, Artificial Sequence
  Description of Artificial Sequence: Synthetic peptide
  XENP026951 vlCDR3
FQGSHVPNT

SEQ ID NO: 42614 - protein, 446 aa, Artificial Sequence; identical to SEQ ID NO: 39254
  Description of Artificial Sequence: Synthetic polypeptide
  XENP026952 1C11[PD-1]_H3_L3.38_IgG1_PVA_/S267K Heavy Chain

SEQ ID NO: 42615 - protein, 117 aa, Artificial Sequence; identical to SEQ ID NO: 33034
  Description of Artificial Sequence: Synthetic polypeptide
  VH of XENP026952

SEQ ID NO: 42616 - protein, 5 aa, Artificial Sequence
  Description of Artificial Sequence: Synthetic peptide
  XENP026952 vhCDR1
HYGMN

SEQ ID NO: 42617 - protein, 17 aa, Artificial Sequence
  Description of Artificial Sequence: Synthetic peptide
  XENP026952 vhCDR2
WINTYTGEPTYADGFTG

SEQ ID NO: 42618 - protein, 8 aa, Artificial Sequence
  Description of Artificial Sequence: Synthetic peptide
  XENP026952 vhCDR3
DYYGSSPY

SEQ ID NO: 42619 - protein, 219 aa, Artificial Sequence; identical to SEQ ID NO: 41394
  Description of Artificial Sequence: Synthetic polypeptide
  XENP026952 1C11[PD-1]_H3_L3.38_IgG1_PVA_/S267K Light Chain

SEQ ID NO: 42620 - protein, 112 aa, Artificial Sequence; identical to SEQ ID NO: 41395
  Description of Artificial Sequence: Synthetic polypeptide
  VL of XENP026952

SEQ ID NO: 42621 - protein, 16 aa, Artificial Sequence
  Description of Artificial Sequence: Synthetic peptide
  XENP026952 vlCDR1
KSSQSIVHSNGNNYLE

SEQ ID NO: 42622 - protein, 7 aa, Artificial Sequence
  Description of Artificial Sequence: Synthetic peptide
  XENP026952 vlCDR2
KVSNRFS

SEQ ID NO: 42623 - protein, 9 aa, Artificial Sequence
  Description of Artificial Sequence: Synthetic peptide
  XENP026952 vlCDR3
FQGSHVPNT

SEQ ID NO: 42624 - protein, 446 aa, Artificial Sequence; identical to SEQ ID NO: 39254
  Description of Artificial Sequence: Synthetic polypeptide
  XENP026953 1C11[PD-1]_H3_L3.125_IgG1_PVA_/S267K Heavy Chain

SEQ ID NO: 42625 - protein, 117 aa, Artificial Sequence; identical to SEQ ID NO: 33034
  Description of Artificial Sequence: Synthetic polypeptide
  VH of XENP026953

SEQ ID NO: 42626 - protein, 5 aa, Artificial Sequence
  Description of Artificial Sequence: Synthetic peptide
  XENP026953 vhCDR1
HYGMN

SEQ ID NO: 42627 - protein, 17 aa, Artificial Sequence
  Description of Artificial Sequence: Synthetic peptide
  XENP026953 vhCDR2
WINTYTGEPTYADGFTG

SEQ ID NO: 42628 - protein, 8 aa, Artificial Sequence
  Description of Artificial Sequence: Synthetic peptide
  XENP026953 vhCDR3
DYYGSSPY

SEQ ID NO: 42629 - protein, 219 aa, Artificial Sequence; identical to SEQ ID NO: 41314
  Description of Artificial Sequence: Synthetic polypeptide
  XENP026953 1C11[PD-1]_H3_L3.125_IgG1_PVA_/S267K Light Chain

SEQ ID NO: 42630 - protein, 112 aa, Artificial Sequence; identical to SEQ ID NO: 39644
  Description of Artificial Sequence: Synthetic polypeptide
  VL of XENP026953

SEQ ID NO: 42631 - protein, 16 aa, Artificial Sequence
  Description of Artificial Sequence: Synthetic peptide
  XENP026953 vlCDR1
KSSQSIVHSNGNTYLE

SEQ ID NO: 42632 - protein, 7 aa, Artificial Sequence
  Description of Artificial Sequence: Synthetic peptide
  XENP026953 vlCDR2
KVSNRFS

SEQ ID NO: 42633 - protein, 9 aa, Artificial Sequence
  Description of Artificial Sequence: Synthetic peptide
  XENP026953 vlCDR3
FQGSHVPNT

SEQ ID NO: 42634 - protein, 446 aa, Artificial Sequence; identical to SEQ ID NO: 42484
  Description of Artificial Sequence: Synthetic polypeptide
  XENP026954 1C11[PD-1]_H3.308_L3.38_IgG1_PVA_/S267K Heavy Chain

SEQ ID NO: 42635 - protein, 117 aa, Artificial Sequence; identical to SEQ ID NO: 42485
  Description of Artificial Sequence: Synthetic polypeptide
  VH of XENP026954

SEQ ID NO: 42636 - protein, 5 aa, Artificial Sequence
  Description of Artificial Sequence: Synthetic peptide
  XENP026954 vhCDR1
HYGMN

SEQ ID NO: 42637 - protein, 17 aa, Artificial Sequence
  Description of Artificial Sequence: Synthetic peptide
  XENP026954 vhCDR2
WINTYTSEPTYADGFTG

SEQ ID NO: 42638 - protein, 8 aa, Artificial Sequence
  Description of Artificial Sequence: Synthetic peptide
  XENP026954 vhCDR3
DYYGSSPY

SEQ ID NO: 42639 - protein, 219 aa, Artificial Sequence; identical to SEQ ID NO: 41394
  Description of Artificial Sequence: Synthetic polypeptide
  XENP026954 1C11[PD-1]_H3.308_L3.38_IgG1_PVA_/S267K Light Chain

SEQ ID NO: 42640 - protein, 112 aa, Artificial Sequence; identical to SEQ ID NO: 41395
  Description of Artificial Sequence: Synthetic polypeptide
  VL of XENP026954

SEQ ID NO: 42641 - protein, 16 aa, Artificial Sequence
  Description of Artificial Sequence: Synthetic peptide
  XENP026954 vlCDR1
KSSQSIVHSNGNNYLE

SEQ ID NO: 42642 - protein, 7 aa, Artificial Sequence
  Description of Artificial Sequence: Synthetic peptide
  XENP026954 vlCDR2
KVSNRFS

SEQ ID NO: 42643 - protein, 9 aa, Artificial Sequence
  Description of Artificial Sequence: Synthetic peptide
  XENP026954 vlCDR3
FQGSHVPNT

SEQ ID NO: 42644 - protein, 446 aa, Artificial Sequence; identical to SEQ ID NO: 41379
  Description of Artificial Sequence: Synthetic polypeptide
  XENP026955 1C11[PD-1]_H3.59_L3.210_IgG1_PVA_/S267K Heavy Chain

SEQ ID NO: 42645 - protein, 117 aa, Artificial Sequence; identical to SEQ ID NO: 33992
  Description of Artificial Sequence: Synthetic polypeptide
  VH of XENP026955

SEQ ID NO: 42646 - protein, 5 aa, Artificial Sequence
  Description of Artificial Sequence: Synthetic peptide
  XENP026955 vhCDR1
HYGMN

SEQ ID NO: 42647 - protein, 17 aa, Artificial Sequence
  Description of Artificial Sequence: Synthetic peptide
  XENP026955 vhCDR2
WINTYTGEPTYADGFTG

SEQ ID NO: 42648 - protein, 8 aa, Artificial Sequence
  Description of Artificial Sequence: Synthetic peptide
  XENP026955 vhCDR3
DYYGSSPY

SEQ ID NO: 42649 - protein, 219 aa, Artificial Sequence; identical to SEQ ID NO: 42549
  Description of Artificial Sequence: Synthetic polypeptide
  XENP026955 1C11[PD-1]_H3.59_L3.210_IgG1_PVA_/S267K Light Chain

SEQ ID NO: 42650 - protein, 112 aa, Artificial Sequence; identical to SEQ ID NO: 42550
  Description of Artificial Sequence: Synthetic polypeptide
  VL of XENP026955

SEQ ID NO: 42651 - protein, 16 aa, Artificial Sequence
  Description of Artificial Sequence: Synthetic peptide
  XENP026955 vlCDR1
KSSQSIVHSNGNNYLE

SEQ ID NO: 42652 - protein, 7 aa, Artificial Sequence
  Description of Artificial Sequence: Synthetic peptide
  XENP026955 vlCDR2
KVSNRFS

SEQ ID NO: 42653 - protein, 9 aa, Artificial Sequence
  Description of Artificial Sequence: Synthetic peptide
  XENP026955 vlCDR3
FQGSHVPNT

SEQ ID NO: 42654 - protein, 442 aa, Artificial Sequence
  Description of Artificial Sequence: Synthetic polypeptide
  XENP026842 Nivolumab_H0L0_IgG1_ PVA_ /S267K/M428L/N434S Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 42655 - protein, 113 aa, Artificial Sequence [sequence omitted]

SEQ ID NO: 42656 - protein, 5 aa, Artificial Sequence
  Description of Artificial Sequence: Synthetic peptide
  XENP026842 vhCDR1
NSGMH

SEQ ID NO: 42657 - protein, 17 aa, Artificial Sequence
  Description of Artificial Sequence: Synthetic peptide
  XENP026842 vhCDR2
VIWYDGSKRYYADSVKG

SEQ ID NO: 42658 - protein, 4 aa, Artificial Sequence
  Description of Artificial Sequence: Synthetic peptide
  XENP026842 vhCDR3
NDDY

SEQ ID NO: 42659 - protein, 214 aa, Artificial Sequence; identical to SEQ ID NO: 11470
  Description of Artificial Sequence: Synthetic polypeptide
  XENP016432 Nivolumab_H0L0_IgG1_P PVA_ /S267K/M428L/N434S Light Chain

SEQ ID NO: 42660 - protein, 107 aa, Artificial Sequence [sequence omitted]

SEQ ID NO: 42661 - protein, 11 aa, Artificial Sequence
  Description of Artificial Sequence: Synthetic peptide
  XENP016432 vlCDR1
RASQSVSSYLA

SEQ ID NO: 42662 - protein, 7 aa, Artificial Sequence
  Description of Artificial Sequence: Synthetic peptide
  XENP016432 vlCDR2
DASNRAT

SEQ ID NO: 42663 - protein, 9 aa, Artificial Sequence
  Description of Artificial Sequence: Synthetic peptide
  XENP016432 vlCDR3
QQSSNWPRT

SEQ ID NO: 42664 - protein, 446 aa, Artificial Sequence; identical to SEQ ID NO: 39254
  Description of Artificial Sequence: Synthetic polypeptide
  XENP27643 1C11_H3_L3.211_IgG1_PVA_/S267K Heavy Chain

SEQ ID NO: 42665 - protein, 117 aa, Artificial Sequence; identical to SEQ ID NO: 33034
  Description of Artificial Sequence: Synthetic polypeptide
  VH of XENP27643

SEQ ID NO: 42666 - protein, 5 aa, Artificial Sequence
  Description of Artificial Sequence: Synthetic peptide
  XENP27643 vhCDR1
HYGMN

SEQ ID NO: 42667 - protein, 17 aa, Artificial Sequence
  Description of Artificial Sequence: Synthetic peptide
  XENP27643 vhCDR2
WINTYTGEPTYADGFTG

SEQ ID NO: 42668 - protein, 8 aa, Artificial Sequence
  Description of Artificial Sequence: Synthetic peptide
  XENP27643 vhCDR3
DYYGSSPY

SEQ ID NO: 42669 - protein, 219 aa, Artificial Sequence
  Description of Artificial Sequence: Synthetic polypeptide
  XENP27643 1C11_H3_L3.211_IgG1_PVA_/S267K Light Chain
DVLMTQSPDSLAVSLGERATINCKSSQSIVHSNGNTYLEWYQQKPGQSPELLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42670 - protein, 112 aa, Artificial Sequence
  Description of Artificial Sequence: Synthetic polypeptide
  VL of XENP27643
DVLMTQSPDSLAVSLGERATINCKSSQSIVHSNGNTYLEWYQQKPGQSPELLIYKVSNRFSGVPDRFSGSGSGTDFTLTISSLQAEDVAVYYCFQGSHVPNTFGGGTKVEIK

SEQ ID NO: 42671 - protein, 16 aa, Artificial Sequence
  Description of Artificial Sequence: Synthetic peptide
  XENP27643 vlCDR1
KSSQSIVHSNGNTYLE

SEQ ID NO: 42672 - protein, 7 aa, Artificial Sequence
  Description of Artificial Sequence: Synthetic peptide
  XENP27643 vlCDR2
KVSNRFS

SEQ ID NO: 42673 - protein, 9 aa, Artificial Sequence
  Description of Artificial Sequence: Synthetic peptide
  XENP27643 vlCDR3
FQGSHVPNT

SEQ ID NO: 42674 - protein, 446 aa, Artificial Sequence; identical to SEQ ID NO: 39254
  Description of Artificial Sequence: Synthetic polypeptide
  XENP27644 1C11_H3_L3.212_IgG1_PVA_/S267K Heavy Chain

SEQ ID NO: 42675 - protein, 117 aa, Artificial Sequence; identical to SEQ ID NO: 33034
  Description of Artificial Sequence: Synthetic polypeptide
  VH of XENP27644

SEQ ID NO: 42676 - protein, 5 aa, Artificial Sequence
  Description of Artificial Sequence: Synthetic peptide
  XENP27644 vhCDR1
HYGMN

SEQ ID NO: 42677 - protein, 17 aa, Artificial Sequence
  Description of Artificial Sequence: Synthetic peptide
  XENP27644 vhCDR2
WINTYTGEPTYADGFTG

SEQ ID NO: 42678 - protein, 8 aa, Artificial Sequence
  Description of Artificial Sequence: Synthetic peptide
  XENP27644 vhCDR3
DYYGSSPY

SEQ ID NO: 42679 - protein, 219 aa, Artificial Sequence
  Description of Artificial Sequence: Synthetic polypeptide
  XENP27644 1C11_H3_L3.212_IgG1_PVA_/S267K Light Chain
DVLMTQSPDSLAVSLGERATINCKSSQSIVHSNGNTYLEWYQQKPGQSPQLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42680 - protein, 112 aa, Artificial Sequence
  Description of Artificial Sequence: Synthetic polypeptide
  VL of XENP27644
DVLMTQSPDSLAVSLGERATINCKSSQSIVHSNGNTYLEWYQQKPGQSPQLLIYKVSNRFSGVPDRFSGSGSGTDFTLTISSLQAEDVAVYYCFQGSHVPNTFGGGTKVEIK

SEQ ID NO: 42681 - protein, 16 aa, Artificial Sequence
  Description of Artificial Sequence: Synthetic peptide
  XENP27644 vlCDR1
KSSQSIVHSNGNTYLE

SEQ ID NO: 42682 - protein, 7 aa, Artificial Sequence
  Description of Artificial Sequence: Synthetic peptide
  XENP27644 vlCDR2
KVSNRFS

SEQ ID NO: 42683 - protein, 9 aa, Artificial Sequence
  Description of Artificial Sequence: Synthetic peptide
  XENP27644 vlCDR3
FQGSHVPNT

SEQ ID NO: 42684 - protein, 446 aa, Artificial Sequence; identical to SEQ ID NO: 39254
  Description of Artificial Sequence: Synthetic polypeptide
  XENP27645 1C11_H3_L3.213_IgG1_PVA_/S267K Heavy Chain

SEQ ID NO: 42685 - protein, 117 aa, Artificial Sequence; identical to SEQ ID NO: 33034
  Description of Artificial Sequence: Synthetic polypeptide
  VH of XENP27645

SEQ ID NO: 42686 - protein, 5 aa, Artificial Sequence
  Description of Artificial Sequence: Synthetic peptide
  XENP27645 vhCDR1
HYGMN

SEQ ID NO: 42687 - protein, 17 aa, Artificial Sequence
  Description of Artificial Sequence: Synthetic peptide
  XENP27645 vhCDR2
WINTYTGEPTYADGFTG

SEQ ID NO: 42688 - protein, 8 aa, Artificial Sequence
  Description of Artificial Sequence: Synthetic peptide
  XENP27645 vhCDR3
DYYGSSPY

SEQ ID NO: 42689 - protein, 219 aa, Artificial Sequence
  Description of Artificial Sequence: Synthetic polypeptide
  XENP27645 1C11_H3_L3.213_IgG1_PVA_/S267K Light Chain
DVLMTQSPDSLAVSLGERATINCKSSQSIVHSNGNTYLEWYQQKPGQSPTLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42690 - protein, 112 aa, Artificial Sequence
  Description of Artificial Sequence: Synthetic polypeptide
  VL of XENP27645
DVLMTQSPDSLAVSLGERATINCKSSQSIVHSNGNTYLEWYQQKPGQSPTLLIYKVSNRFSGVPDRFSGSGSGTDFTLTISSLQAEDVAVYYCFQGSHVPNTFGGGTKVEIK

SEQ ID NO: 42691 - protein, 16 aa, Artificial Sequence
  Description of Artificial Sequence: Synthetic peptide
  XENP27645 vlCDR1
KSSQSIVHSNGNTYLE

SEQ ID NO: 42692 - protein, 7 aa, Artificial Sequence
  Description of Artificial Sequence: Synthetic peptide
  XENP27645 vlCDR2
KVSNRFS

SEQ ID NO: 42693 - protein, 9 aa, Artificial Sequence
  Description of Artificial Sequence: Synthetic peptide
  XENP27645 vlCDR3
FQGSHVPNT

SEQ ID NO: 42694 - protein, 446 aa, Artificial Sequence; identical to SEQ ID NO: 39254
  Description of Artificial Sequence: Synthetic polypeptide
  XENP27646 1C11_H3_L3.214_IgG1_PVA_/S267K Heavy Chain

SEQ ID NO: 42695 - protein, 117 aa, Artificial Sequence; identical to SEQ ID NO: 33034
  Description of Artificial Sequence: Synthetic polypeptide
  VH of XENP27646

SEQ ID NO: 42696 - protein, 5 aa, Artificial Sequence
  Description of Artificial Sequence: Synthetic peptide
  XENP27646 vhCDR1
HYGMN

SEQ ID NO: 42697 - protein, 17 aa, Artificial Sequence
  Description of Artificial Sequence: Synthetic peptide
  XENP27646 vhCDR2
WINTYTGEPTYADGFTG

SEQ ID NO: 42698 - protein, 8 aa, Artificial Sequence
  Description of Artificial Sequence: Synthetic peptide
  XENP27646 vhCDR3
DYYGSSPY

SEQ ID NO: 42699 - protein, 219 aa, Artificial Sequence
  Description of Artificial Sequence: Synthetic polypeptide
  XENP27646 1C11_H3_L3.214_IgG1_PVA_/S267K Light Chain
DVLMTQSPDSLAVSLGERATINCKSSQSIVISNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42700 - protein, 112 aa, Artificial Sequence
  Description of Artificial Sequence: Synthetic polypeptide
  VL of XENP27646
DVLMTQSPDSLAVSLGERATINCKSSQSIVISNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42701 - protein, 16 aa, Artificial Sequence
  Description of Artificial Sequence: Synthetic peptide
  XENP27646 vlCDR1
KSSQSIVISNGNTYLE

SEQ ID NO: 42702 - protein, 7 aa, Artificial Sequence
  Description of Artificial Sequence: Synthetic peptide
  XENP27646 vlCDR2
KVSNRFS

SEQ ID NO: 42703 - protein, 9 aa, Artificial Sequence
  Description of Artificial Sequence: Synthetic peptide
  XENP27646 vlCDR3
FQGSHVPNT

SEQ ID NO: 42704 - protein, 446 aa, Artificial Sequence; identical to SEQ ID NO: 39254
  Description of Artificial Sequence: Synthetic polypeptide
  XENP27647 1C11_H3_L3.215_IgG1_PVA_/S267K Heavy Chain

SEQ ID NO: 42705 - protein, 117 aa, Artificial Sequence; identical to SEQ ID NO: 33034
  Description of Artificial Sequence: Synthetic polypeptide
  VH of XENP27647

SEQ ID NO: 42706 - protein, 5 aa, Artificial Sequence
  Description of Artificial Sequence: Synthetic peptide
  XENP27647 vhCDR1
HYGMN

SEQ ID NO: 42707 - protein, 17 aa, Artificial Sequence
  Description of Artificial Sequence: Synthetic peptide
  XENP27647 vhCDR2
WINTYTGEPTYADGFTG

SEQ ID NO: 42708 - protein, 8 aa, Artificial Sequence
  Description of Artificial Sequence: Synthetic peptide
  XENP27647 vhCDR3
DYYGSSPY

SEQ ID NO: 42709 - protein, 219 aa, Artificial Sequence
  Description of Artificial Sequence: Synthetic polypeptide
  XENP27647 1C11_H3_L3.215_IgG1_PVA_/S267K Light Chain
DVLMTQSPDSLAVSLGERATINCKSSQSIVLSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42710 - protein, 112 aa, Artificial Sequence
  Description of Artificial Sequence: Synthetic polypeptide
  VL of XENP27647
DVLMTQSPDSLAVSLGERATINCKSSQSIVLSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42711 - protein, 16 aa, Artificial Sequence
  Description of Artificial Sequence: Synthetic peptide
  XENP27647 vlCDR1
KSSQSIVLSNGNTYLE

SEQ ID NO: 42712 - protein, 7 aa, Artificial Sequence
  Description of Artificial Sequence: Synthetic peptide
  XENP27647 vlCDR2
KVSNRFS

SEQ ID NO: 42713 - protein, 9 aa, Artificial Sequence
  Description of Artificial Sequence: Synthetic peptide
  XENP27647 vlCDR3
FQGSHVPNT

SEQ ID NO: 42714 - protein, 446 aa, Artificial Sequence; identical to SEQ ID NO: 39254
  Description of Artificial Sequence: Synthetic polypeptide
  XENP27648 1C11_H3_L3.216_IgG1_PVA_/S267K Heavy Chain

SEQ ID NO: 42715 - protein, 117 aa, Artificial Sequence; identical to SEQ ID NO: 33034
  Description of Artificial Sequence: Synthetic polypeptide
  VH of XENP27648

SEQ ID NO: 42716 - protein, 5 aa, Artificial Sequence
  Description of Artificial Sequence: Synthetic peptide
  XENP27648 vhCDR1
HYGMN

SEQ ID NO: 42717 - protein, 17 aa, Artificial Sequence
  Description of Artificial Sequence: Synthetic peptide
  XENP27648 vhCDR2
WINTYTGEPTYADGFTG

SEQ ID NO: 42718 - protein, 8 aa, Artificial Sequence
  Description of Artificial Sequence: Synthetic peptide
  XENP27648 vhCDR3
DYYGSSPY

SEQ ID NO: 42719 - protein, 219 aa, Artificial Sequence
  Description of Artificial Sequence: Synthetic polypeptide
  XENP27648 1C11_H3_L3.216_IgG1_PVA_/S267K Light Chain
DVLMTQSPDSLAVSLGERATINCKSSQSIVVSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42720 - protein, 112 aa, Artificial Sequence
  Description of Artificial Sequence: Synthetic polypeptide
  VL of XENP27648
DVLMTQSPDSLAVSLGERATINCKSSQSIVVSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 42721 - protein, 16 aa, Artificial Sequence
  Description of Artificial Sequence: Synthetic peptide
  XENP27648 vlCDR1
KSSQSIVVSNGNTYLE

SEQ ID NO: 42722 - protein, 7 aa, Artificial Sequence
  Description of Artificial Sequence: Synthetic peptide
  XENP27648 vlCDR2
KVSNRFS

SEQ ID NO: 42723 - protein, 9 aa, Artificial Sequence
  Description of Artificial Sequence: Synthetic peptide
  XENP27648 vlCDR3
FQGSHVPNT

SEQ ID NO: 42724 - protein, 446 aa, Artificial Sequence; identical to SEQ ID NO: 39254
  Description of Artificial Sequence: Synthetic polypeptide
  XENP27649 1C11_H3_L3.217_IgG1_PVA_/S267K Heavy Chain

SEQ ID NO: 42725 - protein, 117 aa, Artificial Sequence; identical to SEQ ID NO: 33034
  Description of Artificial Sequence: Synthetic polypeptide
  VH of XENP27649

SEQ ID NO: 42726 - protein, 5 aa, Artificial Sequence
  Description of Artificial Sequence: Synthetic peptide
  XENP27649 vhCDR1
HYGMN

SEQ ID NO: 42727 - protein, 17 aa, Artificial Sequence
  Description of Artificial Sequence: Synthetic peptide
  XENP27649 vhCDR2
WINTYTGEPTYADGFTG

SEQ ID NO: 42728 - protein, 8 aa, Artificial Sequence
  Description of Artificial Sequence: Synthetic peptide
  XENP27649 vhCDR3
DYYGSSPY

SEQ ID NO: 42729 - protein, 219 aa, Artificial Sequence
  Description of Artificial Sequence: Synthetic polypeptide
  XENP27649 1C11_H3_L3.217_IgG1_PVA_/S267K Light Chain
DVLMTQSPDSLAVSLGERATINCKSSQSIVFSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42730 - protein, 112 aa, Artificial Sequence
  Description of Artificial Sequence: Synthetic polypeptide
  VL of XENP27649
DVLMTQSPDSLAVSLGERATINCKSSQSIVFSNGNNYLEWYQQKPGQSPKLLIYKVSNRFSGVPDRFSGSGSGTDFTLTISSLQAEDVAVYYCFQGSHVPNTFGGGTKVEIK

SEQ ID NO: 42731 - protein, 16 aa, Artificial Sequence
  Description of Artificial Sequence: Synthetic peptide
  XENP27649 vlCDR1
KSSQSIVFSNGNNYLE

SEQ ID NO: 42732 - protein, 7 aa, Artificial Sequence
  Description of Artificial Sequence: Synthetic peptide
  XENP27649 vlCDR2
KVSNRFS

SEQ ID NO: 42733 - protein, 9 aa, Artificial Sequence
  Description of Artificial Sequence: Synthetic peptide
  XENP27649 vlCDR3
FQGSHVPNT

SEQ ID NO: 42734 - protein, 446 aa, Artificial Sequence; identical to SEQ ID NO: 39254
  Description of Artificial Sequence: Synthetic polypeptide
  XENP27650 1C11_H3_L3.218_IgG1_PVA_/S267K Heavy Chain

SEQ ID NO: 42735 - protein, 117 aa, Artificial Sequence; identical to SEQ ID NO: 33034
  Description of Artificial Sequence: Synthetic polypeptide
  VH of XENP27650

SEQ ID NO: 42736 - protein, 5 aa, Artificial Sequence
  Description of Artificial Sequence: Synthetic peptide
  XENP27650 vhCDR1
HYGMN

SEQ ID NO: 42737 - protein, 17 aa, Artificial Sequence
  Description of Artificial Sequence: Synthetic peptide
  XENP27650 vhCDR2
WINTYTGEPTYADGFTG

SEQ ID NO: 42738 - protein, 8 aa, Artificial Sequence
  Description of Artificial Sequence: Synthetic peptide
  XENP27650 vhCDR3
DYYGSSPY

SEQ ID NO: 42739 - protein, 219 aa, Artificial Sequence
  Description of Artificial Sequence: Synthetic polypeptide
  XENP27650 1C11_H3_L3.218_IgG1_PVA_/S267K Light Chain
DVLMTQSPDSLAVSLGERATINCKSSQSIVYSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42740 - protein, 112 aa, Artificial Sequence
  Description of Artificial Sequence: Synthetic polypeptide
  VL of XENP27650
DVLMTQSPDSLAVSLGERATINCKSSQSIVYSNGNNYLEWYQQKPGQSPKLLIYKVSNRFSGVPDRFSGSGSGTDFTLTISSLQAEDVAVYYCFQGSHVPNTFGGGTKVEIK

SEQ ID NO: 42741 - protein, 16 aa, Artificial Sequence
  Description of Artificial Sequence: Synthetic peptide
  XENP27650 vlCDR1
KSSQSIVYSNGNNYLE

SEQ ID NO: 42742 - protein, 7 aa, Artificial Sequence
  Description of Artificial Sequence: Synthetic peptide
  XENP27650 vlCDR2
KVSNRFS

SEQ ID NO: 42743 - protein, 9 aa, Artificial Sequence
  Description of Artificial Sequence: Synthetic peptide
  XENP27650 vlCDR3
FQGSHVPNT

SEQ ID NO: 42744 - protein, 446 aa, Artificial Sequence; identical to SEQ ID NO: 39254
  Description of Artificial Sequence: Synthetic polypeptide
  XENP27651 1C11_H3_L3.219_IgG1_PVA_/S267K Heavy Chain

SEQ ID NO: 42745 - protein, 117 aa, Artificial Sequence; identical to SEQ ID NO: 33034
  Description of Artificial Sequence: Synthetic polypeptide
  VH of XENP27651

SEQ ID NO: 42746 - protein, 5 aa, Artificial Sequence
  Description of Artificial Sequence: Synthetic peptide
  XENP27651 vhCDR1
HYGMN

SEQ ID NO: 42747 - protein, 17 aa, Artificial Sequence
  Description of Artificial Sequence: Synthetic peptide
  XENP27651 vhCDR2
WINTYTGEPTYADGFTG

SEQ ID NO: 42748 - protein, 8 aa, Artificial Sequence
  Description of Artificial Sequence: Synthetic peptide
  XENP27651 vhCDR3
DYYGSSPY

SEQ ID NO: 42749 - protein, 219 aa, Artificial Sequence
  Description of Artificial Sequence: Synthetic polypeptide
  XENP27651 1C11_H3_L3.219_IgG1_PVA_/S267K Light Chain
DILMTQSPDSLAVSLGERATINCKSSQSIVFSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42750 - protein, 112 aa, Artificial Sequence
  Description of Artificial Sequence: Synthetic polypeptide
  VL of XENP27651
DILMTQSPDSLAVSLGERATINCKSSQSIVFSNGNNYLEWYQQKPGQSPKLLIYKVSNRFSGVPDRFSGSGSGTDFTLTISSLQAEDVAVYYCFQGSHVPNTFGGGTKVEIK

SEQ ID NO: 42751 - protein, 16 aa, Artificial Sequence
  Description of Artificial Sequence: Synthetic peptide
  XENP27651 vlCDR1
KSSQSIVFSNGNNYLE

SEQ ID NO: 42752 - protein, 7 aa, Artificial Sequence
  Description of Artificial Sequence: Synthetic peptide
  XENP27651 vlCDR2
KVSNRFS

SEQ ID NO: 42753 - protein, 9 aa, Artificial Sequence
  Description of Artificial Sequence: Synthetic peptide
  XENP27651 vlCDR3
FQGSHVPNT

SEQ ID NO: 42754 - protein, 446 aa, Artificial Sequence; identical to SEQ ID NO: 39254
  Description of Artificial Sequence: Synthetic polypeptide
  XENP27652 1C11_H3_L3.220_IgG1_PVA_/S267K Heavy Chain

SEQ ID NO: 42755 - protein, 117 aa, Artificial Sequence; identical to SEQ ID NO: 33034
  Description of Artificial Sequence: Synthetic polypeptide
  VH of XENP27652

SEQ ID NO: 42756 - protein, 5 aa, Artificial Sequence
  Description of Artificial Sequence: Synthetic peptide
  XENP27652 vhCDR1
HYGMN

SEQ ID NO: 42757 - protein, 17 aa, Artificial Sequence
  Description of Artificial Sequence: Synthetic peptide
  XENP27652 vhCDR2
WINTYTGEPTYADGFTG

SEQ ID NO: 42758 - protein, 8 aa, Artificial Sequence
  Description of Artificial Sequence: Synthetic peptide
  XENP27652 vhCDR3
DYYGSSPY

SEQ ID NO: 42759 - protein, 219 aa, Artificial Sequence
  Description of Artificial Sequence: Synthetic polypeptide
  XENP27652 1C11_H3_L3.220_IgG1_PVA_/S267K Light Chain
DILMTQSPDSLAVSLGERATINCKSSQSIVYSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42760 - protein, 112 aa, Artificial Sequence
  Description of Artificial Sequence: Synthetic polypeptide
  VL of XENP27652
DILMTQSPDSLAVSLGERATINCKSSQSIVYSNGNNYLEWYQQKPGQSPKLLIYKVSNRFSGVPDRFSGSGSGTDFTLTISSLQAEDVAVYYCFQGSHVPNTFGGGTKVEIK

SEQ ID NO: 42761 - protein, 16 aa, Artificial Sequence
  Description of Artificial Sequence: Synthetic peptide
  XENP27652 vlCDR1
KSSQSIVYSNGNNYLE

SEQ ID NO: 42762 - protein, 7 aa, Artificial Sequence
  Description of Artificial Sequence: Synthetic peptide
  XENP27652 vlCDR2
KVSNRFS

SEQ ID NO: 42763 - protein, 9 aa, Artificial Sequence
  Description of Artificial Sequence: Synthetic peptide
  XENP27652 vlCDR3
FQGSHVPNT

SEQ ID NO: 42764 - protein, 446 aa, Artificial Sequence
  Description of Artificial Sequence: Synthetic polypeptide
  XENP27839 1C11_H3.309_L3_IgG1_PVA_/S267K Heavy Chain
QIQLVQSESELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42765 - protein, 117 aa, Artificial Sequence
  Description of Artificial Sequence: Synthetic polypeptide
  VH of XENP27839
QIQLVQSESELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 42766 - protein, 5 aa, Artificial Sequence
  Description of Artificial Sequence: Synthetic peptide
  XENP27839 vhCDR1
HYGMN

SEQ ID NO: 42767 - protein, 17 aa, Artificial Sequence
  Description of Artificial Sequence: Synthetic peptide
  XENP27839 vhCDR2
WINTYTGEPTYADGFTG

SEQ ID NO: 42768 - protein, 8 aa, Artificial Sequence
  Description of Artificial Sequence: Synthetic peptide
  XENP27839 vhCDR3
DYYGSSPY

SEQ ID NO: 42769 - protein, 219 aa, Artificial Sequence; identical to SEQ ID NO: 33008
  Description of Artificial Sequence: Synthetic polypeptide
  XENP27839 1C11_H3.309_L3_IgG1_PVA_/S267K Light Chain

SEQ ID NO: 42770 - protein, 112 aa, Artificial Sequence; identical to SEQ ID NO: 33009
  Description of Artificial Sequence: Synthetic polypeptide
  VL of XENP27839

SEQ ID NO: 42771 - protein, 16 aa, Artificial Sequence
  Description of Artificial Sequence: Synthetic peptide
  XENP27839 vlCDR1
KSSQSIVHSNGNTYLE

SEQ ID NO: 42772 - protein, 7 aa, Artificial Sequence
  Description of Artificial Sequence: Synthetic peptide
  XENP27839 vlCDR2
KVSNRFS

SEQ ID NO: 42773 - protein, 9 aa, Artificial Sequence
  Description of Artificial Sequence: Synthetic peptide
  XENP27839 vlCDR3
FQGSHVPNT

SEQ ID NO: 42774 - protein, 446 aa, Artificial Sequence
  Description of Artificial Sequence: Synthetic polypeptide
  XENP27840 1C11_H3.310_L3_IgG1_PVA_/S267K Heavy Chain
QIQLVQSSSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42775 - protein, 117 aa, Artificial Sequence
  Description of Artificial Sequence: Synthetic polypeptide
  VH of XENP27840
QIQLVQSSSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 42776 - protein, 5 aa, Artificial Sequence
  Description of Artificial Sequence: Synthetic peptide
  XENP27840 vhCDR1
HYGMN

SEQ ID NO: 42777 - protein, 17 aa, Artificial Sequence
  Description of Artificial Sequence: Synthetic peptide
  XENP27840 vhCDR2
WINTYTGEPTYADGFTG

SEQ ID NO: 42778 - protein, 8 aa, Artificial Sequence
  Description of Artificial Sequence: Synthetic peptide
  XENP27840 vhCDR3
DYYGSSPY

SEQ ID NO: 42779 - protein, 219 aa, Artificial Sequence; identical to SEQ ID NO: 33008
  Description of Artificial Sequence: Synthetic polypeptide
  XENP27840 1C11_H3.310_L3_IgG1_PVA_/S267K Light Chain

SEQ ID NO: 42780 - protein, 112 aa, Artificial Sequence; identical to SEQ ID NO: 33009
  Description of Artificial Sequence: Synthetic polypeptide
  VL of XENP27840

SEQ ID NO: 42781 - protein, 16 aa, Artificial Sequence
  Description of Artificial Sequence: Synthetic peptide
  XENP27840 vlCDR1
KSSQSIVHSNGNTYLE

SEQ ID NO: 42782 - protein, 7 aa, Artificial Sequence
  Description of Artificial Sequence: Synthetic peptide
  XENP27840 vlCDR2
KVSNRFS

SEQ ID NO: 42783 - protein, 9 aa, Artificial Sequence
  Description of Artificial Sequence: Synthetic peptide
  XENP27840 vlCDR3
FQGSHVPNT

SEQ ID NO: 42784 - protein, 446 aa, Artificial Sequence
  Description of Artificial Sequence: Synthetic polypeptide
  XENP27841 1C11_H3.311_L3_IgG1_PVA_/S267K Heavy Chain
QIQLVQSVSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42785 - protein, 117 aa, Artificial Sequence
  Description of Artificial Sequence: Synthetic polypeptide
  VH of XENP27841
QIQLVQSVSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 42786 - protein, 5 aa, Artificial Sequence
  Description of Artificial Sequence: Synthetic peptide
  XENP27841 vhCDR1
HYGMN

SEQ ID NO: 42787 - protein, 17 aa, Artificial Sequence
  Description of Artificial Sequence: Synthetic peptide
  XENP27841 vhCDR2
WINTYTGEPTYADGFTG

SEQ ID NO: 42788 - protein, 8 aa, Artificial Sequence
  Description of Artificial Sequence: Synthetic peptide
  XENP27841 vhCDR3
DYYGSSPY

SEQ ID NO: 42789 - protein, 219 aa, Artificial Sequence; identical to SEQ ID NO: 33008
  Description of Artificial Sequence: Synthetic polypeptide
  XENP27841 1C11_H3.311_L3_IgG1_PVA_/S267K Light Chain

SEQ ID NO: 42790 - protein, 112 aa, Artificial Sequence; identical to SEQ ID NO: 33009
  Description of Artificial Sequence: Synthetic polypeptide
  VL of XENP27841

SEQ ID NO: 42791 - protein, 16 aa, Artificial Sequence
  Description of Artificial Sequence: Synthetic peptide
  XENP27841 vlCDR1
KSSQSIVHSNGNTYLE

SEQ ID NO: 42792 - protein, 7 aa, Artificial Sequence
  Description of Artificial Sequence: Synthetic peptide
  XENP27841 vlCDR2
KVSNRFS

SEQ ID NO: 42793 - protein, 9 aa, Artificial Sequence
  Description of Artificial Sequence: Synthetic peptide
  XENP27841 vlCDR3
FQGSHVPNT

SEQ ID NO: 42794 - protein, 446 aa, Artificial Sequence
  Description of Artificial Sequence: Synthetic polypeptide
  XENP27842 1C11_H3.312_L3_IgG1_PVA_/S267K Heavy Chain
QIQLVQSGSELTKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42795 - protein, 117 aa, Artificial Sequence
  Description of Artificial Sequence: Synthetic polypeptide
  VH of XENP27842
QIQLVQSGSELTKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 42796 - protein, 5 aa, Artificial Sequence
  Description of Artificial Sequence: Synthetic peptide
  XENP27842 vhCDR1
HYGMN

SEQ ID NO: 42797 - protein, 17 aa, Artificial Sequence
  Description of Artificial Sequence: Synthetic peptide
  XENP27842 vhCDR2
WINTYTGEPTYADGFTG

SEQ ID NO: 42798 - protein, 8 aa, Artificial Sequence
  Description of Artificial Sequence: Synthetic peptide
  XENP27842 vhCDR3
DYYGSSPY

SEQ ID NO: 42799 - protein, 219 aa, Artificial Sequence; identical to SEQ ID NO: 33008
  Description of Artificial Sequence: Synthetic polypeptide
  XENP27842 1C11_H3.312_L3_IgG1_PVA_/S267K Light Chain

SEQ ID NO: 42800 - protein, 112 aa, Artificial Sequence; identical to SEQ ID NO: 33009
  Description of Artificial Sequence: Synthetic polypeptide
  VL of XENP27842

SEQ ID NO: 42801 - protein, 16 aa, Artificial Sequence
  Description of Artificial Sequence: Synthetic peptide
  XENP27842 vlCDR1
KSSQSIVHSNGNTYLE

SEQ ID NO: 42802 - protein, 7 aa, Artificial Sequence
  Description of Artificial Sequence: Synthetic peptide
  XENP27842 vlCDR2
KVSNRFS

SEQ ID NO: 42803 - protein, 9 aa, Artificial Sequence
  Description of Artificial Sequence: Synthetic peptide
  XENP27842 vlCDR3
FQGSHVPNT

SEQ ID NO: 42804 - protein, 446 aa, Artificial Sequence
  Description of Artificial Sequence: Synthetic polypeptide
  XENP27843 1C11_H3.313_L3_IgG1_PVA_/S267K Heavy Chain
QIQLVQSGSELQKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42805 - protein, 117 aa, Artificial Sequence
  Description of Artificial Sequence: Synthetic polypeptide
  VH of XENP27843
QIQLVQSGSELQKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 42806 - protein, 5 aa, Artificial Sequence
  Description of Artificial Sequence: Synthetic peptide
  XENP27843 vhCDR1
HYGMN

SEQ ID NO: 42807 - protein, 17 aa, Artificial Sequence
  Description of Artificial Sequence: Synthetic peptide
  XENP27843 vhCDR2
WINTYTGEPTYADGFTG

SEQ ID NO: 42808 - protein, 8 aa, Artificial Sequence
  Description of Artificial Sequence: Synthetic peptide
  XENP27843 vhCDR3
DYYGSSPY

SEQ ID NO: 42809 - protein, 219 aa, Artificial Sequence; identical to SEQ ID NO: 33008
  Description of Artificial Sequence: Synthetic polypeptide
  XENP27843 1C11_H3.313_L3_IgG1_PVA_/S267K Light Chain

SEQ ID NO: 42810 - protein, 112 aa, Artificial Sequence; identical to SEQ ID NO: 33009
  Description of Artificial Sequence: Synthetic polypeptide
  VL of XENP27843

SEQ ID NO: 42811 - protein, 16 aa, Artificial Sequence
  Description of Artificial Sequence: Synthetic peptide
  XENP27843 vlCDR1
KSSQSIVHSNGNTYLE

SEQ ID NO: 42812 - protein, 7 aa, Artificial Sequence
  Description of Artificial Sequence: Synthetic peptide
  XENP27843 vlCDR2
KVSNRFS

SEQ ID NO: 42813 - protein, 9 aa, Artificial Sequence
  Description of Artificial Sequence: Synthetic peptide
  XENP27843 vlCDR3
FQGSHVPNT

SEQ ID NO: 42814 - protein, 446 aa, Artificial Sequence
  Description of Artificial Sequence: Synthetic polypeptide
  XENP27844 1C11_H3.314_L3_IgG1_PVA_/S267K Heavy Chain
QIQLVQSGSELYKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42815 - protein, 117 aa, Artificial Sequence
  Description of Artificial Sequence: Synthetic polypeptide
  VH of XENP27844
QIQLVQSGSELYKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 42816 - protein, 5 aa, Artificial Sequence
  Description of Artificial Sequence: Synthetic peptide
  XENP27844 vhCDR1
HYGMN

SEQ ID NO: 42817 - protein, 17 aa, Artificial Sequence
  Description of Artificial Sequence: Synthetic peptide
  XENP27844 vhCDR2
WINTYTGEPTYADGFTG

SEQ ID NO: 42818 - protein, 8 aa, Artificial Sequence
  Description of Artificial Sequence: Synthetic peptide
  XENP27844 vhCDR3
DYYGSSPY

SEQ ID NO: 42819 - protein, 219 aa, Artificial Sequence; identical to SEQ ID NO: 33008
  Description of Artificial Sequence: Synthetic polypeptide
  XENP27844 1C11_H3.314_L3_IgG1_PVA_/S267K Light Chain

SEQ ID NO: 42820 - protein, 112 aa, Artificial Sequence; identical to SEQ ID NO: 33009
  Description of Artificial Sequence: Synthetic polypeptide
  VL of XENP27844

SEQ ID NO: 42821 - protein, 16 aa, Artificial Sequence
  Description of Artificial Sequence: Synthetic peptide
  XENP27844 vlCDR1
KSSQSIVHSNGNTYLE

SEQ ID NO: 42822 - protein, 7 aa, Artificial Sequence
  Description of Artificial Sequence: Synthetic peptide
  XENP27844 vlCDR2
KVSNRFS

SEQ ID NO: 42823 - protein, 9 aa, Artificial Sequence
  Description of Artificial Sequence: Synthetic peptide
  XENP27844 vlCDR3
FQGSHVPNT

SEQ ID NO: 42824 - protein, 446 aa, Artificial Sequence
  Description of Artificial Sequence: Synthetic polypeptide
  XENP27845 1C11_H3.315_L3_IgG1_PVA_/S267K Heavy Chain
QIQLVQSGSELLKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42825 - protein, 117 aa, Artificial Sequence
  Description of Artificial Sequence: Synthetic polypeptide
  VH of XENP27845
QIQLVQSGSELLKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 42826 - protein, 5 aa, Artificial Sequence
  Description of Artificial Sequence: Synthetic peptide
  XENP27845 vhCDR1
HYGMN

SEQ ID NO: 42827 - protein, 17 aa, Artificial Sequence
  Description of Artificial Sequence: Synthetic peptide
  XENP27845 vhCDR2
WINTYTGEPTYADGFTG

SEQ ID NO: 42828 - protein, 8 aa, Artificial Sequence
  Description of Artificial Sequence: Synthetic peptide
  XENP27845 vhCDR3
DYYGSSPY

SEQ ID NO: 42829 - protein, 219 aa, Artificial Sequence; identical to SEQ ID NO: 33008
  Description of Artificial Sequence: Synthetic polypeptide
  XENP27845 1C11_H3.315_L3_IgG1_PVA_/S267K Light Chain

SEQ ID NO: 42830 - protein, 112 aa, Artificial Sequence; identical to SEQ ID NO: 33009
  Description of Artificial Sequence: Synthetic polypeptide
  VL of XENP27845

SEQ ID NO: 42831 - protein, 16 aa, Artificial Sequence
  Description of Artificial Sequence: Synthetic peptide
  XENP27845 vlCDR1
KSSQSIVHSNGNTYLE

SEQ ID NO: 42832 - protein, 7 aa, Artificial Sequence
  Description of Artificial Sequence: Synthetic peptide
  XENP27845 vlCDR2
KVSNRFS

SEQ ID NO: 42833 - protein, 9 aa, Artificial Sequence
  Description of Artificial Sequence: Synthetic peptide
  XENP27845 vlCDR3
FQGSHVPNT

SEQ ID NO: 42834 - protein, 446 aa, Artificial Sequence
  Description of Artificial Sequence: Synthetic polypeptide
  XENP27846 1C11_H3.316_L3_IgG1_PVA_/S267K Heavy Chain
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42835 - protein, 117 aa, Artificial Sequence; identical to SEQ ID NO: 34478
  Description of Artificial Sequence: Synthetic polypeptide
  VH of XENP27846

SEQ ID NO: 42836 - protein, 5 aa, Artificial Sequence
  Description of Artificial Sequence: Synthetic peptide
  XENP27846 vhCDR1
HYGMN

SEQ ID NO: 42837 - protein, 17 aa, Artificial Sequence
  Description of Artificial Sequence: Synthetic peptide
  XENP27846 vhCDR2
WINTYTGEPTYADGFTG

SEQ ID NO: 42838 - protein, 8 aa, Artificial Sequence
  Description of Artificial Sequence: Synthetic peptide
  XENP27846 vhCDR3
DYYGSSPY

SEQ ID NO: 42839 - protein, 219 aa, Artificial Sequence; identical to SEQ ID NO: 33008
  Description of Artificial Sequence: Synthetic polypeptide
  XENP27846 1C11_H3.316_L3_IgG1_PVA_/S267K Light Chain

SEQ ID NO: 42840 - protein, 112 aa, Artificial Sequence; identical to SEQ ID NO: 33009
  Description of Artificial Sequence: Synthetic polypeptide
  VL of XENP27846

SEQ ID NO: 42841 - protein, 16 aa, Artificial Sequence
  Description of Artificial Sequence: Synthetic peptide
  XENP27846 vlCDR1
KSSQSIVHSNGNTYLE

SEQ ID NO: 42842 - protein, 7 aa, Artificial Sequence
  Description of Artificial Sequence: Synthetic peptide
  XENP27846 vlCDR2
KVSNRFS

SEQ ID NO: 42843 - protein, 9 aa, Artificial Sequence
  Description of Artificial Sequence: Synthetic peptide
  XENP27846 vlCDR3
FQGSHVPNT

SEQ ID NO: 42844 - protein, 446 aa, Artificial Sequence
  Description of Artificial Sequence: Synthetic polypeptide
  XENP27847 1C11_H3.317_L3_IgG1_PVA_/S267K Heavy Chain
QIQLVQSGSELKKPGASVTVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42845 - protein, 117 aa, Artificial Sequence
  Description of Artificial Sequence: Synthetic polypeptide
  VH of XENP27847
QIQLVQSGSELKKPGASVTVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 42846 - protein, 5 aa, Artificial Sequence
  Description of Artificial Sequence: Synthetic peptide
  XENP27847 vhCDR1
HYGMN

SEQ ID NO: 42847 - protein, 17 aa, Artificial Sequence
  Description of Artificial Sequence: Synthetic peptide
  XENP27847 vhCDR2
WINTYTGEPTYADGFTG

SEQ ID NO: 42848 - protein, 8 aa, Artificial Sequence
  Description of Artificial Sequence: Synthetic peptide
  XENP27847 vhCDR3
DYYGSSPY

SEQ ID NO: 42849 - protein, 219 aa, Artificial Sequence; identical to SEQ ID NO: 33008
  Description of Artificial Sequence: Synthetic polypeptide
  XENP27847 1C11_H3.317_L3_IgG1_PVA_/S267K Light Chain

SEQ ID NO: 42850 - protein, 112 aa, Artificial Sequence; identical to SEQ ID NO: 33009
  Description of Artificial Sequence: Synthetic polypeptide
  VL of XENP27847

SEQ ID NO: 42851 - protein, 16 aa, Artificial Sequence
  Description of Artificial Sequence: Synthetic peptide
  XENP27847 vlCDR1
KSSQSIVHSNGNTYLE

SEQ ID NO: 42852 - protein, 7 aa, Artificial Sequence
  Description of Artificial Sequence: Synthetic peptide
  XENP27847 vlCDR2
KVSNRFS

SEQ ID NO: 42853 - protein, 9 aa, Artificial Sequence
  Description of Artificial Sequence: Synthetic peptide
  XENP27847 vlCDR3
FQGSHVPNT

SEQ ID NO: 42854 - protein, 446 aa, Artificial Sequence
  Description of Artificial Sequence: Synthetic polypeptide
  XENP27848 1C11_H3.318_L3_IgG1_PVA_/S267K Heavy Chain
QIQLVQSGSELVKPGASVTVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42855 - protein, 117 aa, Artificial Sequence
  Description of Artificial Sequence: Synthetic polypeptide
  VH of XENP27848
QIQLVQSGSELVKPGASVTVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 42856 - protein, 5 aa, Artificial Sequence
  Description of Artificial Sequence: Synthetic peptide
  XENP27848 vhCDR1
HYGMN

SEQ ID NO: 42857 - protein, 17 aa, Artificial Sequence
  Description of Artificial Sequence: Synthetic peptide
  XENP27848 vhCDR2
WINTYTGEPTYADGFTG

SEQ ID NO: 42858 - protein, 8 aa, Artificial Sequence
  Description of Artificial Sequence: Synthetic peptide
  XENP27848 vhCDR3
DYYGSSPY

SEQ ID NO: 42859 - protein, 219 aa, Artificial Sequence; identical to SEQ ID NO: 33008
  Description of Artificial Sequence: Synthetic polypeptide
  XENP27848 1C11_H3.318_L3_IgG1_PVA_/S267K Light Chain

SEQ ID NO: 42860 - protein, 112 aa, Artificial Sequence; identical to SEQ ID NO: 33009
  Description of Artificial Sequence: Synthetic polypeptide
  VL of XENP27848

SEQ ID NO: 42861 - protein, 16 aa, Artificial Sequence
  Description of Artificial Sequence: Synthetic peptide
  XENP27848 vlCDR1
KSSQSIVHSNGNTYLE

SEQ ID NO: 42862 - protein, 7 aa, Artificial Sequence
  Description of Artificial Sequence: Synthetic peptide
  XENP27848 vlCDR2
KVSNRFS

SEQ ID NO: 42863 - protein, 9 aa, Artificial Sequence
  Description of Artificial Sequence: Synthetic peptide
  XENP27848 vlCDR3
FQGSHVPNT

SEQ ID NO: 42864 - protein, 446 aa, Artificial Sequence
  Description of Artificial Sequence: Synthetic polypeptide
  XENP27849 1C11_H3.319_L3_IgG1_PVA_/S267K Heavy Chain
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42865 - protein, 117 aa, Artificial Sequence
  Description of Artificial Sequence: Synthetic polypeptide
  VH of XENP27849
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYFGSSPYWGQGTLVTVSS

SEQ ID NO: 42866 - protein, 5 aa, Artificial Sequence
  Description of Artificial Sequence: Synthetic peptide
  XENP27849 vhCDR1
HYGMN

SEQ ID NO: 42867 - protein, 17 aa, Artificial Sequence
  Description of Artificial Sequence: Synthetic peptide
  XENP27849 vhCDR2
WINTYTGEPTYADGFTG

SEQ ID NO: 42868 - protein, 8 aa, Artificial Sequence
  Description of Artificial Sequence: Synthetic peptide
  XENP27849 vhCDR3
DYFGSSPY

SEQ ID NO: 42869 - protein, 219 aa, Artificial Sequence; identical to SEQ ID NO: 33008
  Description of Artificial Sequence: Synthetic polypeptide
  XENP27849 1C11_H3.319_L3_IgG1_PVA_/S267K Light Chain

SEQ ID NO: 42870 - protein, 112 aa, Artificial Sequence; identical to SEQ ID NO: 33009
  Description of Artificial Sequence: Synthetic polypeptide
  VL of XENP27849

SEQ ID NO: 42871 - protein, 16 aa, Artificial Sequence
  Description of Artificial Sequence: Synthetic peptide
  XENP27849 vlCDR1
KSSQSIVHSNGNTYLE

SEQ ID NO: 42872 - protein, 7 aa, Artificial Sequence
  Description of Artificial Sequence: Synthetic peptide
  XENP27849 vlCDR2
KVSNRFS

SEQ ID NO: 42873 - protein, 9 aa, Artificial Sequence
  Description of Artificial Sequence: Synthetic peptide
  XENP27849 vlCDR3
FQGSHVPNT

SEQ ID NO: 42874 - protein, 446 aa, Artificial Sequence
  Description of Artificial Sequence: Synthetic polypeptide
  XENP27850 1C11_H3.320_L3_IgG1_PVA_/S267K Heavy Chain
QIQLVQSGSELKKPGASVKVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42875 - protein, 117 aa, Artificial Sequence
  Description of Artificial Sequence: Synthetic polypeptide
  VH of XENP27850
QIQLVQSGSELKKPGASVKVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSS

SEQ ID NO: 42876 - protein, 5 aa, Artificial Sequence
  Description of Artificial Sequence: Synthetic peptide
  XENP27850 vhCDR1
HYGMN

SEQ ID NO: 42877 - protein, 17 aa, Artificial Sequence
  Description of Artificial Sequence: Synthetic peptide
  XENP27850 vhCDR2
WINTHTGEPTYADGFTG

SEQ ID NO: 42878 - protein, 8 aa, Artificial Sequence
  Description of Artificial Sequence: Synthetic peptide
  XENP27850 vhCDR3
DYFGSSPY

SEQ ID NO: 42879 - protein, 219 aa, Artificial Sequence; identical to SEQ ID NO: 33008
  Description of Artificial Sequence: Synthetic polypeptide
  XENP27850 1C11_H3.320_L3_IgG1_PVA_/S267K Light Chain

SEQ ID NO: 42880 - protein, 112 aa, Artificial Sequence; identical to SEQ ID NO: 33009
  Description of Artificial Sequence: Synthetic polypeptide
  VL of XENP27850

SEQ ID NO: 42881 - protein, 16 aa, Artificial Sequence
  Description of Artificial Sequence: Synthetic peptide
  XENP27850 vlCDR1
KSSQSIVHSNGNTYLE

SEQ ID NO: 42882 - protein, 7 aa, Artificial Sequence
  Description of Artificial Sequence: Synthetic peptide
  XENP27850 vlCDR2
KVSNRFS

SEQ ID NO: 42883 - protein, 9 aa, Artificial Sequence
  Description of Artificial Sequence: Synthetic peptide
  XENP27850 vlCDR3
FQGSHVPNT

SEQ ID NO: 42884 - protein, 446 aa, Artificial Sequence
  Description of Artificial Sequence: Synthetic polypeptide
  XENP27851 1C11_H3.321_L3_IgG1_PVA_/S267K Heavy Chain
QIQLVQSGSELKKPGASVKVSCKASGYTFTHYGMNWVRQAPGQGLEWMGWINTYSGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42885 - protein, 117 aa, Artificial Sequence
  Description of Artificial Sequence: Synthetic polypeptide
  VH of XENP27851
QIQLVQSGSELKKPGASVKVSCKASGYTFTHYGMNWVRQAPGQGLEWMGWINTYSGEPTYADGFTGRFVFSLDTSVSTAYLQISSLKAEDTAVYFCARDYFGSSPYWGQGTLVTVSS

SEQ ID NO: 42886 - protein, 5 aa, Artificial Sequence
  Description of Artificial Sequence: Synthetic peptide
  XENP27851 vhCDR1
HYGMN

SEQ ID NO: 42887 - protein, 17 aa, Artificial Sequence
  Description of Artificial Sequence: Synthetic peptide
  XENP27851 vhCDR2
WINTYSGEPTYADGFTG

SEQ ID NO: 42888 - protein, 8 aa, Artificial Sequence
  Description of Artificial Sequence: Synthetic peptide
  XENP27851 vhCDR3
DYFGSSPY

SEQ ID NO: 42889 - protein, 219 aa, Artificial Sequence; identical to SEQ ID NO: 33008
  Description of Artificial Sequence: Synthetic polypeptide
  XENP27851 1C11_H3.321_L3_IgG1_PVA_/S267K Light Chain

SEQ ID NO: 42890 - protein, 112 aa, Artificial Sequence; identical to SEQ ID NO: 33009
  Description of Artificial Sequence: Synthetic polypeptide
  VL of XENP27851

SEQ ID NO: 42891 - protein, 16 aa, Artificial Sequence
  Description of Artificial Sequence: Synthetic peptide
  XENP27851 vlCDR1
KSSQSIVHSNGNTYLE

SEQ ID NO: 42892 - protein, 7 aa, Artificial Sequence
  Description of Artificial Sequence: Synthetic peptide
  XENP27851 vlCDR2
KVSNRFS

SEQ ID NO: 42893 - protein, 9 aa, Artificial Sequence
  Description of Artificial Sequence: Synthetic peptide
  XENP27851 vlCDR3
FQGSHVPNT

SEQ ID NO: 42894 - protein, 446 aa, Artificial Sequence
  Description of Artificial Sequence: Synthetic polypeptide
  XENP27852 1C11_H3.322_L3_IgG1_PVA_/S267K Heavy Chain
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42895 - protein, 117 aa, Artificial Sequence
  Description of Artificial Sequence: Synthetic polypeptide
  VH of XENP27852
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYFGSSPYWGQGTLVTVSS

SEQ ID NO: 42896 - protein, 5 aa, Artificial Sequence
  Description of Artificial Sequence: Synthetic peptide
  XENP27852 vhCDR1
HYGMN

SEQ ID NO: 42897 - protein, 17 aa, Artificial Sequence
  Description of Artificial Sequence: Synthetic peptide
  XENP27852 vhCDR2
WINTYTSEPTYADGFTG

SEQ ID NO: 42898 - protein, 8 aa, Artificial Sequence
  Description of Artificial Sequence: Synthetic peptide
  XENP27852 vhCDR3
DYFGSSPY

SEQ ID NO: 42899 - protein, 219 aa, Artificial Sequence; identical to SEQ ID NO: 33008
  Description of Artificial Sequence: Synthetic polypeptide
  XENP27852 1C11_H3.322_L3_IgG1_PVA_/S267K Light Chain

SEQ ID NO: 42900 - protein, 112 aa, Artificial Sequence; identical to SEQ ID NO: 33009
  Description of Artificial Sequence: Synthetic polypeptide
  VL of XENP27852

SEQ ID NO: 42901 - protein, 16 aa, Artificial Sequence
  Description of Artificial Sequence: Synthetic peptide
  XENP27852 vlCDR1
KSSQSIVHSNGNTYLE

SEQ ID NO: 42902 - protein, 7 aa, Artificial Sequence
  Description of Artificial Sequence: Synthetic peptide
  XENP27852 vlCDR2
KVSNRFS

SEQ ID NO: 42903 - protein, 9 aa, Artificial Sequence
  Description of Artificial Sequence: Synthetic peptide
  XENP27852 vlCDR3
FQGSHVPNT

SEQ ID NO: 42904 - protein, 446 aa, Artificial Sequence
  Description of Artificial Sequence: Synthetic polypeptide
  XENP27853 1C11_H3.323_L3_IgG1_PVA_/S267K Heavy Chain
QIQLVQSGSELKKPGASVKVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42905 - protein, 117 aa, Artificial Sequence
  Description of Artificial Sequence: Synthetic polypeptide
  VH of XENP27853
QIQLVQSGSELKKPGASVKVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSS

SEQ ID NO: 42906 - protein, 5 aa, Artificial Sequence
  Description of Artificial Sequence: Synthetic peptide
  XENP27853 vhCDR1
HYGMN

SEQ ID NO: 42907 - protein, 17 aa, Artificial Sequence
  Description of Artificial Sequence: Synthetic peptide
  XENP27853 vhCDR2
WINTHSGEPTYADGFTG

SEQ ID NO: 42908 - protein, 8 aa, Artificial Sequence
  Description of Artificial Sequence: Synthetic peptide
  XENP27853 vhCDR3
DYYGSSPY

SEQ ID NO: 42909 - protein, 219 aa, Artificial Sequence; identical to SEQ ID NO: 33008
  Description of Artificial Sequence: Synthetic polypeptide
  XENP27853 1C11_H3.323_L3_IgG1_PVA_/S267K Light Chain

SEQ ID NO: 42910 - protein, 112 aa, Artificial Sequence; identical to SEQ ID NO: 33009
  Description of Artificial Sequence: Synthetic polypeptide
  VL of XENP27853

SEQ ID NO: 42911 - protein, 16 aa, Artificial Sequence
  Description of Artificial Sequence: Synthetic peptide
  XENP27853 vlCDR1
KSSQSIVHSNGNTYLE

SEQ ID NO: 42912 - protein, 7 aa, Artificial Sequence
  Description of Artificial Sequence: Synthetic peptide
  XENP27853 vlCDR2
KVSNRFS

SEQ ID NO: 42913 - protein, 9 aa, Artificial Sequence
  Description of Artificial Sequence: Synthetic peptide
  XENP27853 vlCDR3
FQGSHVPNT

SEQ ID NO: 42914 - protein, 446 aa, Artificial Sequence
  Description of Artificial Sequence: Synthetic polypeptide
  XENP27854 1C11_H3.324_L3_IgG1_PVA_/S267K Heavy Chain
QIQLVQSGSELKKPGASVKVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42915 - protein, 117 aa, Artificial Sequence
  Description of Artificial Sequence: Synthetic polypeptide
  VH of XENP27854
QIQLVQSGSELKKPGASVKVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSS

SEQ ID NO: 42916 - protein, 5 aa, Artificial Sequence
  Description of Artificial Sequence: Synthetic peptide
  XENP27854 vhCDR1
HYGMN

SEQ ID NO: 42917 - protein, 17 aa, Artificial Sequence
  Description of Artificial Sequence: Synthetic peptide
  XENP27854 vhCDR2
WINTHSGEPTYADGFTG

SEQ ID NO: 42918 - protein, 8 aa, Artificial Sequence
  Description of Artificial Sequence: Synthetic peptide
  XENP27854 vhCDR3
DYFGSSPY

SEQ ID NO: 42919 - protein, 219 aa, Artificial Sequence; identical to SEQ ID NO: 33008
  Description of Artificial Sequence: Synthetic polypeptide
  XENP27854 1C11_H3.324_L3_IgG1_PVA_/S267K Light Chain

SEQ ID NO: 42920 - protein, 112 aa, Artificial Sequence; identical to SEQ ID NO: 33009
  Description of Artificial Sequence: Synthetic polypeptide
  VL of XENP27854

SEQ ID NO: 42921 - protein, 16 aa, Artificial Sequence
  Description of Artificial Sequence: Synthetic peptide
  XENP27854 vlCDR1
KSSQSIVHSNGNTYLE

SEQ ID NO: 42922 - protein, 7 aa, Artificial Sequence
  Description of Artificial Sequence: Synthetic peptide
  XENP27854 vlCDR2
KVSNRFS

SEQ ID NO: 42923 - protein, 9 aa, Artificial Sequence
  Description of Artificial Sequence: Synthetic peptide
  XENP27854 vlCDR3
FQGSHVPNT

SEQ ID NO: 42924 - protein, 446 aa, Artificial Sequence
  Description of Artificial Sequence: Synthetic polypeptide
  XENP27855 1C11_H3.325_L3_IgG1_PVA_/S267K Heavy Chain
QIQLVQSGSELKKPGASVKVSCKASGYTFTHYGMNWVRQAPGQGLEWMGWINTHSGEPTYADGFTGRFVFSLDTSQSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42925 - protein, 117 aa, Artificial Sequence
  Description of Artificial Sequence: Synthetic polypeptide
  VH of XENP27855
QIQLVQSGSELKKPGASVKVSCKASGYTFTHYGMNWVRQAPGQGLEWMGWINTHSGEPTYADGFTGRFVFSLDTSQSTAYLQISSLKAEDTAVYFCARDYYGSSPYWGQGTLVTVSS

SEQ ID NO: 42926 - protein, 5 aa, Artificial Sequence
  Description of Artificial Sequence: Synthetic peptide
  XENP27855 vhCDR1
HYGMN

SEQ ID NO: 42927 - protein, 17 aa, Artificial Sequence
  Description of Artificial Sequence: Synthetic peptide
  XENP27855 vhCDR2
WINTHSGEPTYADGFTG

SEQ ID NO: 42928 - protein, 8 aa, Artificial Sequence
  Description of Artificial Sequence: Synthetic peptide
  XENP27855 vhCDR3
DYYGSSPY

SEQ ID NO: 42929 - protein, 219 aa, Artificial Sequence; identical to SEQ ID NO: 33008
  Description of Artificial Sequence: Synthetic polypeptide
  XENP27855 1C11_H3.325_L3_IgG1_PVA_/S267K Light Chain

SEQ ID NO: 42930 - protein, 112 aa, Artificial Sequence; identical to SEQ ID NO: 33009
  Description of Artificial Sequence: Synthetic polypeptide
  VL of XENP27855

SEQ ID NO: 42931 - protein, 16 aa, Artificial Sequence
  Description of Artificial Sequence: Synthetic peptide
  XENP27855 vlCDR1
KSSQSIVHSNGNTYLE

SEQ ID NO: 42932 - protein, 7 aa, Artificial Sequence
  Description of Artificial Sequence: Synthetic peptide
  XENP27855 vlCDR2
KVSNRFS

SEQ ID NO: 42933 - protein, 9 aa, Artificial Sequence
  Description of Artificial Sequence: Synthetic peptide
  XENP27855 vlCDR3
FQGSHVPNT

SEQ ID NO: 42934 - protein, 446 aa, Artificial Sequence
  Description of Artificial Sequence: Synthetic polypeptide
  XENP27856 1C11_H3.326_L3_IgG1_PVA_/S267K Heavy Chain
QIQLVQSGSELKKPGASVKVSCKASGYTFTHYGMNWVRQAPGQGLEWMGWINTHSGEPTYADGFTGRFVFSLDTSQSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42935 - protein, 117 aa, Artificial Sequence
  Description of Artificial Sequence: Synthetic polypeptide
  VH of XENP27856
QIQLVQSGSELKKPGASVKVSCKASGYTFTHYGMNWVRQAPGQGLEWMGWINTHSGEPTYADGFTGRFVFSLDTSQSTAYLQISSLKAEDTAVYFCARDYFGSSPYWGQGTLVTVSS

SEQ ID NO: 42936 - protein, 5 aa, Artificial Sequence
  Description of Artificial Sequence: Synthetic peptide
  XENP27856 vhCDR1
HYGMN

SEQ ID NO: 42937 - protein, 17 aa, Artificial Sequence
  Description of Artificial Sequence: Synthetic peptide
  XENP27856 vhCDR2
WINTHSGEPTYADGFTG

SEQ ID NO: 42938 - protein, 8 aa, Artificial Sequence
  Description of Artificial Sequence: Synthetic peptide
  XENP27856 vhCDR3
DYFGSSPY

SEQ ID NO: 42939 - protein, 219 aa, Artificial Sequence; identical to SEQ ID NO: 33008
  Description of Artificial Sequence: Synthetic polypeptide
  XENP27856 1C11_H3.326_L3_IgG1_PVA_/S267K Light Chain

SEQ ID NO: 42940 - protein, 112 aa, Artificial Sequence; identical to SEQ ID NO: 33009
  Description of Artificial Sequence: Synthetic polypeptide
  VL of XENP27856

SEQ ID NO: 42941 - protein, 16 aa, Artificial Sequence
  Description of Artificial Sequence: Synthetic peptide
  XENP27856 vlCDR1
KSSQSIVHSNGNTYLE

SEQ ID NO: 42942 - protein, 7 aa, Artificial Sequence
  Description of Artificial Sequence: Synthetic peptide
  XENP27856 vlCDR2
KVSNRFS

SEQ ID NO: 42943 - protein, 9 aa, Artificial Sequence
  Description of Artificial Sequence: Synthetic peptide
  XENP27856 vlCDR3
FQGSHVPNT

SEQ ID NO: 42944 - protein, 446 aa, Artificial Sequence; identical to SEQ ID NO: 42864
  Description of Artificial Sequence: Synthetic polypeptide
  XENP27857 1C11_H3.319_L3.152_IgG1_PVA_/S267K Heavy Chain

SEQ ID NO: 42945 - protein, 117 aa, Artificial Sequence; identical to SEQ ID NO: 42865
  Description of Artificial Sequence: Synthetic polypeptide
  VH of XENP27857

SEQ ID NO: 42946 - protein, 5 aa, Artificial Sequence
  Description of Artificial Sequence: Synthetic peptide
  XENP27857 vhCDR1
HYGMN

SEQ ID NO: 42947 - protein, 17 aa, Artificial Sequence
  Description of Artificial Sequence: Synthetic peptide
  XENP27857 vhCDR2
WINTYTGEPTYADGFTG

SEQ ID NO: 42948 - protein, 8 aa, Artificial Sequence
  Description of Artificial Sequence: Synthetic peptide
  XENP27857 vhCDR3
DYFGSSPY

SEQ ID NO: 42949 - protein, 219 aa, Artificial Sequence; identical to SEQ ID NO: 41984
  Description of Artificial Sequence: Synthetic polypeptide
  XENP27857 1C11_H3.319_L3.152_IgG1_PVA_/S267K Light Chain

SEQ ID NO: 42950 - protein, 112 aa, Artificial Sequence; identical to SEQ ID NO: 41985
  Description of Artificial Sequence: Synthetic polypeptide
  VL of XENP27857

SEQ ID NO: 42951 - protein, 16 aa, Artificial Sequence
  Description of Artificial Sequence: Synthetic peptide
  XENP27857 vlCDR1
KSSQSIVFSNGNTYLE

SEQ ID NO: 42952 - protein, 7 aa, Artificial Sequence
  Description of Artificial Sequence: Synthetic peptide
  XENP27857 vlCDR2
KVSNRFS

SEQ ID NO: 42953 - protein, 9 aa, Artificial Sequence
  Description of Artificial Sequence: Synthetic peptide
  XENP27857 vlCDR3
FQGSHVPNT

SEQ ID NO: 42954 - protein, 446 aa, Artificial Sequence; identical to SEQ ID NO: 42874
  Description of Artificial Sequence: Synthetic polypeptide
  XENP27858 1C11_H3.320_L3.152_IgG1_PVA_/S267K Heavy Chain

SEQ ID NO: 42955 - protein, 117 aa, Artificial Sequence; identical to SEQ ID NO: 42875
  Description of Artificial Sequence: Synthetic polypeptide
  VH of XENP27858

SEQ ID NO: 42956 - protein, 5 aa, Artificial Sequence
  Description of Artificial Sequence: Synthetic peptide
  XENP27858 vhCDR1
HYGMN

SEQ ID NO: 42957 - protein, 17 aa, Artificial Sequence
  Description of Artificial Sequence: Synthetic peptide
  XENP27858 vhCDR2
WINTHTGEPTYADGFTG

SEQ ID NO: 42958 - protein, 8 aa, Artificial Sequence
  Description of Artificial Sequence: Synthetic peptide
  XENP27858 vhCDR3
DYFGSSPY

SEQ ID NO: 42959 - protein, 219 aa, Artificial Sequence; identical to SEQ ID NO: 41984
  Description of Artificial Sequence: Synthetic polypeptide
  XENP27858 1C11_H3.320_L3.152_IgG1_PVA_/S267K Light Chain

SEQ ID NO: 42960 - protein, 112 aa, Artificial Sequence; identical to SEQ ID NO: 41985
  Description of Artificial Sequence: Synthetic polypeptide
  VL of XENP27858

SEQ ID NO: 42961 - protein, 16 aa, Artificial Sequence
  Description of Artificial Sequence: Synthetic peptide
  XENP27858 vlCDR1
KSSQSIVFSNGNTYLE

SEQ ID NO: 42962 - protein, 7 aa, Artificial Sequence
  Description of Artificial Sequence: Synthetic peptide
  XENP27858 vlCDR2
KVSNRFS

SEQ ID NO: 42963 - protein, 9 aa, Artificial Sequence
  Description of Artificial Sequence: Synthetic peptide
  XENP27858 vlCDR3
FQGSHVPNT

SEQ ID NO: 42964 - protein, 446 aa, Artificial Sequence; identical to SEQ ID NO: 42884
  Description of Artificial Sequence: Synthetic polypeptide
  XENP27859 1C11_H3.321_L3.152_IgG1_PVA_/S267K Heavy Chain

SEQ ID NO: 42965 - protein, 117 aa, Artificial Sequence; identical to SEQ ID NO: 42885
  Description of Artificial Sequence: Synthetic polypeptide
  VH of XENP27859

SEQ ID NO: 42966 - protein, 5 aa, Artificial Sequence
  Description of Artificial Sequence: Synthetic peptide
  XENP27859 vhCDR1
HYGMN

SEQ ID NO: 42967 - protein, 17 aa, Artificial Sequence
  Description of Artificial Sequence: Synthetic peptide
  XENP27859 vhCDR2
WINTYSGEPTYADGFTG

SEQ ID NO: 42968 - protein, 8 aa, Artificial Sequence
  Description of Artificial Sequence: Synthetic peptide
  XENP27859 vhCDR3
DYFGSSPY

SEQ ID NO: 42969 - protein, 219 aa, Artificial Sequence; identical to SEQ ID NO: 41984
  Description of Artificial Sequence: Synthetic polypeptide
  XENP27859 1C11_H3.321_L3.152_IgG1_PVA_/S267K Light Chain

SEQ ID NO: 42970 - protein, 112 aa, Artificial Sequence; identical to SEQ ID NO: 41985
  Description of Artificial Sequence: Synthetic polypeptide
  VL of XENP27859

SEQ ID NO: 42971 - protein, 16 aa, Artificial Sequence
  Description of Artificial Sequence: Synthetic peptide
  XENP27859 vlCDR1
KSSQSIVFSNGNTYLE

SEQ ID NO: 42972 - protein, 7 aa, Artificial Sequence
  Description of Artificial Sequence: Synthetic peptide
  XENP27859 vlCDR2
KVSNRFS

SEQ ID NO: 42973 - protein, 9 aa, Artificial Sequence
  Description of Artificial Sequence: Synthetic peptide
  XENP27859 vlCDR3
FQGSHVPNT

SEQ ID NO: 42974 - protein, 446 aa, Artificial Sequence; identical to SEQ ID NO: 42894
  Description of Artificial Sequence: Synthetic polypeptide
  XENP27860 1C11_H3.322_L3.152_IgG1_PVA_/S267K Heavy Chain

SEQ ID NO: 42975 - protein, 117 aa, Artificial Sequence; identical to SEQ ID NO: 42895
  Description of Artificial Sequence: Synthetic polypeptide
  VH of XENP27860

SEQ ID NO: 42976 - protein, 5 aa, Artificial Sequence
  Description of Artificial Sequence: Synthetic peptide
  XENP27860 vhCDR1
HYGMN

SEQ ID NO: 42977 - protein, 17 aa, Artificial Sequence
  Description of Artificial Sequence: Synthetic peptide
  XENP27860 vhCDR2
WINTYTSEPTYADGFTG

SEQ ID NO: 42978 - protein, 8 aa, Artificial Sequence
  Description of Artificial Sequence: Synthetic peptide
  XENP27860 vhCDR3
DYFGSSPY

SEQ ID NO: 42979 - protein, 219 aa, Artificial Sequence; identical to SEQ ID NO: 41984
  Description of Artificial Sequence: Synthetic polypeptide
  XENP27860 1C11_H3.322_L3.152_IgG1_PVA_/S267K Light Chain

SEQ ID NO: 42980 - protein, 112 aa, Artificial Sequence; identical to SEQ ID NO: 41985
  Description of Artificial Sequence: Synthetic polypeptide
  VL of XENP27860

SEQ ID NO: 42981 - protein, 16 aa, Artificial Sequence
  Description of Artificial Sequence: Synthetic peptide
  XENP27860 vlCDR1
KSSQSIVFSNGNTYLE

SEQ ID NO: 42982 - protein, 7 aa, Artificial Sequence
  Description of Artificial Sequence: Synthetic peptide
  XENP27860 vlCDR2
KVSNRFS

SEQ ID NO: 42983 - protein, 9 aa, Artificial Sequence
  Description of Artificial Sequence: Synthetic peptide
  XENP27860 vlCDR3
FQGSHVPNT

SEQ ID NO: 42984 - protein, 446 aa, Artificial Sequence; identical to SEQ ID NO: 42904
  Description of Artificial Sequence: Synthetic polypeptide
  XENP27861 1C11_H3.323_L3.152_IgG1_PVA_/S267K Heavy Chain

SEQ ID NO: 42985 - protein, 117 aa, Artificial Sequence; identical to SEQ ID NO: 42905
  Description of Artificial Sequence: Synthetic polypeptide
  VH of XENP27861

SEQ ID NO: 42986 - protein, 5 aa, Artificial Sequence
  Description of Artificial Sequence: Synthetic peptide
  XENP27861 vhCDR1
HYGMN

SEQ ID NO: 42987 - protein, 17 aa, Artificial Sequence
  Description of Artificial Sequence: Synthetic peptide
  XENP27861 vhCDR2
WINTHSGEPTYADGFTG

SEQ ID NO: 42988 - protein, 8 aa, Artificial Sequence
  Description of Artificial Sequence: Synthetic peptide
  XENP27861 vhCDR3
DYYGSSPY

SEQ ID NO: 42989 - protein, 219 aa, Artificial Sequence; identical to SEQ ID NO: 41984
  Description of Artificial Sequence: Synthetic polypeptide
  XENP27861 1C11_H3.323_L3.152_IgG1_PVA_/S267K Light Chain

SEQ ID NO: 42990 - protein, 112 aa, Artificial Sequence; identical to SEQ ID NO: 41985
  Description of Artificial Sequence: Synthetic polypeptide
  VL of XENP27861

SEQ ID NO: 42991 - protein, 16 aa, Artificial Sequence
  Description of Artificial Sequence: Synthetic peptide
  XENP27861 vlCDR1
KSSQSIVFSNGNTYLE

SEQ ID NO: 42992 - protein, 7 aa, Artificial Sequence
  Description of Artificial Sequence: Synthetic peptide
  XENP27861 vlCDR2
KVSNRFS

SEQ ID NO: 42993 - protein, 9 aa, Artificial Sequence
  Description of Artificial Sequence: Synthetic peptide
  XENP27861 vlCDR3
FQGSHVPNT

SEQ ID NO: 42994 - protein, 446 aa, Artificial Sequence; identical to SEQ ID NO: 42914
  Description of Artificial Sequence: Synthetic polypeptide
  XENP27862 1C11_H3.324_L3.152_IgG1_PVA_/S267K Heavy Chain

SEQ ID NO: 42995 - protein, 117 aa, Artificial Sequence; identical to SEQ ID NO: 42915
  Description of Artificial Sequence: Synthetic polypeptide
  VH of XENP27862

SEQ ID NO: 42996 - protein, 5 aa, Artificial Sequence
  Description of Artificial Sequence: Synthetic peptide
  XENP27862 vhCDR1
HYGMN

SEQ ID NO: 42997 - protein, 17 aa, Artificial Sequence
  Description of Artificial Sequence: Synthetic peptide
  XENP27862 vhCDR2
WINTHSGEPTYADGFTG

SEQ ID NO: 42998 - protein, 8 aa, Artificial Sequence
  Description of Artificial Sequence: Synthetic peptide
  XENP27862 vhCDR3
DYFGSSPY

SEQ ID NO: 42999 - protein, 219 aa, Artificial Sequence; identical to SEQ ID NO: 41984
  Description of Artificial Sequence: Synthetic polypeptide
  XENP27862 1C11_H3.324_L3.152_IgG1_PVA_/S267K Light Chain

SEQ ID NO: 43000 - protein, 112 aa, Artificial Sequence; identical to SEQ ID NO: 41985
  Description of Artificial Sequence: Synthetic polypeptide
  VL of XENP27862

SEQ ID NO: 43001 - protein, 16 aa, Artificial Sequence
  Description of Artificial Sequence: Synthetic peptide
  XENP27862 vlCDR1
KSSQSIVFSNGNTYLE

SEQ ID NO: 43002 - protein, 7 aa, Artificial Sequence
  Description of Artificial Sequence: Synthetic peptide
  XENP27862 vlCDR2
KVSNRFS

SEQ ID NO: 43003 - protein, 9 aa, Artificial Sequence
  Description of Artificial Sequence: Synthetic peptide
  XENP27862 vlCDR3
FQGSHVPNT

SEQ ID NO: 43004 - protein, 446 aa, Artificial Sequence; identical to SEQ ID NO: 42924
  Description of Artificial Sequence: Synthetic polypeptide
  XENP27863 1C11_H3.325_L3.152_IgG1_PVA_/S267K Heavy Chain

SEQ ID NO: 43005 - protein, 117 aa, Artificial Sequence; identical to SEQ ID NO: 42925
  Description of Artificial Sequence: Synthetic polypeptide
  VH of XENP27863

SEQ ID NO: 43006 - protein, 5 aa, Artificial Sequence
  Description of Artificial Sequence: Synthetic peptide
  XENP27863 vhCDR1
HYGMN

SEQ ID NO: 43007 - protein, 17 aa, Artificial Sequence
  Description of Artificial Sequence: Synthetic peptide
  XENP27863 vhCDR2
WINTHSGEPTYADGFTG

SEQ ID NO: 43008 - protein, 8 aa, Artificial Sequence
  Description of Artificial Sequence: Synthetic peptide
  XENP27863 vhCDR3
DYYGSSPY

SEQ ID NO: 43009 - protein, 219 aa, Artificial Sequence; identical to SEQ ID NO: 41984
  Description of Artificial Sequence: Synthetic polypeptide
  XENP27863 1C11_H3.325_L3.152_IgG1_PVA_/S267K Light Chain

SEQ ID NO: 43010 - protein, 112 aa, Artificial Sequence; identical to SEQ ID NO: 41985
  Description of Artificial Sequence: Synthetic polypeptide
  VL of XENP27863

SEQ ID NO: 43011 - protein, 16 aa, Artificial Sequence
  Description of Artificial Sequence: Synthetic peptide
  XENP27863 vlCDR1
KSSQSIVFSNGNTYLE

SEQ ID NO: 43012 - protein, 7 aa, Artificial Sequence
  Description of Artificial Sequence: Synthetic peptide
  XENP27863 vlCDR2
KVSNRFS

SEQ ID NO: 43013 - protein, 9 aa, Artificial Sequence
  Description of Artificial Sequence: Synthetic peptide
  XENP27863 vlCDR3
FQGSHVPNT

SEQ ID NO: 43014 - protein, 446 aa, Artificial Sequence; identical to SEQ ID NO: 42934
  Description of Artificial Sequence: Synthetic polypeptide
  XENP27864 1C11_H3.326_L3.152_IgG1_PVA_/S267K Heavy Chain

SEQ ID NO: 43015 - protein, 117 aa, Artificial Sequence; identical to SEQ ID NO: 42935
  Description of Artificial Sequence: Synthetic polypeptide
  VH of XENP27864

SEQ ID NO: 43016 - protein, 5 aa, Artificial Sequence
  Description of Artificial Sequence: Synthetic peptide
  XENP27864 vhCDR1
HYGMN

SEQ ID NO: 43017 - protein, 17 aa, Artificial Sequence
  Description of Artificial Sequence: Synthetic peptide
  XENP27864 vhCDR2
WINTHSGEPTYADGFTG

SEQ ID NO: 43018 - protein, 8 aa, Artificial Sequence
  Description of Artificial Sequence: Synthetic peptide
  XENP27864 vhCDR3
DYFGSSPY

SEQ ID NO: 43019 - protein, 219 aa, Artificial Sequence; identical to SEQ ID NO: 41984
  Description of Artificial Sequence: Synthetic polypeptide
  XENP27864 1C11_H3.326_L3.152_IgG1_PVA_/S267K Light Chain

SEQ ID NO: 43020 - protein, 112 aa, Artificial Sequence; identical to SEQ ID NO: 41985
  Description of Artificial Sequence: Synthetic polypeptide
  VL of XENP27864

SEQ ID NO: 43021 - protein, 16 aa, Artificial Sequence
  Description of Artificial Sequence: Synthetic peptide
  XENP27864 vlCDR1
KSSQSIVFSNGNTYLE

SEQ ID NO: 43022 - protein, 7 aa, Artificial Sequence
  Description of Artificial Sequence: Synthetic peptide
  XENP27864 vlCDR2
KVSNRFS

SEQ ID NO: 43023 - protein, 9 aa, Artificial Sequence
  Description of Artificial Sequence: Synthetic peptide
  XENP27864 vlCDR3
FQGSHVPNT

SEQ ID NO: 43024 - protein, 446 aa, Artificial Sequence; identical to SEQ ID NO: 42864
  Description of Artificial Sequence: Synthetic polypeptide
  XENP27865 1C11_H3.319_L3.220_IgG1_PVA_/S267K Heavy Chain

SEQ ID NO: 43025 - protein, 117 aa, Artificial Sequence; identical to SEQ ID NO: 42865
  Description of Artificial Sequence: Synthetic polypeptide
  VH of XENP27865

SEQ ID NO: 43026 - protein, 5 aa, Artificial Sequence
  Description of Artificial Sequence: Synthetic peptide
  XENP27865 vhCDR1
HYGMN

SEQ ID NO: 43027 - protein, 17 aa, Artificial Sequence
  Description of Artificial Sequence: Synthetic peptide
  XENP27865 vhCDR2
WINTYTGEPTYADGFTG

SEQ ID NO: 43028 - protein, 8 aa, Artificial Sequence
  Description of Artificial Sequence: Synthetic peptide
  XENP27865 vhCDR3
DYFGSSPY

SEQ ID NO: 43029 - protein, 219 aa, Artificial Sequence; identical to SEQ ID NO: 42759
  Description of Artificial Sequence: Synthetic polypeptide
  XENP27865 1C11_H3.319_L3.220_IgG1_PVA_/S267K Light Chain

SEQ ID NO: 43030 - protein, 112 aa, Artificial Sequence; identical to SEQ ID NO: 42760
  Description of Artificial Sequence: Synthetic polypeptide
  VL of XENP27865

SEQ ID NO: 43031 - protein, 16 aa, Artificial Sequence
  Description of Artificial Sequence: Synthetic peptide
  XENP27865 vlCDR1
KSSQSIVYSNGNNYLE

SEQ ID NO: 43032 - protein, 7 aa, Artificial Sequence
  Description of Artificial Sequence: Synthetic peptide
  XENP27865 vlCDR2
KVSNRFS

SEQ ID NO: 43033 - protein, 9 aa, Artificial Sequence
  Description of Artificial Sequence: Synthetic peptide
  XENP27865 vlCDR3
FQGSHVPNT

SEQ ID NO: 43034 - protein, 446 aa, Artificial Sequence; identical to SEQ ID NO: 42874
  Description of Artificial Sequence: Synthetic polypeptide
  XENP27866 1C11_H3.320_L3.220_IgG1_PVA_/S267K Heavy Chain

SEQ ID NO: 43035 - protein, 117 aa, Artificial Sequence; identical to SEQ ID NO: 42875
  Description of Artificial Sequence: Synthetic polypeptide
  VH of XENP27866

SEQ ID NO: 43036 - protein, 5 aa, Artificial Sequence
  Description of Artificial Sequence: Synthetic peptide
  XENP27866 vhCDR1
HYGMN

SEQ ID NO: 43037 - protein, 17 aa, Artificial Sequence
  Description of Artificial Sequence: Synthetic peptide
  XENP27866 vhCDR2
WINTHTGEPTYADGFTG

SEQ ID NO: 43038 - protein, 8 aa, Artificial Sequence
  Description of Artificial Sequence: Synthetic peptide
  XENP27866 vhCDR3
DYFGSSPY

SEQ ID NO: 43039 - protein, 219 aa, Artificial Sequence; identical to SEQ ID NO: 42759
  Description of Artificial Sequence: Synthetic polypeptide
  XENP27866 1C11_H3.320_L3.220_IgG1_PVA_/S267K Light Chain

SEQ ID NO: 43040 - protein, 112 aa, Artificial Sequence; identical to SEQ ID NO: 42760
  Description of Artificial Sequence: Synthetic polypeptide
  VL of XENP27866

SEQ ID NO: 43041 - protein, 16 aa, Artificial Sequence
  Description of Artificial Sequence: Synthetic peptide
  XENP27866 vlCDR1
KSSQSIVYSNGNNYLE

SEQ ID NO: 43042 - protein, 7 aa, Artificial Sequence
  Description of Artificial Sequence: Synthetic peptide
  XENP27866 vlCDR2
KVSNRFS

SEQ ID NO: 43043 - protein, 9 aa, Artificial Sequence
  Description of Artificial Sequence: Synthetic peptide
  XENP27866 vlCDR3
FQGSHVPNT

SEQ ID NO: 43044 - protein, 446 aa, Artificial Sequence; identical to SEQ ID NO: 42884
  Description of Artificial Sequence: Synthetic polypeptide
  XENP27867 1C11_H3.321_L3.220_IgG1_PVA_/S267K Heavy Chain

SEQ ID NO: 43045 - protein, 117 aa, Artificial Sequence; identical to SEQ ID NO: 42885
  Description of Artificial Sequence: Synthetic polypeptide
  VH of XENP27867

SEQ ID NO: 43046 - protein, 5 aa, Artificial Sequence
  Description of Artificial Sequence: Synthetic peptide
  XENP27867 vhCDR1
HYGMN

SEQ ID NO: 43047 - protein, 17 aa, Artificial Sequence
  Description of Artificial Sequence: Synthetic peptide
  XENP27867 vhCDR2
WINTYSGEPTYADGFTG

SEQ ID NO: 43048 - protein, 8 aa, Artificial Sequence
  Description of Artificial Sequence: Synthetic peptide
  XENP27867 vhCDR3
DYFGSSPY

SEQ ID NO: 43049 - protein, 219 aa, Artificial Sequence; identical to SEQ ID NO: 42759
  Description of Artificial Sequence: Synthetic polypeptide
  XENP27867 1C11_H3.321_L3.220_IgG1_PVA_/S267K Light Chain

SEQ ID NO: 43050 - protein, 112 aa, Artificial Sequence; identical to SEQ ID NO: 42760
  Description of Artificial Sequence: Synthetic polypeptide
  VL of XENP27867

SEQ ID NO: 43051 - protein, 16 aa, Artificial Sequence
  Description of Artificial Sequence: Synthetic peptide
  XENP27867 vlCDR1
KSSQSIVYSNGNNYLE

SEQ ID NO: 43052 - protein, 7 aa, Artificial Sequence
  Description of Artificial Sequence: Synthetic peptide
  XENP27867 vlCDR2
KVSNRFS

SEQ ID NO: 43053 - protein, 9 aa, Artificial Sequence
  Description of Artificial Sequence: Synthetic peptide
  XENP27867 vlCDR3
FQGSHVPNT

SEQ ID NO: 43054 - protein, 446 aa, Artificial Sequence; identical to SEQ ID NO: 42894
  Description of Artificial Sequence: Synthetic polypeptide
  XENP27868 1C11_H3.322_L3.220_IgG1_PVA_/S267K Heavy Chain

SEQ ID NO: 43055 - protein, 117 aa, Artificial Sequence; identical to SEQ ID NO: 42895
  Description of Artificial Sequence: Synthetic polypeptide
  VH of XENP27868

SEQ ID NO: 43056 - protein, 5 aa, Artificial Sequence
  Description of Artificial Sequence: Synthetic peptide
  XENP27868 vhCDR1
HYGMN

SEQ ID NO: 43057 - protein, 17 aa, Artificial Sequence
  Description of Artificial Sequence: Synthetic peptide
  XENP27868 vhCDR2
WINTYTSEPTYADGFTG

SEQ ID NO: 43058 - protein, 8 aa, Artificial Sequence
  Description of Artificial Sequence: Synthetic peptide
  XENP27868 vhCDR3
DYFGSSPY

SEQ ID NO: 43059 - protein, 219 aa, Artificial Sequence; identical to SEQ ID NO: 42759
  Description of Artificial Sequence: Synthetic polypeptide
  XENP27868 1C11_H3.322_L3.220_IgG1_PVA_/S267K Light Chain

SEQ ID NO: 43060 - protein, 112 aa, Artificial Sequence; identical to SEQ ID NO: 42760
  Description of Artificial Sequence: Synthetic polypeptide
  VL of XENP27868

SEQ ID NO: 43061 - protein, 16 aa, Artificial Sequence
  Description of Artificial Sequence: Synthetic peptide
  XENP27868 vlCDR1
KSSQSIVYSNGNNYLE

SEQ ID NO: 43062 - protein, 7 aa, Artificial Sequence
  Description of Artificial Sequence: Synthetic peptide
  XENP27868 vlCDR2
KVSNRFS

SEQ ID NO: 43063 - protein, 9 aa, Artificial Sequence
  Description of Artificial Sequence: Synthetic peptide
  XENP27868 vlCDR3
FQGSHVPNT

SEQ ID NO: 43064 - protein, 446 aa, Artificial Sequence; identical to SEQ ID NO: 42904
  Description of Artificial Sequence: Synthetic polypeptide
  XENP27869 1C11_H3.323_L3.220_IgG1_PVA_/S267K Heavy Chain

SEQ ID NO: 43065 - protein, 117 aa, Artificial Sequence; identical to SEQ ID NO: 42905
  Description of Artificial Sequence: Synthetic polypeptide
  VH of XENP27869

SEQ ID NO: 43066 - protein, 5 aa, Artificial Sequence
  Description of Artificial Sequence: Synthetic peptide
  XENP27869 vhCDR1
HYGMN

SEQ ID NO: 43067 - protein, 17 aa, Artificial Sequence
  Description of Artificial Sequence: Synthetic peptide
  XENP27869 vhCDR2
WINTHSGEPTYADGFTG

SEQ ID NO: 43068 - protein, 8 aa, Artificial Sequence
  Description of Artificial Sequence: Synthetic peptide
  XENP27869 vhCDR3
DYYGSSPY

SEQ ID NO: 43069 - protein, 219 aa, Artificial Sequence; identical to SEQ ID NO: 42759
  Description of Artificial Sequence: Synthetic polypeptide
  XENP27869 1C11_H3.323_L3.220_IgG1_PVA_/S267K Light Chain

SEQ ID NO: 43070 - protein, 112 aa, Artificial Sequence; identical to SEQ ID NO: 42760
  Description of Artificial Sequence: Synthetic polypeptide
  VL of XENP27869

SEQ ID NO: 43071 - protein, 16 aa, Artificial Sequence
  Description of Artificial Sequence: Synthetic peptide
  XENP27869 vlCDR1
KSSQSIVYSNGNNYLE

SEQ ID NO: 43072 - protein, 7 aa, Artificial Sequence
  Description of Artificial Sequence: Synthetic peptide
  XENP27869 vlCDR2
KVSNRFS

SEQ ID NO: 43073 - protein, 9 aa, Artificial Sequence
  Description of Artificial Sequence: Synthetic peptide
  XENP27869 vlCDR3
FQGSHVPNT

SEQ ID NO: 43074 - protein, 446 aa, Artificial Sequence; identical to SEQ ID NO: 42914
  Description of Artificial Sequence: Synthetic polypeptide
  XENP27870 1C11_H3.324_L3.220_IgG1_PVA_/S267K Heavy Chain

SEQ ID NO: 43075 - protein, 117 aa, Artificial Sequence; identical to SEQ ID NO: 42915
  Description of Artificial Sequence: Synthetic polypeptide
  VH of XENP27870

SEQ ID NO: 43076 - protein, 5 aa, Artificial Sequence
  Description of Artificial Sequence: Synthetic peptide
  XENP27870 vhCDR1
HYGMN

SEQ ID NO: 43077 - protein, 17 aa, Artificial Sequence
  Description of Artificial Sequence: Synthetic peptide
  XENP27870 vhCDR2
WINTHSGEPTYADGFTG

SEQ ID NO: 43078 - protein, 8 aa, Artificial Sequence
  Description of Artificial Sequence: Synthetic peptide
  XENP27870 vhCDR3
DYFGSSPY

SEQ ID NO: 43079 - protein, 219 aa, Artificial Sequence; identical to SEQ ID NO: 42759
  Description of Artificial Sequence: Synthetic polypeptide
  XENP27870 1C11_H3.324_L3.220_IgG1_PVA_/S267K Light Chain

SEQ ID NO: 43080 - protein, 112 aa, Artificial Sequence; identical to SEQ ID NO: 42760
  Description of Artificial Sequence: Synthetic polypeptide
  VL of XENP27870

SEQ ID NO: 43081 - protein, 16 aa, Artificial Sequence
  Description of Artificial Sequence: Synthetic peptide
  XENP27870 vlCDR1
KSSQSIVYSNGNNYLE

SEQ ID NO: 43082 - protein, 7 aa, Artificial Sequence
  Description of Artificial Sequence: Synthetic peptide
  XENP27870 vlCDR2
KVSNRFS

SEQ ID NO: 43083 - protein, 9 aa, Artificial Sequence
  Description of Artificial Sequence: Synthetic peptide
  XENP27870 vlCDR3
FQGSHVPNT

SEQ ID NO: 43084 - protein, 446 aa, Artificial Sequence; identical to SEQ ID NO: 42924
  Description of Artificial Sequence: Synthetic polypeptide
  XENP27871 1C11_H3.325_L3.220_IgG1_PVA_/S267K Heavy Chain

SEQ ID NO: 43085 - protein, 117 aa, Artificial Sequence; identical to SEQ ID NO: 42925
  Description of Artificial Sequence: Synthetic polypeptide
  VH of XENP27871

SEQ ID NO: 43086 - protein, 5 aa, Artificial Sequence
  Description of Artificial Sequence: Synthetic peptide
  XENP27871 vhCDR1
HYGMN

SEQ ID NO: 43087 - protein, 17 aa, Artificial Sequence
  Description of Artificial Sequence: Synthetic peptide
  XENP27871 vhCDR2
WINTHSGEPTYADGFTG

SEQ ID NO: 43088 - protein, 8 aa, Artificial Sequence
  Description of Artificial Sequence: Synthetic peptide
  XENP27871 vhCDR3
DYYGSSPY

SEQ ID NO: 43089 - protein, 219 aa, Artificial Sequence; identical to SEQ ID NO: 42759
  Description of Artificial Sequence: Synthetic polypeptide
  XENP27871 1C11_H3.325_L3.220_IgG1_PVA_/S267K Light Chain

SEQ ID NO: 43090 - protein, 112 aa, Artificial Sequence; identical to SEQ ID NO: 42760
  Description of Artificial Sequence: Synthetic polypeptide
  VL of XENP27871

SEQ ID NO: 43091 - protein, 16 aa, Artificial Sequence
  Description of Artificial Sequence: Synthetic peptide
  XENP27871 vlCDR1
KSSQSIVYSNGNNYLE

SEQ ID NO: 43092 - protein, 7 aa, Artificial Sequence
  Description of Artificial Sequence: Synthetic peptide
  XENP27871 vlCDR2
KVSNRFS

SEQ ID NO: 43093 - protein, 9 aa, Artificial Sequence
  Description of Artificial Sequence: Synthetic peptide
  XENP27871 vlCDR3
FQGSHVPNT

SEQ ID NO: 43094 - protein, 446 aa, Artificial Sequence; identical to SEQ ID NO: 42934
  Description of Artificial Sequence: Synthetic polypeptide
  XENP27872 1C11_H3.326_L3.220_IgG1_PVA_/S267K Heavy Chain

SEQ ID NO: 43095 - protein, 117 aa, Artificial Sequence; identical to SEQ ID NO: 42935
  Description of Artificial Sequence: Synthetic polypeptide
  VH of XENP27872

SEQ ID NO: 43096 - protein, 5 aa, Artificial Sequence
  Description of Artificial Sequence: Synthetic peptide
  XENP27872 vhCDR1
HYGMN

SEQ ID NO: 43097 - protein, 17 aa, Artificial Sequence
  Description of Artificial Sequence: Synthetic peptide
  XENP27872 vhCDR2
WINTHSGEPTYADGFTG

SEQ ID NO: 43098 - protein, 8 aa, Artificial Sequence
  Description of Artificial Sequence: Synthetic peptide
  XENP27872 vhCDR3
DYFGSSPY

SEQ ID NO: 43099 - protein, 219 aa, Artificial Sequence; identical to SEQ ID NO: 42759
  Description of Artificial Sequence: Synthetic polypeptide
  XENP27872 1C11_H3.326_L3.220_IgG1_PVA_/S267K Light Chain

SEQ ID NO: 43100 - protein, 112 aa, Artificial Sequence; identical to SEQ ID NO: 42760
  Description of Artificial Sequence: Synthetic polypeptide
  VL of XENP27872

SEQ ID NO: 43101 - protein, 16 aa, Artificial Sequence
  Description of Artificial Sequence: Synthetic peptide
  XENP27872 vlCDR1
KSSQSIVYSNGNNYLE

SEQ ID NO: 43102 - protein, 7 aa, Artificial Sequence
  Description of Artificial Sequence: Synthetic peptide
  XENP27872 vlCDR2
KVSNRFS

SEQ ID NO: 43103 - protein, 9 aa, Artificial Sequence
  Description of Artificial Sequence: Synthetic peptide
  XENP27872 vlCDR3
FQGSHVPNT

SEQ ID NO: 43104 - protein, 446 aa, Artificial Sequence; identical to SEQ ID NO: 41934
  Description of Artificial Sequence: Synthetic polypeptide
  XENP27959 1C11_H3.303_L3.219_IgG1_PVA_/S267K Heavy Chain

SEQ ID NO: 43105 - protein, 117 aa, Artificial Sequence; identical to SEQ ID NO: 41935
  Description of Artificial Sequence: Synthetic polypeptide
  VH of XENP27959

SEQ ID NO: 43106 - protein, 5 aa, Artificial Sequence
  Description of Artificial Sequence: Synthetic peptide
  XENP27959 vhCDR1
HYGMN

SEQ ID NO: 43107 - protein, 17 aa, Artificial Sequence
  Description of Artificial Sequence: Synthetic peptide
  XENP27959 vhCDR2
WINTYTGEPTYADGFTG

SEQ ID NO: 43108 - protein, 8 aa, Artificial Sequence
  Description of Artificial Sequence: Synthetic peptide
  XENP27959 vhCDR3
DYFGSSPY

SEQ ID NO: 43109 - protein, 219 aa, Artificial Sequence; identical to SEQ ID NO: 42749
  Description of Artificial Sequence: Synthetic polypeptide
  XENP27959 1C11_H3.303_L3.219_IgG1_PVA_/S267K Light Chain

SEQ ID NO: 43110 - protein, 112 aa, Artificial Sequence; identical to SEQ ID NO: 42750
  Description of Artificial Sequence: Synthetic polypeptide
  VL of XENP27959

SEQ ID NO: 43111 - protein, 16 aa, Artificial Sequence
  Description of Artificial Sequence: Synthetic peptide
  XENP27959 vlCDR1
KSSQSIVFSNGNNYLE

SEQ ID NO: 43112 - protein, 7 aa, Artificial Sequence
  Description of Artificial Sequence: Synthetic peptide
  XENP27959 vlCDR2
KVSNRFS

SEQ ID NO: 43113 - protein, 9 aa, Artificial Sequence
  Description of Artificial Sequence: Synthetic peptide
  XENP27959 vlCDR3
FQGSHVPNT

SEQ ID NO: 43114 - protein, 446 aa, Artificial Sequence; identical to SEQ ID NO: 41934
  Description of Artificial Sequence: Synthetic polypeptide
  XENP27960 1C11_H3.303_L3.220_IgG1_PVA_/S267K Heavy Chain

SEQ ID NO: 43115 - protein, 117 aa, Artificial Sequence; identical to SEQ ID NO: 41935
  Description of Artificial Sequence: Synthetic polypeptide
  VH of XENP27960

SEQ ID NO: 43116 - protein, 5 aa, Artificial Sequence
  Description of Artificial Sequence: Synthetic peptide
  XENP27960 vhCDR1
HYGMN

SEQ ID NO: 43117 - protein, 17 aa, Artificial Sequence
  Description of Artificial Sequence: Synthetic peptide
  XENP27960 vhCDR2
WINTYTGEPTYADGFTG

SEQ ID NO: 43118 - protein, 8 aa, Artificial Sequence
  Description of Artificial Sequence: Synthetic peptide
  XENP27960 vhCDR3
DYFGSSPY

SEQ ID NO: 43119 - protein, 219 aa, Artificial Sequence; identical to SEQ ID NO: 42759
  Description of Artificial Sequence: Synthetic polypeptide
  XENP27960 1C11_H3.303_L3.220_IgG1_PVA_/S267K Light Chain

SEQ ID NO: 43120 - protein, 112 aa, Artificial Sequence; identical to SEQ ID NO: 42760
  Description of Artificial Sequence: Synthetic polypeptide
  VL of XENP27960

SEQ ID NO: 43121 - protein, 16 aa, Artificial Sequence
  Description of Artificial Sequence: Synthetic peptide
  XENP27960 vlCDR1
KSSQSIVYSNGNNYLE

SEQ ID NO: 43122 - protein, 7 aa, Artificial Sequence
  Description of Artificial Sequence: Synthetic peptide
  XENP27960 vlCDR2
KVSNRFS

SEQ ID NO: 43123 - protein, 9 aa, Artificial Sequence
  Description of Artificial Sequence: Synthetic peptide
  XENP27960 vlCDR3
FQGSHVPNT

SEQ ID NO: 43124 - protein, 446 aa, Artificial Sequence; identical to SEQ ID NO: 42874
  Description of Artificial Sequence: Synthetic polypeptide
  XENP27961 1C11_H3.320_L3.219_IgG1_PVA_/S267K Heavy Chain

SEQ ID NO: 43125 - protein, 117 aa, Artificial Sequence; identical to SEQ ID NO: 42875
  Description of Artificial Sequence: Synthetic polypeptide
  VH of XENP27961

SEQ ID NO: 43126 - protein, 5 aa, Artificial Sequence
  Description of Artificial Sequence: Synthetic peptide
  XENP27961 vhCDR1
HYGMN

SEQ ID NO: 43127 - protein, 17 aa, Artificial Sequence
  Description of Artificial Sequence: Synthetic peptide
  XENP27961 vhCDR2
WINTHTGEPTYADGFTG

SEQ ID NO: 43128 - protein, 8 aa, Artificial Sequence
  Description of Artificial Sequence: Synthetic peptide
  XENP27961 vhCDR3
DYFGSSPY

SEQ ID NO: 43129 - protein, 219 aa, Artificial Sequence; identical to SEQ ID NO: 42749
  Description of Artificial Sequence: Synthetic polypeptide
  XENP27961 1C11_H3.320_L3.219_IgG1_PVA_/S267K Light Chain

SEQ ID NO: 43130 - protein, 112 aa, Artificial Sequence; identical to SEQ ID NO: 42750
  Description of Artificial Sequence: Synthetic polypeptide
  VL of XENP27961

SEQ ID NO: 43131 - protein, 16 aa, Artificial Sequence
  Description of Artificial Sequence: Synthetic peptide
  XENP27961 vlCDR1
KSSQSIVFSNGNNYLE

SEQ ID NO: 43132 - protein, 7 aa, Artificial Sequence
  Description of Artificial Sequence: Synthetic peptide
  XENP27961 vlCDR2
KVSNRFS

SEQ ID NO: 43133 - protein, 9 aa, Artificial Sequence
  Description of Artificial Sequence: Synthetic peptide
  XENP27961 vlCDR3
FQGSHVPNT

SEQ ID NO: 43134 - protein, 446 aa, Artificial Sequence; identical to SEQ ID NO: 42904
  Description of Artificial Sequence: Synthetic polypeptide
  XENP27962 1C11_H3.323_L3.219_IgG1_PVA_/S267K Heavy Chain

SEQ ID NO: 43135 - protein, 117 aa, Artificial Sequence; identical to SEQ ID NO: 42905
  Description of Artificial Sequence: Synthetic polypeptide
  VH of XENP27962

SEQ ID NO: 43136 - protein, 5 aa, Artificial Sequence
  Description of Artificial Sequence: Synthetic peptide
  XENP27962 vhCDR1
HYGMN

SEQ ID NO: 43137 - protein, 17 aa, Artificial Sequence
  Description of Artificial Sequence: Synthetic peptide
  XENP27962 vhCDR2
WINTHSGEPTYADGFTG

SEQ ID NO: 43138 - protein, 8 aa, Artificial Sequence
  Description of Artificial Sequence: Synthetic peptide
  XENP27962 vhCDR3
DYYGSSPY

SEQ ID NO: 43139 - protein, 219 aa, Artificial Sequence; identical to SEQ ID NO: 42749
  Description of Artificial Sequence: Synthetic polypeptide
  XENP27962 1C11_H3.323_L3.219_IgG1_PVA_/S267K Light Chain

SEQ ID NO: 43140 - protein, 112 aa, Artificial Sequence; identical to SEQ ID NO: 42750
  Description of Artificial Sequence: Synthetic polypeptide
  VL of XENP27962

SEQ ID NO: 43141 - protein, 16 aa, Artificial Sequence
  Description of Artificial Sequence: Synthetic peptide
  XENP27962 vlCDR1
KSSQSIVFSNGNNYLE

SEQ ID NO: 43142 - protein, 7 aa, Artificial Sequence
  Description of Artificial Sequence: Synthetic peptide
  XENP27962 vlCDR2
KVSNRFS

SEQ ID NO: 43143 - protein, 9 aa, Artificial Sequence
  Description of Artificial Sequence: Synthetic peptide
  XENP27962 vlCDR3
FQGSHVPNT

SEQ ID NO: 43144 - protein, 446 aa, Artificial Sequence; identical to SEQ ID NO: 42914
  Description of Artificial Sequence: Synthetic polypeptide
  XENP27963 1C11_H3.324_L3.219_IgG1_PVA_/S267K Heavy Chain

SEQ ID NO: 43145 - protein, 117 aa, Artificial Sequence; identical to SEQ ID NO: 42915
  Description of Artificial Sequence: Synthetic polypeptide
  VH of XENP27963

SEQ ID NO: 43146 - protein, 5 aa, Artificial Sequence
  Description of Artificial Sequence: Synthetic peptide
  XENP27963 vhCDR1
HYGMN

SEQ ID NO: 43147 - protein, 17 aa, Artificial Sequence
  Description of Artificial Sequence: Synthetic peptide
  XENP27963 vhCDR2
WINTHSGEPTYADGFTG

SEQ ID NO: 43148 - protein, 8 aa, Artificial Sequence
  Description of Artificial Sequence: Synthetic peptide
  XENP27963 vhCDR3
DYFGSSPY

SEQ ID NO: 43149 - protein, 219 aa, Artificial Sequence; identical to SEQ ID NO: 42749
  Description of Artificial Sequence: Synthetic polypeptide
  XENP27963 1C11_H3.324_L3.219_IgG1_PVA_/S267K Light Chain

SEQ ID NO: 43150 - protein, 112 aa, Artificial Sequence; identical to SEQ ID NO: 42750
  Description of Artificial Sequence: Synthetic polypeptide
  VL of XENP27963

SEQ ID NO: 43151 - protein, 16 aa, Artificial Sequence
  Description of Artificial Sequence: Synthetic peptide
  XENP27963 vlCDR1
KSSQSIVFSNGNNYLE

SEQ ID NO: 43152 - protein, 7 aa, Artificial Sequence
  Description of Artificial Sequence: Synthetic peptide
  XENP27963 vlCDR2
KVSNRFS

SEQ ID NO: 43153 - protein, 9 aa, Artificial Sequence
  Description of Artificial Sequence: Synthetic peptide
  XENP27963 vlCDR3
FQGSHVPNT

SEQ ID NO: 43154 - protein, 446 aa, Artificial Sequence
  Description of Artificial Sequence: Synthetic polypeptide
  XENP28024 1C11_H3.327_L3.220_IgG1_PVA_/S267K Heavy Chain
QIQLVQSGSELLKPGASVKVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43155 - protein, 117 aa, Artificial Sequence
  Description of Artificial Sequence: Synthetic polypeptide
  VH of XENP28024
QIQLVQSGSELLKPGASVKVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSS

SEQ ID NO: 43156 - protein, 5 aa, Artificial Sequence
  Description of Artificial Sequence: Synthetic peptide
  XENP28024 vhCDR1
HYGMN

SEQ ID NO: 43157 - protein, 17 aa, Artificial Sequence
  Description of Artificial Sequence: Synthetic peptide
  XENP28024 vhCDR2
WINTHTGEPTYADGFTG

SEQ ID NO: 43158 - protein, 8 aa, Artificial Sequence
  Description of Artificial Sequence: Synthetic peptide
  XENP28024 vhCDR3
DYFGSSPY

SEQ ID NO: 43159 - protein, 219 aa, Artificial Sequence; identical to SEQ ID NO: 42759
  Description of Artificial Sequence: Synthetic polypeptide
  XENP28024 1C11_H3.327_L3.220_IgG1_PVA_/S267K Light Chain

SEQ ID NO: 43160 - protein, 112 aa, Artificial Sequence; identical to SEQ ID NO: 42760
  Description of Artificial Sequence: Synthetic polypeptide
  VL of XENP28024

SEQ ID NO: 43161 - protein, 16 aa, Artificial Sequence
  Description of Artificial Sequence: Synthetic peptide
  XENP28024 vlCDR1
KSSQSIVYSNGNNYLE

SEQ ID NO: 43162 - protein, 7 aa, Artificial Sequence
  Description of Artificial Sequence: Synthetic peptide
  XENP28024 vlCDR2
KVSNRFS

SEQ ID NO: 43163 - protein, 9 aa, Artificial Sequence
  Description of Artificial Sequence: Synthetic peptide
  XENP28024 vlCDR3
FQGSHVPNT

SEQ ID NO: 43164 - protein, 446 aa, Artificial Sequence
  Description of Artificial Sequence: Synthetic polypeptide
  XENP28025 1C11_H3.328_L3.220_IgG1_PVA_/S267K Heavy Chain
QIQLVQSGSELKKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43165 - protein, 117 aa, Artificial Sequence
  Description of Artificial Sequence: Synthetic polypeptide
  VH of XENP28025
QIQLVQSGSELKKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSS

SEQ ID NO: 43166 - protein, 5 aa, Artificial Sequence
  Description of Artificial Sequence: Synthetic peptide
  XENP28025 vhCDR1
HYGMN

SEQ ID NO: 43167 - protein, 17 aa, Artificial Sequence
  Description of Artificial Sequence: Synthetic peptide
  XENP28025 vhCDR2
WINTHTGEPTYADGFTG

SEQ ID NO: 43168 - protein, 8 aa, Artificial Sequence
  Description of Artificial Sequence: Synthetic peptide
  XENP28025 vhCDR3
DYFGSSPY

SEQ ID NO: 43169 - protein, 219 aa, Artificial Sequence; identical to SEQ ID NO: 42759
  Description of Artificial Sequence: Synthetic polypeptide
  XENP28025 1C11_H3.328_L3.220_IgG1_PVA_/S267K Light Chain

SEQ ID NO: 43170 - protein, 112 aa, Artificial Sequence; identical to SEQ ID NO: 42760
  Description of Artificial Sequence: Synthetic polypeptide
  VL of XENP28025

SEQ ID NO: 43171 - protein, 16 aa, Artificial Sequence
  Description of Artificial Sequence: Synthetic peptide
  XENP28025 vlCDR1
KSSQSIVYSNGNNYLE

SEQ ID NO: 43172 - protein, 7 aa, Artificial Sequence
  Description of Artificial Sequence: Synthetic peptide
  XENP28025 vlCDR2
KVSNRFS

SEQ ID NO: 43173 - protein, 9 aa, Artificial Sequence
  Description of Artificial Sequence: Synthetic peptide
  XENP28025 vlCDR3
FQGSHVPNT

SEQ ID NO: 43174 - protein, 446 aa, Artificial Sequence
  Description of Artificial Sequence: Synthetic polypeptide
  XENP28026 1C11_H3.329_L3.220_IgG1_PVA_/S267K Heavy Chain
QIQLVQSGSELLKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43175 - protein, 117 aa, Artificial Sequence
  Description of Artificial Sequence: Synthetic polypeptide
  VH of XENP28026
QIQLVQSGSELLKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSS

SEQ ID NO: 43176 - protein, 5 aa, Artificial Sequence
  Description of Artificial Sequence: Synthetic peptide
  XENP28026 vhCDR1
HYGMN

SEQ ID NO: 43177 - protein, 17 aa, Artificial Sequence
  Description of Artificial Sequence: Synthetic peptide
  XENP28026 vhCDR2
WINTHTGEPTYADGFTG

SEQ ID NO: 43178 - protein, 8 aa, Artificial Sequence
  Description of Artificial Sequence: Synthetic peptide
  XENP28026 vhCDR3
DYFGSSPY

SEQ ID NO: 43179 - protein, 219 aa, Artificial Sequence; identical to SEQ ID NO: 42759
  Description of Artificial Sequence: Synthetic polypeptide
  XENP28026 1C11_H3.329_L3.220_IgG1_PVA_/S267K Light Chain

SEQ ID NO: 43180 - protein, 112 aa, Artificial Sequence; identical to SEQ ID NO: 42760
  Description of Artificial Sequence: Synthetic polypeptide
  VL of XENP28026

SEQ ID NO: 43181 - protein, 16 aa, Artificial Sequence
  Description of Artificial Sequence: Synthetic peptide
  XENP28026 vlCDR1
KSSQSIVYSNGNNYLE

SEQ ID NO: 43182 - protein, 7 aa, Artificial Sequence
  Description of Artificial Sequence: Synthetic peptide
  XENP28026 vlCDR2
KVSNRFS

SEQ ID NO: 43183 - protein, 9 aa, Artificial Sequence
  Description of Artificial Sequence: Synthetic peptide
  XENP28026 vlCDR3
FQGSHVPNT

SEQ ID NO: 43184 - protein, 446 aa, Artificial Sequence
  Description of Artificial Sequence: Synthetic polypeptide
  XENP28027 1C11_H3.330_L3.220_IgG1_PVA_/S267K Heavy Chain
QIQLVQSGSELLKPGASVKVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43185 - protein, 117 aa, Artificial Sequence
  Description of Artificial Sequence: Synthetic polypeptide
  VH of XENP28027
QIQLVQSGSELLKPGASVKVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSS

SEQ ID NO: 43186 - protein, 5 aa, Artificial Sequence
  Description of Artificial Sequence: Synthetic peptide
  XENP28027 vhCDR1
HYGMN

SEQ ID NO: 43187 - protein, 17 aa, Artificial Sequence
  Description of Artificial Sequence: Synthetic peptide
  XENP28027 vhCDR2
WINTHSGEPTYADGFTG

SEQ ID NO: 43188 - protein, 8 aa, Artificial Sequence
  Description of Artificial Sequence: Synthetic peptide
  XENP28027 vhCDR3
DYYGSSPY

SEQ ID NO: 43189 - protein, 219 aa, Artificial Sequence; identical to SEQ ID NO: 42759
  Description of Artificial Sequence: Synthetic polypeptide
  XENP28027 1C11_H3.330_L3.220_IgG1_PVA_/S267K Light Chain

SEQ ID NO: 43190 - protein, 112 aa, Artificial Sequence; identical to SEQ ID NO: 42760
  Description of Artificial Sequence: Synthetic polypeptide
  VL of XENP28027

SEQ ID NO: 43191 - protein, 16 aa, Artificial Sequence
  Description of Artificial Sequence: Synthetic peptide
  XENP28027 vlCDR1
KSSQSIVYSNGNNYLE

SEQ ID NO: 43192 - protein, 7 aa, Artificial Sequence
  Description of Artificial Sequence: Synthetic peptide
  XENP28027 vlCDR2
KVSNRFS

SEQ ID NO: 43193 - protein, 9 aa, Artificial Sequence
  Description of Artificial Sequence: Synthetic peptide
  XENP28027 vlCDR3
FQGSHVPNT

SEQ ID NO: 43194 - protein, 446 aa, Artificial Sequence
  Description of Artificial Sequence: Synthetic polypeptide
  XENP28028 1C11_H3.331_L3.220_IgG1_PVA_/S267K Heavy Chain
QIQLVQSGSELKKPGASVSVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43195 - protein, 117 aa, Artificial Sequence
  Description of Artificial Sequence: Synthetic polypeptide
  VH of XENP28028
QIQLVQSGSELKKPGASVSVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSS

SEQ ID NO: 43196 - protein, 5 aa, Artificial Sequence
  Description of Artificial Sequence: Synthetic peptide
  XENP28028 vhCDR1
HYGMN

SEQ ID NO: 43197 - protein, 17 aa, Artificial Sequence
  Description of Artificial Sequence: Synthetic peptide
  XENP28028 vhCDR2
WINTHSGEPTYADGFTG

SEQ ID NO: 43198 - protein, 8 aa, Artificial Sequence
  Description of Artificial Sequence: Synthetic peptide
  XENP28028 vhCDR3
DYYGSSPY

SEQ ID NO: 43199 - protein, 219 aa, Artificial Sequence; identical to SEQ ID NO: 42759
  Description of Artificial Sequence: Synthetic polypeptide
  XENP28028 1C11_H3.331_L3.220_IgG1_PVA_/S267K Light Chain

SEQ ID NO: 43200 - protein, 112 aa, Artificial Sequence; identical to SEQ ID NO: 42760
  Description of Artificial Sequence: Synthetic polypeptide
  VL of XENP28028

SEQ ID NO: 43201 - protein, 16 aa, Artificial Sequence
  Description of Artificial Sequence: Synthetic peptide
  XENP28028 vlCDR1
KSSQSIVYSNGNNYLE

SEQ ID NO: 43202 - protein, 7 aa, Artificial Sequence
  Description of Artificial Sequence: Synthetic peptide
  XENP28028 vlCDR2
KVSNRFS

SEQ ID NO: 43203 - protein, 9 aa, Artificial Sequence
  Description of Artificial Sequence: Synthetic peptide
  XENP28028 vlCDR3
FQGSHVPNT

SEQ ID NO: 43204 - protein, 446 aa, Artificial Sequence
  Description of Artificial Sequence: Synthetic polypeptide
  XENP28029 1C11_H3.332_L3.220_IgG1_PVA_/S267K Heavy Chain
QIQLVQSGSELLKPGASVSVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43205 - protein, 117 aa, Artificial Sequence
  Description of Artificial Sequence: Synthetic polypeptide
  VH of XENP28029
QIQLVQSGSELLKPGASVSVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSS

SEQ ID NO: 43206 - protein, 5 aa, Artificial Sequence
  Description of Artificial Sequence: Synthetic peptide
  XENP28029 vhCDR1
HYGMN

SEQ ID NO: 43207 - protein, 17 aa, Artificial Sequence
  Description of Artificial Sequence: Synthetic peptide
  XENP28029 vhCDR2
WINTHSGEPTYADGFTG

SEQ ID NO: 43208 - protein, 8 aa, Artificial Sequence
  Description of Artificial Sequence: Synthetic peptide
  XENP28029 vhCDR3
DYYGSSPY

SEQ ID NO: 43209 - protein, 219 aa, Artificial Sequence; identical to SEQ ID NO: 42759
  Description of Artificial Sequence: Synthetic polypeptide
  XENP28029 1C11_H3.332_L3.220_IgG1_PVA_/S267K Light Chain

SEQ ID NO: 43210 - protein, 112 aa, Artificial Sequence; identical to SEQ ID NO: 42760
  Description of Artificial Sequence: Synthetic polypeptide
  VL of XENP28029

SEQ ID NO: 43211 - protein, 16 aa, Artificial Sequence
  Description of Artificial Sequence: Synthetic peptide
  XENP28029 vlCDR1
KSSQSIVYSNGNNYLE

SEQ ID NO: 43212 - protein, 7 aa, Artificial Sequence
  Description of Artificial Sequence: Synthetic peptide
  XENP28029 vlCDR2
KVSNRFS

SEQ ID NO: 43213 - protein, 9 aa, Artificial Sequence
  Description of Artificial Sequence: Synthetic peptide
  XENP28029 vlCDR3
FQGSHVPNT

SEQ ID NO: 43214 - protein, 446 aa, Artificial Sequence
  Description of Artificial Sequence: Synthetic polypeptide
  XENP28030 1C11_H3.333_L3.220_IgG1_PVA_/S267K Heavy Chain
QIQLVQSGSELLKPGASVKVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43215 - protein, 117 aa, Artificial Sequence
  Description of Artificial Sequence: Synthetic polypeptide
  VH of XENP28030
QIQLVQSGSELLKPGASVKVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSS

SEQ ID NO: 43216 - protein, 5 aa, Artificial Sequence
  Description of Artificial Sequence: Synthetic peptide
  XENP28030 vhCDR1
HYGMN

SEQ ID NO: 43217 - protein, 17 aa, Artificial Sequence
  Description of Artificial Sequence: Synthetic peptide
  XENP28030 vhCDR2
WINTHSGEPTYADGFTG

SEQ ID NO: 43218 - protein, 8 aa, Artificial Sequence
  Description of Artificial Sequence: Synthetic peptide
  XENP28030 vhCDR3
DYFGSSPY

SEQ ID NO: 43219 - protein, 219 aa, Artificial Sequence; identical to SEQ ID NO: 42759
  Description of Artificial Sequence: Synthetic polypeptide
  XENP28030 1C11_H3.333_L3.220_IgG1_PVA_/S267K Light Chain

SEQ ID NO: 43220 - protein, 112 aa, Artificial Sequence; identical to SEQ ID NO: 42760
  Description of Artificial Sequence: Synthetic polypeptide
  VL of XENP28030

SEQ ID NO: 43221 - protein, 16 aa, Artificial Sequence
  Description of Artificial Sequence: Synthetic peptide
  XENP28030 vlCDR1
KSSQSIVYSNGNNYLE

SEQ ID NO: 43222 - protein, 7 aa, Artificial Sequence
  Description of Artificial Sequence: Synthetic peptide
  XENP28030 vlCDR2
KVSNRFS

SEQ ID NO: 43223 - protein, 9 aa, Artificial Sequence
  Description of Artificial Sequence: Synthetic peptide
  XENP28030 vlCDR3
FQGSHVPNT

SEQ ID NO: 43224 - protein, 446 aa, Artificial Sequence
  Description of Artificial Sequence: Synthetic polypeptide
  XENP28031 1C11_H3.334_L3.220_IgG1_PVA_/S267K Heavy Chain
QIQLVQSGSELKKPGASVSVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43225 - protein, 117 aa, Artificial Sequence
  Description of Artificial Sequence: Synthetic polypeptide
  VH of XENP28031
QIQLVQSGSELKKPGASVSVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSS

SEQ ID NO: 43226 - protein, 5 aa, Artificial Sequence
  Description of Artificial Sequence: Synthetic peptide
  XENP28031 vhCDR1
HYGMN

SEQ ID NO: 43227 - protein, 17 aa, Artificial Sequence
  Description of Artificial Sequence: Synthetic peptide
  XENP28031 vhCDR2
WINTHSGEPTYADGFTG

SEQ ID NO: 43228 - protein, 8 aa, Artificial Sequence
  Description of Artificial Sequence: Synthetic peptide
  XENP28031 vhCDR3
DYFGSSPY

SEQ ID NO: 43229 - protein, 219 aa, Artificial Sequence; identical to SEQ ID NO: 42759
  Description of Artificial Sequence: Synthetic polypeptide
  XENP28031 1C11_H3.334_L3.220_IgG1_PVA_/S267K Light Chain

SEQ ID NO: 43230 - protein, 112 aa, Artificial Sequence; identical to SEQ ID NO: 42760
  Description of Artificial Sequence: Synthetic polypeptide
  VL of XENP28031

SEQ ID NO: 43231 - protein, 16 aa, Artificial Sequence
  Description of Artificial Sequence: Synthetic peptide
  XENP28031 vlCDR1
KSSQSIVYSNGNNYLE

SEQ ID NO: 43232 - protein, 7 aa, Artificial Sequence
  Description of Artificial Sequence: Synthetic peptide
  XENP28031 vlCDR2
KVSNRFS

SEQ ID NO: 43233 - protein, 9 aa, Artificial Sequence
  Description of Artificial Sequence: Synthetic peptide
  XENP28031 vlCDR3
FQGSHVPNT

SEQ ID NO: 43234 - protein, 446 aa, Artificial Sequence
  Description of Artificial Sequence: Synthetic polypeptide
  XENP28032 1C11_H3.335_L3.220_IgG1_PVA_/S267K Heavy Chain
QIQLVQSGSELLKPGASVSVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43235 - protein, 117 aa, Artificial Sequence
  Description of Artificial Sequence: Synthetic polypeptide
  VH of XENP28032
QIQLVQSGSELLKPGASVSVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSS

SEQ ID NO: 43236 - protein, 5 aa, Artificial Sequence
  Description of Artificial Sequence: Synthetic peptide
  XENP28032 vhCDR1
HYGMN

SEQ ID NO: 43237 - protein, 17 aa, Artificial Sequence
  Description of Artificial Sequence: Synthetic peptide
  XENP28032 vhCDR2
WINTHSGEPTYADGFTG

SEQ ID NO: 43238 - protein, 8 aa, Artificial Sequence
  Description of Artificial Sequence: Synthetic peptide
  XENP28032 vhCDR3
DYFGSSPY

SEQ ID NO: 43239 - protein, 219 aa, Artificial Sequence; identical to SEQ ID NO: 42759
  Description of Artificial Sequence: Synthetic polypeptide
  XENP28032 1C11_H3.335_L3.220_IgG1_PVA_/S267K Light Chain

SEQ ID NO: 43240 - protein, 112 aa, Artificial Sequence; identical to SEQ ID NO: 42760
  Description of Artificial Sequence: Synthetic polypeptide
  VL of XENP28032

SEQ ID NO: 43241 - protein, 16 aa, Artificial Sequence
  Description of Artificial Sequence: Synthetic peptide
  XENP28032 vlCDR1
KSSQSIVYSNGNNYLE

SEQ ID NO: 43242 - protein, 7 aa, Artificial Sequence
  Description of Artificial Sequence: Synthetic peptide
  XENP28032 vlCDR2
KVSNRFS

SEQ ID NO: 43243 - protein, 9 aa, Artificial Sequence
  Description of Artificial Sequence: Synthetic peptide
  XENP28032 vlCDR3
FQGSHVPNT

SEQ ID NO: 43244 - protein, 446 aa, Artificial Sequence
  Description of Artificial Sequence: Synthetic polypeptide
  XENP28033 1C11_H3.336_L3.220_IgG1_PVA_/S267K Heavy Chain
QIQLVQSGSELLKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43245 - protein, 117 aa, Artificial Sequence
  Description of Artificial Sequence: Synthetic polypeptide
  VH of XENP28033
QIQLVQSGSELLKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSS

SEQ ID NO: 43246 - protein, 5 aa, Artificial Sequence
  Description of Artificial Sequence: Synthetic peptide
  XENP28033 vhCDR1
HYGMN

SEQ ID NO: 43247 - protein, 17 aa, Artificial Sequence
  Description of Artificial Sequence: Synthetic peptide
  XENP28033 vhCDR2
WINTYTGEPTYADGFTG

SEQ ID NO: 43248 - protein, 8 aa, Artificial Sequence
  Description of Artificial Sequence: Synthetic peptide
  XENP28033 vhCDR3
DYFGSSPY

SEQ ID NO: 43249 - protein, 219 aa, Artificial Sequence; identical to SEQ ID NO: 42759
  Description of Artificial Sequence: Synthetic polypeptide
  XENP28033 1C11_H3.336_L3.220_IgG1_PVA_/S267K Light Chain

SEQ ID NO: 43250 - protein, 112 aa, Artificial Sequence; identical to SEQ ID NO: 42760
  Description of Artificial Sequence: Synthetic polypeptide
  VL of XENP28033

SEQ ID NO: 43251 - protein, 16 aa, Artificial Sequence
  Description of Artificial Sequence: Synthetic peptide
  XENP28033 vlCDR1
KSSQSIVYSNGNNYLE

SEQ ID NO: 43252 - protein, 7 aa, Artificial Sequence
  Description of Artificial Sequence: Synthetic peptide
  XENP28033 vlCDR2
KVSNRFS

SEQ ID NO: 43253 - protein, 9 aa, Artificial Sequence
  Description of Artificial Sequence: Synthetic peptide
  XENP28033 vlCDR3
FQGSHVPNT

SEQ ID NO: 43254 - protein, 446 aa, Artificial Sequence
  Description of Artificial Sequence: Synthetic polypeptide
  XENP28034 1C11_H3.337_L3.220_IgG1_PVA_/S267K Heavy Chain
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43255 - protein, 117 aa, Artificial Sequence
  Description of Artificial Sequence: Synthetic polypeptide
  VH of XENP28034
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSS

SEQ ID NO: 43256 - protein, 5 aa, Artificial Sequence
  Description of Artificial Sequence: Synthetic peptide
  XENP28034 vhCDR1
HYGMN

SEQ ID NO: 43257 - protein, 17 aa, Artificial Sequence
  Description of Artificial Sequence: Synthetic peptide
  XENP28034 vhCDR2
WINTYTGEPTYADGFTG

SEQ ID NO: 43258 - protein, 8 aa, Artificial Sequence
  Description of Artificial Sequence: Synthetic peptide
  XENP28034 vhCDR3
DYFGSSPY

SEQ ID NO: 43259 - protein, 219 aa, Artificial Sequence; identical to SEQ ID NO: 42759
  Description of Artificial Sequence: Synthetic polypeptide
  XENP28034 1C11_H3.337_L3.220_IgG1_PVA_/S267K Light Chain

SEQ ID NO: 43260 - protein, 112 aa, Artificial Sequence; identical to SEQ ID NO: 42760
  Description of Artificial Sequence: Synthetic polypeptide
  VL of XENP28034

SEQ ID NO: 43261 - protein, 16 aa, Artificial Sequence
  Description of Artificial Sequence: Synthetic peptide
  XENP28034 vlCDR1
KSSQSIVYSNGNNYLE

SEQ ID NO: 43262 - protein, 7 aa, Artificial Sequence
  Description of Artificial Sequence: Synthetic peptide
  XENP28034 vlCDR2
KVSNRFS

SEQ ID NO: 43263 - protein, 9 aa, Artificial Sequence
  Description of Artificial Sequence: Synthetic peptide
  XENP28034 vlCDR3
FQGSHVPNT

SEQ ID NO: 43264 - protein, 446 aa, Artificial Sequence
  Description of Artificial Sequence: Synthetic polypeptide
  XENP28035 1C11_H3.338_L3.220_IgG1_PVA_/S267K Heavy Chain
QIQLVQSGSELLKPGASVSVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43265 - protein, 117 aa, Artificial Sequence
  Description of Artificial Sequence: Synthetic polypeptide
  VH of XENP28035
QIQLVQSGSELLKPGASVSVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSS

SEQ ID NO: 43266 - protein, 5 aa, Artificial Sequence
  Description of Artificial Sequence: Synthetic peptide
  XENP28035 vhCDR1
HYGMN

SEQ ID NO: 43267 - protein, 17 aa, Artificial Sequence
  Description of Artificial Sequence: Synthetic peptide
  XENP28035 vhCDR2
WINTYTGEPTYADGFTG

SEQ ID NO: 43268 - protein, 8 aa, Artificial Sequence
  Description of Artificial Sequence: Synthetic peptide
  XENP28035 vhCDR3
DYFGSSPY

SEQ ID NO: 43269 - protein, 219 aa, Artificial Sequence; identical to SEQ ID NO: 42759
  Description of Artificial Sequence: Synthetic polypeptide
  XENP28035 1C11_H3.338_L3.220_IgG1_PVA_/S267K Light Chain

SEQ ID NO: 43270 - protein, 112 aa, Artificial Sequence; identical to SEQ ID NO: 42760
  Description of Artificial Sequence: Synthetic polypeptide
  VL of XENP28035

SEQ ID NO: 43271 - protein, 16 aa, Artificial Sequence
  Description of Artificial Sequence: Synthetic peptide
  XENP28035 vlCDR1
KSSQSIVYSNGNNYLE

SEQ ID NO: 43272 - protein, 7 aa, Artificial Sequence
  Description of Artificial Sequence: Synthetic peptide
  XENP28035 vlCDR2
KVSNRFS

SEQ ID NO: 43273 - protein, 9 aa, Artificial Sequence
  Description of Artificial Sequence: Synthetic peptide
  XENP28035 vlCDR3
FQGSHVPNT

SEQ ID NO: 43274 - protein, 446 aa, Artificial Sequence; identical to SEQ ID NO: 43154
  Description of Artificial Sequence: Synthetic polypeptide
  XENP28651 1C11_H3.327_L3.152_IgG1_PVA_/S267K Heavy Chain

SEQ ID NO: 43275 - protein, 117 aa, Artificial Sequence; identical to SEQ ID NO: 43155
  Description of Artificial Sequence: Synthetic polypeptide
  VH of XENP28651

SEQ ID NO: 43276 - protein, 5 aa, Artificial Sequence
  Description of Artificial Sequence: Synthetic peptide
  XENP28651 vhCDR1
HYGMN

SEQ ID NO: 43277 - protein, 17 aa, Artificial Sequence
  Description of Artificial Sequence: Synthetic peptide
  XENP28651 vhCDR2
WINTHTGEPTYADGFTG

SEQ ID NO: 43278 - protein, 8 aa, Artificial Sequence
  Description of Artificial Sequence: Synthetic peptide
  XENP28651 vhCDR3
DYFGSSPY

SEQ ID NO: 43279 - protein, 219 aa, Artificial Sequence; identical to SEQ ID NO: 41984
  Description of Artificial Sequence: Synthetic polypeptide
  XENP28651 1C11_H3.327_L3.152_IgG1_PVA_/S267K Light Chain

SEQ ID NO: 43280 - protein, 112 aa, Artificial Sequence; identical to SEQ ID NO: 41985
  Description of Artificial Sequence: Synthetic polypeptide
  VL of XENP28651

SEQ ID NO: 43281 - protein, 16 aa, Artificial Sequence
  Description of Artificial Sequence: Synthetic peptide
  XENP28651 vlCDR1
KSSQSIVFSNGNTYLE

SEQ ID NO: 43282 - protein, 7 aa, Artificial Sequence
  Description of Artificial Sequence: Synthetic peptide
  XENP28651 vlCDR2
KVSNRFS

SEQ ID NO: 43283 - protein, 9 aa, Artificial Sequence
  Description of Artificial Sequence: Synthetic peptide
  XENP28651 vlCDR3
FQGSHVPNT

SEQ ID NO: 43284 - protein, 446 aa, Artificial Sequence; identical to SEQ ID NO: 43164
  Description of Artificial Sequence: Synthetic polypeptide
  XENP28652 1C11_H3.328_L3.152_IgG1_PVA_/S267K Heavy Chain

SEQ ID NO: 43285 - protein, 117 aa, Artificial Sequence; identical to SEQ ID NO: 43165
  Description of Artificial Sequence: Synthetic polypeptide
  VH of XENP28652

SEQ ID NO: 43286 - protein, 5 aa, Artificial Sequence
  Description of Artificial Sequence: Synthetic peptide
  XENP28652 vhCDR1
HYGMN

SEQ ID NO: 43287 - protein, 17 aa, Artificial Sequence
  Description of Artificial Sequence: Synthetic peptide
  XENP28652 vhCDR2
WINTHTGEPTYADGFTG

SEQ ID NO: 43288 - protein, 8 aa, Artificial Sequence
  Description of Artificial Sequence: Synthetic peptide
  XENP28652 vhCDR3
DYFGSSPY

SEQ ID NO: 43289 - protein, 219 aa, Artificial Sequence; identical to SEQ ID NO: 41984
  Description of Artificial Sequence: Synthetic polypeptide
  XENP28652 1C11_H3.328_L3.152_IgG1_PVA_/S267K Light Chain

SEQ ID NO: 43290 - protein, 112 aa, Artificial Sequence; identical to SEQ ID NO: 41985
  Description of Artificial Sequence: Synthetic polypeptide
  VL of XENP28652

SEQ ID NO: 43291 - protein, 16 aa, Artificial Sequence
  Description of Artificial Sequence: Synthetic peptide
  XENP28652 vlCDR1
KSSQSIVFSNGNTYLE

SEQ ID NO: 43292 - protein, 7 aa, Artificial Sequence
  Description of Artificial Sequence: Synthetic peptide
  XENP28652 vlCDR2
KVSNRFS

SEQ ID NO: 43293 - protein, 9 aa, Artificial Sequence
  Description of Artificial Sequence: Synthetic peptide
  XENP28652 vlCDR3
FQGSHVPNT

SEQ ID NO: 43294 - protein, 446 aa, Artificial Sequence; identical to SEQ ID NO: 43174
  Description of Artificial Sequence: Synthetic polypeptide
  XENP28653 1C11_H3.329_L3.152_IgG1_PVA_/S267K Heavy Chain

SEQ ID NO: 43295 - protein, 117 aa, Artificial Sequence; identical to SEQ ID NO: 43175
  Description of Artificial Sequence: Synthetic polypeptide
  VH of XENP28653

SEQ ID NO: 43296 - protein, 5 aa, Artificial Sequence
  Description of Artificial Sequence: Synthetic peptide
  XENP28653 vhCDR1
HYGMN

SEQ ID NO: 43297 - protein, 17 aa, Artificial Sequence
  Description of Artificial Sequence: Synthetic peptide
  XENP28653 vhCDR2
WINTHTGEPTYADGFTG

SEQ ID NO: 43298 - protein, 8 aa, Artificial Sequence
  Description of Artificial Sequence: Synthetic peptide
  XENP28653 vhCDR3
DYFGSSPY

SEQ ID NO: 43299 - protein, 219 aa, Artificial Sequence; identical to SEQ ID NO: 41984
  Description of Artificial Sequence: Synthetic polypeptide
  XENP28653 1C11_H3.329_L3.152_IgG1_PVA_/S267K Light Chain

SEQ ID NO: 43300 - protein, 112 aa, Artificial Sequence; identical to SEQ ID NO: 41985
  Description of Artificial Sequence: Synthetic polypeptide
  VL of XENP28653

SEQ ID NO: 43301 - protein, 16 aa, Artificial Sequence
  Description of Artificial Sequence: Synthetic peptide
  XENP28653 vlCDR1
KSSQSIVFSNGNTYLE

SEQ ID NO: 43302 - protein, 7 aa, Artificial Sequence
  Description of Artificial Sequence: Synthetic peptide
  XENP28653 vlCDR2
KVSNRFS

SEQ ID NO: 43303 - protein, 9 aa, Artificial Sequence
  Description of Artificial Sequence: Synthetic peptide
  XENP28653 vlCDR3
FQGSHVPNT

SEQ ID NO: 43304 - protein, 446 aa, Artificial Sequence
  Description of Artificial Sequence: Synthetic polypeptide
  XENP28654 1C11_H3.23_L3_IgG1_PVA_/S267K Heavy Chain
QIQLVQSGSELKKPGASVKVSCKASGYTFTHYGMNWVRQAPGQGLEWMGYINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43305 - protein, 117 aa, Artificial Sequence
  Description of Artificial Sequence: Synthetic polypeptide
  VH of XENP28654
QIQLVQSGSELKKPGASVKVSCKASGYTFTHYGMNWVRQAPGQGLEWMGYINTYTGEPTYADGFTGRFVFSLDTSVSTAYLQISSLKAEDTAVYFCARDYYGSSPYWGQGTLVTVSS

SEQ ID NO: 43306 - protein, 5 aa, Artificial Sequence
  Description of Artificial Sequence: Synthetic peptide
  XENP28654 vhCDR1
HYGMN

SEQ ID NO: 43307 - protein, 17 aa, Artificial Sequence
  Description of Artificial Sequence: Synthetic peptide
  XENP28654 vhCDR2
YINTYTGEPTYADGFTG

SEQ ID NO: 43308 - protein, 8 aa, Artificial Sequence
  Description of Artificial Sequence: Synthetic peptide
  XENP28654 vhCDR3
DYYGSSPY

SEQ ID NO: 43309 - protein, 219 aa, Artificial Sequence; identical to SEQ ID NO: 33008
  Description of Artificial Sequence: Synthetic polypeptide
  XENP28654 1C11_H3.23_L3_IgG1_PVA_/S267K Light Chain

SEQ ID NO: 43310 - protein, 112 aa, Artificial Sequence; identical to SEQ ID NO: 33009
  Description of Artificial Sequence: Synthetic polypeptide
  VL of XENP28654

SEQ ID NO: 43311 - protein, 16 aa, Artificial Sequence
  Description of Artificial Sequence: Synthetic peptide
  XENP28654 vlCDR1
KSSQSIVHSNGNTYLE

SEQ ID NO: 43312 - protein, 7 aa, Artificial Sequence
  Description of Artificial Sequence: Synthetic peptide
  XENP28654 vlCDR2
KVSNRFS

SEQ ID NO: 43313 - protein, 9 aa, Artificial Sequence
  Description of Artificial Sequence: Synthetic peptide
  XENP28654 vlCDR3
FQGSHVPNT

SEQ ID NO: 43314 - protein, 446 aa, Artificial Sequence
  Description of Artificial Sequence: Synthetic polypeptide
  XENP28655 1C11_H3.28_L3_IgG1_PVA_/S267K Heavy Chain
QIQLVQSGSELKKPGASVKVSCKASGYTFTHYGMNWVRQAPGQGLEWMGWINTYTGETTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43315 - protein, 117 aa, Artificial Sequence
  Description of Artificial Sequence: Synthetic polypeptide
  VH of XENP28655
QIQLVQSGSELKKPGASVKVSCKASGYTFTHYGMNWVRQAPGQGLEWMGWINTYTGETTYADGFTGRFVFSLDTSVSTAYLQISSLKAEDTAVYFCARDYYGSSPYWGQGTLVTVSS

SEQ ID NO: 43316 - protein, 5 aa, Artificial Sequence
  Description of Artificial Sequence: Synthetic peptide
  XENP28655 vhCDR1
HYGMN

SEQ ID NO: 43317 - protein, 17 aa, Artificial Sequence
  Description of Artificial Sequence: Synthetic peptide
  XENP28655 vhCDR2
WINTYTGETTYADGFTG

SEQ ID NO: 43318 - protein, 8 aa, Artificial Sequence
  Description of Artificial Sequence: Synthetic peptide
  XENP28655 vhCDR3
DYYGSSPY

SEQ ID NO: 43319 - protein, 219 aa, Artificial Sequence; identical to SEQ ID NO: 33008
  Description of Artificial Sequence: Synthetic polypeptide
  XENP28655 1C11_H3.28_L3_IgG1_PVA_/S267K Light Chain

SEQ ID NO: 43320 - protein, 112 aa, Artificial Sequence; identical to SEQ ID NO: 33009
  Description of Artificial Sequence: Synthetic polypeptide
  VL of XENP28655

SEQ ID NO: 43321 - protein, 16 aa, Artificial Sequence
  Description of Artificial Sequence: Synthetic peptide
  XENP28655 vlCDR1
KSSQSIVHSNGNTYLE

SEQ ID NO: 43322 - protein, 7 aa, Artificial Sequence
  Description of Artificial Sequence: Synthetic peptide
  XENP28655 vlCDR2
KVSNRFS

SEQ ID NO: 43323 - protein, 9 aa, Artificial Sequence
  Description of Artificial Sequence: Synthetic peptide
  XENP28655 vlCDR3
FQGSHVPNT

SEQ ID NO: 43324 - protein, 446 aa, Artificial Sequence
  Description of Artificial Sequence: Synthetic polypeptide
  XENP28656 1C11_H3.35_L3_IgG1_PVA_/S267K Heavy Chain
QIQLVQSGSELKKPGASVKVSCKASGYTFTHYGMNWVRQAPGQGLEWMGWINTYTGEPTYADKFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43325 - protein, 117 aa, Artificial Sequence; identical to SEQ ID NO: 33839
  Description of Artificial Sequence: Synthetic polypeptide
  VH of XENP28656

SEQ ID NO: 43326 - protein, 5 aa, Artificial Sequence
  Description of Artificial Sequence: Synthetic peptide
  XENP28656 vhCDR1
HYGMN

SEQ ID NO: 43327 - protein, 17 aa, Artificial Sequence
  Description of Artificial Sequence: Synthetic peptide
  XENP28656 vhCDR2
WINTYTGEPTYADKFTG

SEQ ID NO: 43328 - protein, 8 aa, Artificial Sequence
  Description of Artificial Sequence: Synthetic peptide
  XENP28656 vhCDR3
DYYGSSPY

SEQ ID NO: 43329 - protein, 219 aa, Artificial Sequence; identical to SEQ ID NO: 33008
  Description of Artificial Sequence: Synthetic polypeptide
  XENP28656 1C11_H3.35_L3_IgG1_PVA_/S267K Light Chain

SEQ ID NO: 43330 - protein, 112 aa, Artificial Sequence; identical to SEQ ID NO: 33009
  Description of Artificial Sequence: Synthetic polypeptide
  VL of XENP28656

SEQ ID NO: 43331 - protein, 16 aa, Artificial Sequence
  Description of Artificial Sequence: Synthetic peptide
  XENP28656 vlCDR1
KSSQSIVHSNGNTYLE

SEQ ID NO: 43332 - protein, 7 aa, Artificial Sequence
  Description of Artificial Sequence: Synthetic peptide
  XENP28656 vlCDR2
KVSNRFS

SEQ ID NO: 43333 - protein, 9 aa, Artificial Sequence
  Description of Artificial Sequence: Synthetic peptide
  XENP28656 vlCDR3
FQGSHVPNT

SEQ ID NO: 43334 - protein, 446 aa, Artificial Sequence; identical to SEQ ID NO: 39254
  Description of Artificial Sequence: Synthetic polypeptide
  XENP28657 1C11_H3_L3.71_IgG1_PVA_/S267K Heavy Chain

SEQ ID NO: 43335 - protein, 117 aa, Artificial Sequence; identical to SEQ ID NO: 33034
  Description of Artificial Sequence: Synthetic polypeptide
  VH of XENP28657

SEQ ID NO: 43336 - protein, 5 aa, Artificial Sequence
  Description of Artificial Sequence: Synthetic peptide
  XENP28657 vhCDR1
HYGMN

SEQ ID NO: 43337 - protein, 17 aa, Artificial Sequence
  Description of Artificial Sequence: Synthetic peptide
  XENP28657 vhCDR2
WINTYTGEPTYADGFTG

SEQ ID NO: 43338 - protein, 8 aa, Artificial Sequence
  Description of Artificial Sequence: Synthetic peptide
  XENP28657 vhCDR3
DYYGSSPY

SEQ ID NO: 43339 - protein, 219 aa, Artificial Sequence
  Description of Artificial Sequence: Synthetic polypeptide
  XENP28657 1C11_H3_L3.71_IgG1_PVA_/S267K Light Chain
DVLMTQSPDSLAVSLGERATINCKSSQSIVHSNGNTYLEWYQQKPGQSPKLLIYKVSNRFSGVPDRFSGSGSGTDFTLTISSLQAEDIAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43340 - protein, 112 aa, Artificial Sequence
  Description of Artificial Sequence: Synthetic polypeptide
  VL of XENP28657
DVLMTQSPDSLAVSLGERATINCKSSQSIVHSNGNTYLEWYQQKPGQSPKLLIYKVSNRFSGVPDRFSGSGSGTDFTLTISSLQAEDIAVYYCFQGSHVPNTFGGGTKVEIK

SEQ ID NO: 43341 - protein, 16 aa, Artificial Sequence
  Description of Artificial Sequence: Synthetic peptide
  XENP28657 vlCDR1
KSSQSIVHSNGNTYLE

SEQ ID NO: 43342 - protein, 7 aa, Artificial Sequence
  Description of Artificial Sequence: Synthetic peptide
  XENP28657 vlCDR2
KVSNRFS

SEQ ID NO: 43343 - protein, 9 aa, Artificial Sequence
  Description of Artificial Sequence: Synthetic peptide
  XENP28657 vlCDR3
FQGSHVPNT

SEQ ID NO: 43344 - protein, 446 aa, Artificial Sequence; identical to SEQ ID NO: 39254
  Description of Artificial Sequence: Synthetic polypeptide
  XENP28658 1C11_H3_L3.74_IgG1_PVA_/S267K Heavy Chain

SEQ ID NO: 43345 - protein, 117 aa, Artificial Sequence; identical to SEQ ID NO: 33034
  Description of Artificial Sequence: Synthetic polypeptide
  VH of XENP28658

SEQ ID NO: 43346 - protein, 5 aa, Artificial Sequence
  Description of Artificial Sequence: Synthetic peptide
  XENP28658 vhCDR1
HYGMN

SEQ ID NO: 43347 - protein, 17 aa, Artificial Sequence
  Description of Artificial Sequence: Synthetic peptide
  XENP28658 vhCDR2
WINTYTGEPTYADGFTG

SEQ ID NO: 43348 - protein, 8 aa, Artificial Sequence
  Description of Artificial Sequence: Synthetic peptide
  XENP28658 vhCDR3
DYYGSSPY

SEQ ID NO: 43349 - protein, 219 aa, Artificial Sequence
  Description of Artificial Sequence: Synthetic polypeptide
  XENP28658 1C11_H3_L3.74_IgG1_PVA_/S267K Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCQQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43350 - protein, 112 aa, Artificial Sequence
  Description of Artificial Sequence: Synthetic polypeptide
  VL of XENP28658
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCQQGSHVPNTFGGGTKVEIK

SEQ ID NO: 43351 - protein, 16 aa, Artificial Sequence
  Description of Artificial Sequence: Synthetic peptide
  XENP28658 vlCDR1
KSSQSIVHSNGNTYLE

SEQ ID NO: 43352 - protein, 7 aa, Artificial Sequence
  Description of Artificial Sequence: Synthetic peptide
  XENP28658 vlCDR2
KVSNRFS

SEQ ID NO: 43353 - protein, 9 aa, Artificial Sequence
  Description of Artificial Sequence: Synthetic peptide
  XENP28658 vlCDR3
QQGSHVPNT

SEQ ID NO: 43354 - protein, 446 aa, Artificial Sequence; identical to SEQ ID NO: 39254
  Description of Artificial Sequence: Synthetic polypeptide
  XENP28659 1C11_H3_L3.77_IgG1_PVA_/S267K Heavy Chain

SEQ ID NO: 43355 - protein, 117 aa, Artificial Sequence; identical to SEQ ID NO: 33034
  Description of Artificial Sequence: Synthetic polypeptide
  VH of XENP28659

SEQ ID NO: 43356 - protein, 5 aa, Artificial Sequence
  Description of Artificial Sequence: Synthetic peptide
  XENP28659 vhCDR1
HYGMN

SEQ ID NO: 43357 - protein, 17 aa, Artificial Sequence
  Description of Artificial Sequence: Synthetic peptide
  XENP28659 vhCDR2
WINTYTGEPTYADGFTG

SEQ ID NO: 43358 - protein, 8 aa, Artificial Sequence
  Description of Artificial Sequence: Synthetic peptide
  XENP28659 vhCDR3
DYYGSSPY

SEQ ID NO: 43359 - protein, 219 aa, Artificial Sequence
  Description of Artificial Sequence: Synthetic polypeptide
  XENP28659 1C11_H3_L3.77_IgG1_PVA_/S267K Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQYSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43360 - protein, 112 aa, Artificial Sequence
  Description of Artificial Sequence: Synthetic polypeptide
  VL of XENP28659
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQYSHVPNTFGGGTKVEIK

SEQ ID NO: 43361 - protein, 16 aa, Artificial Sequence
  Description of Artificial Sequence: Synthetic peptide
  XENP28659 vlCDR1
KSSQSIVHSNGNTYLE

SEQ ID NO: 43362 - protein, 7 aa, Artificial Sequence
  Description of Artificial Sequence: Synthetic peptide
  XENP28659 vlCDR2
KVSNRFS

SEQ ID NO: 43363 - protein, 9 aa, Artificial Sequence
  Description of Artificial Sequence: Synthetic peptide
  XENP28659 vlCDR3
FQYSHVPNT

SEQ ID NO: 43364 - protein, 446 aa, Artificial Sequence; identical to SEQ ID NO: 41649
  Description of Artificial Sequence: Synthetic polypeptide
  XENP29029 1C11_H3.246_L3_IgG1_PVA_/S267K Heavy Chain

SEQ ID NO: 43365 - protein, 117 aa, Artificial Sequence; identical to SEQ ID NO: 41650
  Description of Artificial Sequence: Synthetic polypeptide
  VH of XENP29029

SEQ ID NO: 43366 - protein, 5 aa, Artificial Sequence
  Description of Artificial Sequence: Synthetic peptide
  XENP29029 vhCDR1
HYGMN

SEQ ID NO: 43367 - protein, 17 aa, Artificial Sequence
  Description of Artificial Sequence: Synthetic peptide
  XENP29029 vhCDR2
WINTYTGEPTYADGFTG

SEQ ID NO: 43368 - protein, 8 aa, Artificial Sequence
  Description of Artificial Sequence: Synthetic peptide
  XENP29029 vhCDR3
DYYGSSPY

SEQ ID NO: 43369 - protein, 219 aa, Artificial Sequence; identical to SEQ ID NO: 33008
  Description of Artificial Sequence: Synthetic polypeptide
  XENP29029 1C11_H3.246_L3_IgG1_PVA_/S267K Light Chain

SEQ ID NO: 43370 - protein, 112 aa, Artificial Sequence; identical to SEQ ID NO: 33009
  Description of Artificial Sequence: Synthetic polypeptide
  VL of XENP29029

SEQ ID NO: 43371 - protein, 16 aa, Artificial Sequence
  Description of Artificial Sequence: Synthetic peptide
  XENP29029 vlCDR1
KSSQSIVHSNGNTYLE

SEQ ID NO: 43372 - protein, 7 aa, Artificial Sequence
  Description of Artificial Sequence: Synthetic peptide
  XENP29029 vlCDR2
KVSNRFS

SEQ ID NO: 43373 - protein, 9 aa, Artificial Sequence
  Description of Artificial Sequence: Synthetic peptide
  XENP29029 vlCDR3
FQGSHVPNT

SEQ ID NO: 43374 - protein, 446 aa, Artificial Sequence; identical to SEQ ID NO: 41654
  Description of Artificial Sequence: Synthetic polypeptide
  XENP29030 1C11_H3.247_L3_IgG1_PVA_/S267K Heavy Chain

SEQ ID NO: 43375 - protein, 117 aa, Artificial Sequence; identical to SEQ ID NO: 41655
  Description of Artificial Sequence: Synthetic polypeptide
  VH of XENP29030

SEQ ID NO: 43376 - protein, 5 aa, Artificial Sequence
  Description of Artificial Sequence: Synthetic peptide
  XENP29030 vhCDR1
HYGMN

SEQ ID NO: 43377 - protein, 17 aa, Artificial Sequence
  Description of Artificial Sequence: Synthetic peptide
  XENP29030 vhCDR2
WINTYTGEPTYADGFTG

SEQ ID NO: 43378 - protein, 8 aa, Artificial Sequence
  Description of Artificial Sequence: Synthetic peptide
  XENP29030 vhCDR3
DYYGSSPY

SEQ ID NO: 43379 - protein, 219 aa, Artificial Sequence; identical to SEQ ID NO: 33008
  Description of Artificial Sequence: Synthetic polypeptide
  XENP29030 1C11_H3.247_L3_IgG1_PVA_/S267K Light Chain

SEQ ID NO: 43380 - protein, 112 aa, Artificial Sequence; identical to SEQ ID NO: 33009
  Description of Artificial Sequence: Synthetic polypeptide
  VL of XENP29030

SEQ ID NO: 43381 - protein, 16 aa, Artificial Sequence
  Description of Artificial Sequence: Synthetic peptide
  XENP29030 vlCDR1
KSSQSIVHSNGNTYLE

SEQ ID NO: 43382 - protein, 7 aa, Artificial Sequence
  Description of Artificial Sequence: Synthetic peptide
  XENP29030 vlCDR2
KVSNRFS

SEQ ID NO: 43383 - protein, 9 aa, Artificial Sequence
  Description of Artificial Sequence: Synthetic peptide
  XENP29030 vlCDR3
FQGSHVPNT

SEQ ID NO: 43384 - protein, 446 aa, Artificial Sequence; identical to SEQ ID NO: 41659
  Description of Artificial Sequence: Synthetic polypeptide
  XENP29031 1C11_H3.248_L3_IgG1_PVA_/S267K Heavy Chain

SEQ ID NO: 43385 - protein, 117 aa, Artificial Sequence; identical to SEQ ID NO: 41660
  Description of Artificial Sequence: Synthetic polypeptide
  VH of XENP29031

SEQ ID NO: 43386 - protein, 5 aa, Artificial Sequence
  Description of Artificial Sequence: Synthetic peptide
  XENP29031 vhCDR1
HYGMN

SEQ ID NO: 43387 - protein, 17 aa, Artificial Sequence
  Description of Artificial Sequence: Synthetic peptide
  XENP29031 vhCDR2
WINTYTGEPTYADGFTG

SEQ ID NO: 43388 - protein, 8 aa, Artificial Sequence
  Description of Artificial Sequence: Synthetic peptide
  XENP29031 vhCDR3
DYYGSSPY

SEQ ID NO: 43389 - protein, 219 aa, Artificial Sequence; identical to SEQ ID NO: 33008
  Description of Artificial Sequence: Synthetic polypeptide
  XENP29031 1C11_H3.248_L3_IgG1_PVA_/S267K Light Chain

SEQ ID NO: 43390 - protein, 112 aa, Artificial Sequence; identical to SEQ ID NO: 33009
  Description of Artificial Sequence: Synthetic polypeptide
  VL of XENP29031

SEQ ID NO: 43391 - protein, 16 aa, Artificial Sequence
  Description of Artificial Sequence: Synthetic peptide
  XENP29031 vlCDR1
KSSQSIVHSNGNTYLE

SEQ ID NO: 43392 - protein, 7 aa, Artificial Sequence
  Description of Artificial Sequence: Synthetic peptide
  XENP29031 vlCDR2
KVSNRFS

SEQ ID NO: 43393 - protein, 9 aa, Artificial Sequence
  Description of Artificial Sequence: Synthetic peptide
  XENP29031 vlCDR3
FQGSHVPNT

SEQ ID NO: 43394 - protein, 446 aa, Artificial Sequence; identical to SEQ ID NO: 41689
  Description of Artificial Sequence: Synthetic polypeptide
  XENP29032 1C11_H3.254_L3_IgG1_PVA_/S267K Heavy Chain

SEQ ID NO: 43395 - protein, 117 aa, Artificial Sequence; identical to SEQ ID NO: 41690
  Description of Artificial Sequence: Synthetic polypeptide
  VH of XENP29032

SEQ ID NO: 43396 - protein, 5 aa, Artificial Sequence
  Description of Artificial Sequence: Synthetic peptide
  XENP29032 vhCDR1
HYGMN

SEQ ID NO: 43397 - protein, 17 aa, Artificial Sequence
  Description of Artificial Sequence: Synthetic peptide
  XENP29032 vhCDR2
WINTYTGEPTYADGFTG

SEQ ID NO: 43398 - protein, 8 aa, Artificial Sequence
  Description of Artificial Sequence: Synthetic peptide
  XENP29032 vhCDR3
DYYGSSPY

SEQ ID NO: 43399 - protein, 219 aa, Artificial Sequence; identical to SEQ ID NO: 33008
  Description of Artificial Sequence: Synthetic polypeptide
  XENP29032 1C11_H3.254_L3_IgG1_PVA_/S267K Light Chain

SEQ ID NO: 43400 - protein, 112 aa, Artificial Sequence; identical to SEQ ID NO: 33009
  Description of Artificial Sequence: Synthetic polypeptide
  VL of XENP29032

SEQ ID NO: 43401 - protein, 16 aa, Artificial Sequence
  Description of Artificial Sequence: Synthetic peptide
  XENP29032 vlCDR1
KSSQSIVHSNGNTYLE

SEQ ID NO: 43402 - protein, 7 aa, Artificial Sequence
  Description of Artificial Sequence: Synthetic peptide
  XENP29032 vlCDR2
KVSNRFS

SEQ ID NO: 43403 - protein, 9 aa, Artificial Sequence
  Description of Artificial Sequence: Synthetic peptide
  XENP29032 vlCDR3
FQGSHVPNT

SEQ ID NO: 43404 - protein, 446 aa, Artificial Sequence; identical to SEQ ID NO: 41734
  Description of Artificial Sequence: Synthetic polypeptide
  XENP29033 1C11_H3.263_L3_IgG1_PVA_/S267K Heavy Chain

SEQ ID NO: 43405 - protein, 117 aa, Artificial Sequence; identical to SEQ ID NO: 41735
  Description of Artificial Sequence: Synthetic polypeptide
  VH of XENP29033

SEQ ID NO: 43406 - protein, 5 aa, Artificial Sequence
  Description of Artificial Sequence: Synthetic peptide
  XENP29033 vhCDR1
QYGMN

SEQ ID NO: 43407 - protein, 17 aa, Artificial Sequence
  Description of Artificial Sequence: Synthetic peptide
  XENP29033 vhCDR2
WINTYTGEPTYADGFTG

SEQ ID NO: 43408 - protein, 8 aa, Artificial Sequence
  Description of Artificial Sequence: Synthetic peptide
  XENP29033 vhCDR3
DYYGSSPY

SEQ ID NO: 43409 - protein, 219 aa, Artificial Sequence; identical to SEQ ID NO: 33008
  Description of Artificial Sequence: Synthetic polypeptide
  XENP29033 1C11_H3.263_L3_IgG1_PVA_/S267K Light Chain

SEQ ID NO: 43410 - protein, 112 aa, Artificial Sequence; identical to SEQ ID NO: 33009
  Description of Artificial Sequence: Synthetic polypeptide
  VL of XENP29033

SEQ ID NO: 43411 - protein, 16 aa, Artificial Sequence
  Description of Artificial Sequence: Synthetic peptide
  XENP29033 vlCDR1
KSSQSIVHSNGNTYLE

SEQ ID NO: 43412 - protein, 7 aa, Artificial Sequence
  Description of Artificial Sequence: Synthetic peptide
  XENP29033 vlCDR2
KVSNRFS

SEQ ID NO: 43413 - protein, 9 aa, Artificial Sequence
  Description of Artificial Sequence: Synthetic peptide
  XENP29033 vlCDR3
FQGSHVPNT

SEQ ID NO: 43414 - protein, 446 aa, Artificial Sequence; identical to SEQ ID NO: 41739
  Description of Artificial Sequence: Synthetic polypeptide
  XENP29034 1C11_H3.264_L3_IgG1_PVA_/S267K Heavy Chain

SEQ ID NO: 43415 - protein, 117 aa, Artificial Sequence; identical to SEQ ID NO: 41740
  Description of Artificial Sequence: Synthetic polypeptide
  VH of XENP29034

SEQ ID NO: 43416 - protein, 5 aa, Artificial Sequence
  Description of Artificial Sequence: Synthetic peptide
  XENP29034 vhCDR1
DYGMN

SEQ ID NO: 43417 - protein, 17 aa, Artificial Sequence
  Description of Artificial Sequence: Synthetic peptide
  XENP29034 vhCDR2
WINTYTGEPTYADGFTG

SEQ ID NO: 43418 - protein, 8 aa, Artificial Sequence
  Description of Artificial Sequence: Synthetic peptide
  XENP29034 vhCDR3
DYYGSSPY

SEQ ID NO: 43419 - protein, 219 aa, Artificial Sequence; identical to SEQ ID NO: 33008
  Description of Artificial Sequence: Synthetic polypeptide
  XENP29034 1C11_H3.264_L3_IgG1_PVA_/S267K Light Chain

SEQ ID NO: 43420 - protein, 112 aa, Artificial Sequence; identical to SEQ ID NO: 33009
  Description of Artificial Sequence: Synthetic polypeptide
  VL of XENP29034

SEQ ID NO: 43421 - protein, 16 aa, Artificial Sequence
  Description of Artificial Sequence: Synthetic peptide
  XENP29034 vlCDR1
KSSQSIVHSNGNTYLE

SEQ ID NO: 43422 - protein, 7 aa, Artificial Sequence
  Description of Artificial Sequence: Synthetic peptide
  XENP29034 vlCDR2
KVSNRFS

SEQ ID NO: 43423 - protein, 9 aa, Artificial Sequence
  Description of Artificial Sequence: Synthetic peptide
  XENP29034 vlCDR3
FQGSHVPNT

SEQ ID NO: 43424 - protein, 446 aa, Artificial Sequence; identical to SEQ ID NO: 41744
  Description of Artificial Sequence: Synthetic polypeptide
  XENP29035 1C11_H3.265_L3_IgG1_PVA_/S267K Heavy Chain

SEQ ID NO: 43425 - protein, 117 aa, Artificial Sequence; identical to SEQ ID NO: 41745
  Description of Artificial Sequence: Synthetic polypeptide
  VH of XENP29035

SEQ ID NO: 43426 - protein, 5 aa, Artificial Sequence
  Description of Artificial Sequence: Synthetic peptide
  XENP29035 vhCDR1
RYGMN

SEQ ID NO: 43427 - protein, 17 aa, Artificial Sequence
  Description of Artificial Sequence: Synthetic peptide
  XENP29035 vhCDR2
WINTYTGEPTYADGFTG

SEQ ID NO: 43428 - protein, 8 aa, Artificial Sequence
  Description of Artificial Sequence: Synthetic peptide
  XENP29035 vhCDR3
DYYGSSPY

SEQ ID NO: 43429 - protein, 219 aa, Artificial Sequence; identical to SEQ ID NO: 33008
  Description of Artificial Sequence: Synthetic polypeptide
  XENP29035 1C11_H3.265_L3_IgG1_PVA_/S267K Light Chain

SEQ ID NO: 43430 - protein, 112 aa, Artificial Sequence; identical to SEQ ID NO: 33009
  Description of Artificial Sequence: Synthetic polypeptide
  VL of XENP29035

SEQ ID NO: 43431 - protein, 16 aa, Artificial Sequence
  Description of Artificial Sequence: Synthetic peptide
  XENP29035 vlCDR1
KSSQSIVHSNGNTYLE

SEQ ID NO: 43432 - protein, 7 aa, Artificial Sequence
  Description of Artificial Sequence: Synthetic peptide
  XENP29035 vlCDR2
KVSNRFS

SEQ ID NO: 43433 - protein, 9 aa, Artificial Sequence
  Description of Artificial Sequence: Synthetic peptide
  XENP29035 vlCDR3
FQGSHVPNT

SEQ ID NO: 43434 - protein, 446 aa, Artificial Sequence; identical to SEQ ID NO: 41764
  Description of Artificial Sequence: Synthetic polypeptide
  XENP29036 1C11_H3.269_L3_IgG1_PVA_/S267K Heavy Chain

SEQ ID NO: 43435 - protein, 117 aa, Artificial Sequence; identical to SEQ ID NO: 41765
  Description of Artificial Sequence: Synthetic polypeptide
  VH of XENP29036

SEQ ID NO: 43436 - protein, 5 aa, Artificial Sequence
  Description of Artificial Sequence: Synthetic peptide
  XENP29036 vhCDR1
HLGMN

SEQ ID NO: 43437 - protein, 17 aa, Artificial Sequence
  Description of Artificial Sequence: Synthetic peptide
  XENP29036 vhCDR2
WINTYTGEPTYADGFTG

SEQ ID NO: 43438 - protein, 8 aa, Artificial Sequence
  Description of Artificial Sequence: Synthetic peptide
  XENP29036 vhCDR3
DYYGSSPY

SEQ ID NO: 43439 - protein, 219 aa, Artificial Sequence; identical to SEQ ID NO: 33008
  Description of Artificial Sequence: Synthetic polypeptide
  XENP29036 1C11_H3.269_L3_IgG1_PVA_/S267K Light Chain

SEQ ID NO: 43440 - protein, 112 aa, Artificial Sequence; identical to SEQ ID NO: 33009
  Description of Artificial Sequence: Synthetic polypeptide
  VL of XENP29036

SEQ ID NO: 43441 - protein, 16 aa, Artificial Sequence
  Description of Artificial Sequence: Synthetic peptide
  XENP29036 vlCDR1
KSSQSIVHSNGNTYLE

SEQ ID NO: 43442 - protein, 7 aa, Artificial Sequence
  Description of Artificial Sequence: Synthetic peptide
  XENP29036 vlCDR2
KVSNRFS

SEQ ID NO: 43443 - protein, 9 aa, Artificial Sequence
  Description of Artificial Sequence: Synthetic peptide
  XENP29036 vlCDR3
FQGSHVPNT

SEQ ID NO: 43444 - protein, 446 aa, Artificial Sequence; identical to SEQ ID NO: 41799
  Description of Artificial Sequence: Synthetic polypeptide
  XENP29037 1C11_H3.276_L3_IgG1_PVA_/S267K Heavy Chain

SEQ ID NO: 43445 - protein, 117 aa, Artificial Sequence; identical to SEQ ID NO: 41800
  Description of Artificial Sequence: Synthetic polypeptide
  VH of XENP29037

SEQ ID NO: 43446 - protein, 5 aa, Artificial Sequence
  Description of Artificial Sequence: Synthetic peptide
  XENP29037 vhCDR1
HYGMN

SEQ ID NO: 43447 - protein, 17 aa, Artificial Sequence
  Description of Artificial Sequence: Synthetic peptide
  XENP29037 vhCDR2
WINTYTGEPTYADGFTG

SEQ ID NO: 43448 - protein, 8 aa, Artificial Sequence
  Description of Artificial Sequence: Synthetic peptide
  XENP29037 vhCDR3
DYYGSSPY

SEQ ID NO: 43449 - protein, 219 aa, Artificial Sequence; identical to SEQ ID NO: 33008
  Description of Artificial Sequence: Synthetic polypeptide
  XENP29037 1C11_H3.276_L3_IgG1_PVA_/S267K Light Chain

SEQ ID NO: 43450 - protein, 112 aa, Artificial Sequence; identical to SEQ ID NO: 33009
  Description of Artificial Sequence: Synthetic polypeptide
  VL of XENP29037

SEQ ID NO: 43451 - protein, 16 aa, Artificial Sequence
  Description of Artificial Sequence: Synthetic peptide
  XENP29037 vlCDR1
KSSQSIVHSNGNTYLE

SEQ ID NO: 43452 - protein, 7 aa, Artificial Sequence
  Description of Artificial Sequence: Synthetic peptide
  XENP29037 vlCDR2
KVSNRFS

SEQ ID NO: 43453 - protein, 9 aa, Artificial Sequence
  Description of Artificial Sequence: Synthetic peptide
  XENP29037 vlCDR3
FQGSHVPNT

SEQ ID NO: 43454 - protein, 446 aa, Artificial Sequence; identical to SEQ ID NO: 41834
  Description of Artificial Sequence: Synthetic polypeptide
  XENP29038 1C11_H3.283_L3_IgG1_PVA_/S267K Heavy Chain

SEQ ID NO: 43455 - protein, 117 aa, Artificial Sequence; identical to SEQ ID NO: 41835
  Description of Artificial Sequence: Synthetic polypeptide
  VH of XENP29038

SEQ ID NO: 43456 - protein, 5 aa, Artificial Sequence
  Description of Artificial Sequence: Synthetic peptide
  XENP29038 vhCDR1
HYGMN

SEQ ID NO: 43457 - protein, 17 aa, Artificial Sequence
  Description of Artificial Sequence: Synthetic peptide
  XENP29038 vhCDR2
WIQTYTGEPTYADGFTG

SEQ ID NO: 43458 - protein, 8 aa, Artificial Sequence
  Description of Artificial Sequence: Synthetic peptide
  XENP29038 vhCDR3
DYYGSSPY

SEQ ID NO: 43459 - protein, 219 aa, Artificial Sequence; identical to SEQ ID NO: 33008
  Description of Artificial Sequence: Synthetic polypeptide
  XENP29038 1C11_H3.283_L3_IgG1_PVA_/S267K Light Chain

SEQ ID NO: 43460 - protein, 112 aa, Artificial Sequence; identical to SEQ ID NO: 33009
  Description of Artificial Sequence: Synthetic polypeptide
  VL of XENP29038

SEQ ID NO: 43461 - protein, 16 aa, Artificial Sequence
  Description of Artificial Sequence: Synthetic peptide
  XENP29038 vlCDR1
KSSQSIVHSNGNTYLE

SEQ ID NO: 43462 - protein, 7 aa, Artificial Sequence
  Description of Artificial Sequence: Synthetic peptide
  XENP29038 vlCDR2
KVSNRFS

SEQ ID NO: 43463 - protein, 9 aa, Artificial Sequence
  Description of Artificial Sequence: Synthetic peptide
  XENP29038 vlCDR3
FQGSHVPNT

SEQ ID NO: 43464 - protein, 446 aa, Artificial Sequence; identical to SEQ ID NO: 41839
  Description of Artificial Sequence: Synthetic polypeptide
  XENP29039 1C11_H3.284_L3_IgG1_PVA_/S267K Heavy Chain

SEQ ID NO: 43465 - protein, 117 aa, Artificial Sequence; identical to SEQ ID NO: 41840
  Description of Artificial Sequence: Synthetic polypeptide
  VH of XENP29039

SEQ ID NO: 43466 - protein, 5 aa, Artificial Sequence
  Description of Artificial Sequence: Synthetic peptide
  XENP29039 vhCDR1
HYGMN

SEQ ID NO: 43467 - protein, 17 aa, Artificial Sequence
  Description of Artificial Sequence: Synthetic peptide
  XENP29039 vhCDR2
WIETYTGEPTYADGFTG

SEQ ID NO: 43468 - protein, 8 aa, Artificial Sequence
  Description of Artificial Sequence: Synthetic peptide
  XENP29039 vhCDR3
DYYGSSPY

SEQ ID NO: 43469 - protein, 219 aa, Artificial Sequence; identical to SEQ ID NO: 33008
  Description of Artificial Sequence: Synthetic polypeptide
  XENP29039 1C11_H3.284_L3_IgG1_PVA_/S267K Light Chain

SEQ ID NO: 43470 - protein, 112 aa, Artificial Sequence; identical to SEQ ID NO: 33009
  Description of Artificial Sequence: Synthetic polypeptide
  VL of XENP29039

SEQ ID NO: 43471 - protein, 16 aa, Artificial Sequence
  Description of Artificial Sequence: Synthetic peptide
  XENP29039 vlCDR1
KSSQSIVHSNGNTYLE

SEQ ID NO: 43472 - protein, 7 aa, Artificial Sequence
  Description of Artificial Sequence: Synthetic peptide
  XENP29039 vlCDR2
KVSNRFS

SEQ ID NO: 43473 - protein, 9 aa, Artificial Sequence
  Description of Artificial Sequence: Synthetic peptide
  XENP29039 vlCDR3
FQGSHVPNT

SEQ ID NO: 43474 - protein, 446 aa, Artificial Sequence; identical to SEQ ID NO: 41844
  Description of Artificial Sequence: Synthetic polypeptide
  XENP29040 1C11_H3.285_L3_IgG1_PVA_/S267K Heavy Chain

SEQ ID NO: 43475 - protein, 117 aa, Artificial Sequence; identical to SEQ ID NO: 41845
  Description of Artificial Sequence: Synthetic polypeptide
  VH of XENP29040

SEQ ID NO: 43476 - protein, 5 aa, Artificial Sequence
  Description of Artificial Sequence: Synthetic peptide
  XENP29040 vhCDR1
HYGMN

SEQ ID NO: 43477 - protein, 17 aa, Artificial Sequence
  Description of Artificial Sequence: Synthetic peptide
  XENP29040 vhCDR2
WIHTYTGEPTYADGFTG

SEQ ID NO: 43478 - protein, 8 aa, Artificial Sequence
  Description of Artificial Sequence: Synthetic peptide
  XENP29040 vhCDR3
DYYGSSPY

SEQ ID NO: 43479 - protein, 219 aa, Artificial Sequence; identical to SEQ ID NO: 33008
  Description of Artificial Sequence: Synthetic polypeptide
  XENP29040 1C11_H3.285_L3_IgG1_PVA_/S267K Light Chain

SEQ ID NO: 43480 - protein, 112 aa, Artificial Sequence; identical to SEQ ID NO: 33009
  Description of Artificial Sequence: Synthetic polypeptide
  VL of XENP29040

SEQ ID NO: 43481 - protein, 16 aa, Artificial Sequence
  Description of Artificial Sequence: Synthetic peptide
  XENP29040 vlCDR1
KSSQSIVHSNGNTYLE

SEQ ID NO: 43482 - protein, 7 aa, Artificial Sequence
  Description of Artificial Sequence: Synthetic peptide
  XENP29040 vlCDR2
KVSNRFS

SEQ ID NO: 43483 - protein, 9 aa, Artificial Sequence
  Description of Artificial Sequence: Synthetic peptide
  XENP29040 vlCDR3
FQGSHVPNT

SEQ ID NO: 43484 - protein, 446 aa, Artificial Sequence; identical to SEQ ID NO: 41849
  Description of Artificial Sequence: Synthetic polypeptide
  XENP29041 1C11_H3.286_L3_IgG1_PVA_/S267K Heavy Chain

SEQ ID NO: 43485 - protein, 117 aa, Artificial Sequence; identical to SEQ ID NO: 41850
  Description of Artificial Sequence: Synthetic polypeptide
  VH of XENP29041

SEQ ID NO: 43486 - protein, 5 aa, Artificial Sequence
  Description of Artificial Sequence: Synthetic peptide
  XENP29041 vhCDR1
HYGMN

SEQ ID NO: 43487 - protein, 17 aa, Artificial Sequence
  Description of Artificial Sequence: Synthetic peptide
  XENP29041 vhCDR2
WISTYTGEPTYADGFTG

SEQ ID NO: 43488 - protein, 8 aa, Artificial Sequence
  Description of Artificial Sequence: Synthetic peptide
  XENP29041 vhCDR3
DYYGSSPY

SEQ ID NO: 43489 - protein, 219 aa, Artificial Sequence; identical to SEQ ID NO: 33008
  Description of Artificial Sequence: Synthetic polypeptide
  XENP29041 1C11_H3.286_L3_IgG1_PVA_/S267K Light Chain

SEQ ID NO: 43490 - protein, 112 aa, Artificial Sequence; identical to SEQ ID NO: 33009
  Description of Artificial Sequence: Synthetic polypeptide
  VL of XENP29041

SEQ ID NO: 43491 - protein, 16 aa, Artificial Sequence
  Description of Artificial Sequence: Synthetic peptide
  XENP29041 vlCDR1
KSSQSIVHSNGNTYLE

SEQ ID NO: 43492 - protein, 7 aa, Artificial Sequence
  Description of Artificial Sequence: Synthetic peptide
  XENP29041 vlCDR2
KVSNRFS

SEQ ID NO: 43493 - protein, 9 aa, Artificial Sequence
  Description of Artificial Sequence: Synthetic peptide
  XENP29041 vlCDR3
FQGSHVPNT

SEQ ID NO: 43494 - protein, 446 aa, Artificial Sequence; identical to SEQ ID NO: 41864
  Description of Artificial Sequence: Synthetic polypeptide
  XENP29042 1C11_H3.289_L3_IgG1_PVA_/S267K Heavy Chain

SEQ ID NO: 43495 - protein, 117 aa, Artificial Sequence; identical to SEQ ID NO: 41865
  Description of Artificial Sequence: Synthetic polypeptide
  VH of XENP29042

SEQ ID NO: 43496 - protein, 5 aa, Artificial Sequence
  Description of Artificial Sequence: Synthetic peptide
  XENP29042 vhCDR1
HYGMN

SEQ ID NO: 43497 - protein, 17 aa, Artificial Sequence
  Description of Artificial Sequence: Synthetic peptide
  XENP29042 vhCDR2
WINTLTGEPTYADGFTG

SEQ ID NO: 43498 - protein, 8 aa, Artificial Sequence
  Description of Artificial Sequence: Synthetic peptide
  XENP29042 vhCDR3
DYYGSSPY

SEQ ID NO: 43499 - protein, 219 aa, Artificial Sequence; identical to SEQ ID NO: 33008
  Description of Artificial Sequence: Synthetic polypeptide
  XENP29042 1C11_H3.289_L3_IgG1_PVA_/S267K Light Chain

SEQ ID NO: 43500 - protein, 112 aa, Artificial Sequence; identical to SEQ ID NO: 33009
  Description of Artificial Sequence: Synthetic polypeptide
  VL of XENP29042

SEQ ID NO: 43501 - protein, 16 aa, Artificial Sequence
  Description of Artificial Sequence: Synthetic peptide
  XENP29042 vlCDR1
KSSQSIVHSNGNTYLE

SEQ ID NO: 43502 - protein, 7 aa, Artificial Sequence
  Description of Artificial Sequence: Synthetic peptide
  XENP29042 vlCDR2
KVSNRFS

SEQ ID NO: 43503 - protein, 9 aa, Artificial Sequence
  Description of Artificial Sequence: Synthetic peptide
  XENP29042 vlCDR3
FQGSHVPNT

SEQ ID NO: 43504 - protein, 446 aa, Artificial Sequence; identical to SEQ ID NO: 41869
  Description of Artificial Sequence: Synthetic polypeptide
  XENP29043 1C11_H3.290_L3_IgG1_PVA_/S267K Heavy Chain

SEQ ID NO: 43505 - protein, 117 aa, Artificial Sequence; identical to SEQ ID NO: 41870
  Description of Artificial Sequence: Synthetic polypeptide
  VH of XENP29043

SEQ ID NO: 43506 - protein, 5 aa, Artificial Sequence
  Description of Artificial Sequence: Synthetic peptide
  XENP29043 vhCDR1
HYGMN

SEQ ID NO: 43507 - protein, 17 aa, Artificial Sequence
  Description of Artificial Sequence: Synthetic peptide
  XENP29043 vhCDR2
WINTWTGEPTYADGFTG

SEQ ID NO: 43508 - protein, 8 aa, Artificial Sequence
  Description of Artificial Sequence: Synthetic peptide
  XENP29043 vhCDR3
DYYGSSPY

SEQ ID NO: 43509 - protein, 219 aa, Artificial Sequence; identical to SEQ ID NO: 33008
  Description of Artificial Sequence: Synthetic polypeptide
  XENP29043 1C11_H3.290_L3_IgG1_PVA_/S267K Light Chain

SEQ ID NO: 43510 - protein, 112 aa, Artificial Sequence; identical to SEQ ID NO: 33009
  Description of Artificial Sequence: Synthetic polypeptide
  VL of XENP29043

SEQ ID NO: 43511 - protein, 16 aa, Artificial Sequence
  Description of Artificial Sequence: Synthetic peptide
  XENP29043 vlCDR1
KSSQSIVHSNGNTYLE

SEQ ID NO: 43512 - protein, 7 aa, Artificial Sequence
  Description of Artificial Sequence: Synthetic peptide
  XENP29043 vlCDR2
KVSNRFS

SEQ ID NO: 43513 - protein, 9 aa, Artificial Sequence
  Description of Artificial Sequence: Synthetic peptide
  XENP29043 vlCDR3
FQGSHVPNT

SEQ ID NO: 43514 - protein, 446 aa, Artificial Sequence; identical to SEQ ID NO: 41889
  Description of Artificial Sequence: Synthetic polypeptide
  XENP29044 1C11_H3.294_L3_IgG1_PVA_/S267K Heavy Chain

SEQ ID NO: 43515 - protein, 117 aa, Artificial Sequence; identical to SEQ ID NO: 41890
  Description of Artificial Sequence: Synthetic polypeptide
  VH of XENP29044

SEQ ID NO: 43516 - protein, 5 aa, Artificial Sequence
  Description of Artificial Sequence: Synthetic peptide
  XENP29044 vhCDR1
HYGMN

SEQ ID NO: 43517 - protein, 17 aa, Artificial Sequence
  Description of Artificial Sequence: Synthetic peptide
  XENP29044 vhCDR2
WINTYIGEPTYADGFTG

SEQ ID NO: 43518 - protein, 8 aa, Artificial Sequence
  Description of Artificial Sequence: Synthetic peptide
  XENP29044 vhCDR3
DYYGSSPY

SEQ ID NO: 43519 - protein, 219 aa, Artificial Sequence; identical to SEQ ID NO: 33008
  Description of Artificial Sequence: Synthetic polypeptide
  XENP29044 1C11_H3.294_L3_IgG1_PVA_/S267K Light Chain

SEQ ID NO: 43520 - protein, 112 aa, Artificial Sequence; identical to SEQ ID NO: 33009
  Description of Artificial Sequence: Synthetic polypeptide
  VL of XENP29044

SEQ ID NO: 43521 - protein, 16 aa, Artificial Sequence
  Description of Artificial Sequence: Synthetic peptide
  XENP29044 vlCDR1
KSSQSIVHSNGNTYLE

SEQ ID NO: 43522 - protein, 7 aa, Artificial Sequence
  Description of Artificial Sequence: Synthetic peptide
  XENP29044 vlCDR2
KVSNRFS

SEQ ID NO: 43523 - protein, 9 aa, Artificial Sequence
  Description of Artificial Sequence: Synthetic peptide
  XENP29044 vlCDR3
FQGSHVPNT

SEQ ID NO: 43524 - protein, 446 aa, Artificial Sequence; identical to SEQ ID NO: 41899
  Description of Artificial Sequence: Synthetic polypeptide
  XENP29045 1C11_H3.296_L3_IgG1_PVA_/S267K Heavy Chain

SEQ ID NO: 43525 - protein, 117 aa, Artificial Sequence; identical to SEQ ID NO: 41900
  Description of Artificial Sequence: Synthetic polypeptide
  VH of XENP29045

SEQ ID NO: 43526 - protein, 5 aa, Artificial Sequence
  Description of Artificial Sequence: Synthetic peptide
  XENP29045 vhCDR1
HYGMN

SEQ ID NO: 43527 - protein, 17 aa, Artificial Sequence
  Description of Artificial Sequence: Synthetic peptide
  XENP29045 vhCDR2
WINTYTGKPTYADGFTG

SEQ ID NO: 43528 - protein, 8 aa, Artificial Sequence
  Description of Artificial Sequence: Synthetic peptide
  XENP29045 vhCDR3
DYYGSSPY

SEQ ID NO: 43529 - protein, 219 aa, Artificial Sequence; identical to SEQ ID NO: 33008
  Description of Artificial Sequence: Synthetic polypeptide
  XENP29045 1C11_H3.296_L3_IgG1_PVA_/S267K Light Chain

SEQ ID NO: 43530 - protein, 112 aa, Artificial Sequence; identical to SEQ ID NO: 33009
  Description of Artificial Sequence: Synthetic polypeptide
  VL of XENP29045

SEQ ID NO: 43531 - protein, 16 aa, Artificial Sequence
  Description of Artificial Sequence: Synthetic peptide
  XENP29045 vlCDR1
KSSQSIVHSNGNTYLE

SEQ ID NO: 43532 - protein, 7 aa, Artificial Sequence
  Description of Artificial Sequence: Synthetic peptide
  XENP29045 vlCDR2
KVSNRFS

SEQ ID NO: 43533 - protein, 9 aa, Artificial Sequence
  Description of Artificial Sequence: Synthetic peptide
  XENP29045 vlCDR3
FQGSHVPNT

SEQ ID NO: 43534 - protein, 446 aa, Artificial Sequence; identical to SEQ ID NO: 39254
  Description of Artificial Sequence: Synthetic polypeptide
  XENP29046 1C11_H3_L3.155_IgG1_PVA_/S267K Heavy Chain

SEQ ID NO: 43535 - protein, 117 aa, Artificial Sequence; identical to SEQ ID NO: 33034
  Description of Artificial Sequence: Synthetic polypeptide
  VH of XENP29046

SEQ ID NO: 43536 - protein, 5 aa, Artificial Sequence
  Description of Artificial Sequence: Synthetic peptide
  XENP29046 vhCDR1
HYGMN

SEQ ID NO: 43537 - protein, 17 aa, Artificial Sequence
  Description of Artificial Sequence: Synthetic peptide
  XENP29046 vhCDR2
WINTYTGEPTYADGFTG

SEQ ID NO: 43538 - protein, 8 aa, Artificial Sequence
  Description of Artificial Sequence: Synthetic peptide
  XENP29046 vhCDR3
DYYGSSPY

SEQ ID NO: 43539 - protein, 219 aa, Artificial Sequence; identical to SEQ ID NO: 41999
  Description of Artificial Sequence: Synthetic polypeptide
  XENP29046 1C11_H3_L3.155_IgG1_PVA_/S267K Light Chain

SEQ ID NO: 43540 - protein, 112 aa, Artificial Sequence; identical to SEQ ID NO: 42000
  Description of Artificial Sequence: Synthetic polypeptide
  VL of XENP29046

SEQ ID NO: 43541 - protein, 16 aa, Artificial Sequence
  Description of Artificial Sequence: Synthetic peptide
  XENP29046 vlCDR1
KSSQSIVHTNGNTYLE

SEQ ID NO: 43542 - protein, 7 aa, Artificial Sequence
  Description of Artificial Sequence: Synthetic peptide
  XENP29046 vlCDR2
KVSNRFS

SEQ ID NO: 43543 - protein, 9 aa, Artificial Sequence
  Description of Artificial Sequence: Synthetic peptide
  XENP29046 vlCDR3
FQGSHVPNT

SEQ ID NO: 43544 - protein, 446 aa, Artificial Sequence; identical to SEQ ID NO: 39254
  Description of Artificial Sequence: Synthetic polypeptide
  XENP29047 1C11_H3_L3.157_IgG1_PVA_/S267K Heavy Chain

SEQ ID NO: 43545 - protein, 117 aa, Artificial Sequence; identical to SEQ ID NO: 33034
  Description of Artificial Sequence: Synthetic polypeptide
  VH of XENP29047

SEQ ID NO: 43546 - protein, 5 aa, Artificial Sequence
  Description of Artificial Sequence: Synthetic peptide
  XENP29047 vhCDR1
HYGMN

SEQ ID NO: 43547 - protein, 17 aa, Artificial Sequence
  Description of Artificial Sequence: Synthetic peptide
  XENP29047 vhCDR2
WINTYTGEPTYADGFTG

SEQ ID NO: 43548 - protein, 8 aa, Artificial Sequence
  Description of Artificial Sequence: Synthetic peptide
  XENP29047 vhCDR3
DYYGSSPY

SEQ ID NO: 43549 - protein, 219 aa, Artificial Sequence; identical to SEQ ID NO: 42009
  Description of Artificial Sequence: Synthetic polypeptide
  XENP29047 1C11_H3_L3.157_IgG1_PVA_/S267K Light Chain

SEQ ID NO: 43550 - protein, 112 aa, Artificial Sequence; identical to SEQ ID NO: 42010
  Description of Artificial Sequence: Synthetic polypeptide
  VL of XENP29047

SEQ ID NO: 43551 - protein, 16 aa, Artificial Sequence
  Description of Artificial Sequence: Synthetic peptide
  XENP29047 vlCDR1
KSSQSIVHQNGNTYLE

SEQ ID NO: 43552 - protein, 7 aa, Artificial Sequence
  Description of Artificial Sequence: Synthetic peptide
  XENP29047 vlCDR2
KVSNRFS

SEQ ID NO: 43553 - protein, 9 aa, Artificial Sequence
  Description of Artificial Sequence: Synthetic peptide
  XENP29047 vlCDR3
FQGSHVPNT

SEQ ID NO: 43554 - protein, 446 aa, Artificial Sequence; identical to SEQ ID NO: 39254
  Description of Artificial Sequence: Synthetic polypeptide
  XENP29048 1C11_H3_L3.163_IgG1_PVA_/S267K Heavy Chain

SEQ ID NO: 43555 - protein, 117 aa, Artificial Sequence; identical to SEQ ID NO: 33034
  Description of Artificial Sequence: Synthetic polypeptide
  VH of XENP29048

SEQ ID NO: 43556 - protein, 5 aa, Artificial Sequence
  Description of Artificial Sequence: Synthetic peptide
  XENP29048 vhCDR1
HYGMN

SEQ ID NO: 43557 - protein, 17 aa, Artificial Sequence
  Description of Artificial Sequence: Synthetic peptide
  XENP29048 vhCDR2
WINTYTGEPTYADGFTG

SEQ ID NO: 43558 - protein, 8 aa, Artificial Sequence
  Description of Artificial Sequence: Synthetic peptide
  XENP29048 vhCDR3
DYYGSSPY

SEQ ID NO: 43559 - protein, 219 aa, Artificial Sequence; identical to SEQ ID NO: 42039
  Description of Artificial Sequence: Synthetic polypeptide
  XENP29048 1C11_H3_L3.163_IgG1_PVA_/S267K Light Chain

SEQ ID NO: 43560 - protein, 112 aa, Artificial Sequence; identical to SEQ ID NO: 42040
  Description of Artificial Sequence: Synthetic polypeptide
  VL of XENP29048

SEQ ID NO: 43561 - protein, 16 aa, Artificial Sequence
  Description of Artificial Sequence: Synthetic peptide
  XENP29048 vlCDR1
KSSQSIVHSRGNTYLE

SEQ ID NO: 43562 - protein, 7 aa, Artificial Sequence
  Description of Artificial Sequence: Synthetic peptide
  XENP29048 vlCDR2
KVSNRFS

SEQ ID NO: 43563 - protein, 9 aa, Artificial Sequence
  Description of Artificial Sequence: Synthetic peptide
  XENP29048 vlCDR3
FQGSHVPNT

SEQ ID NO: 43564 - protein, 446 aa, Artificial Sequence; identical to SEQ ID NO: 39254
  Description of Artificial Sequence: Synthetic polypeptide
  XENP29049 1C11_H3_L3.173_IgG1_PVA_/S267K Heavy Chain

SEQ ID NO: 43565 - protein, 117 aa, Artificial Sequence; identical to SEQ ID NO: 33034
  Description of Artificial Sequence: Synthetic polypeptide
  VH of XENP29049

SEQ ID NO: 43566 - protein, 5 aa, Artificial Sequence
  Description of Artificial Sequence: Synthetic peptide
  XENP29049 vhCDR1
HYGMN

SEQ ID NO: 43567 - protein, 17 aa, Artificial Sequence
  Description of Artificial Sequence: Synthetic peptide
  XENP29049 vhCDR2
WINTYTGEPTYADGFTG

SEQ ID NO: 43568 - protein, 8 aa, Artificial Sequence
  Description of Artificial Sequence: Synthetic peptide
  XENP29049 vhCDR3
DYYGSSPY

SEQ ID NO: 43569 - protein, 219 aa, Artificial Sequence; identical to SEQ ID NO: 42089
  Description of Artificial Sequence: Synthetic polypeptide
  XENP29049 1C11_H3_L3.173_IgG1_PVA_/S267K Light Chain

SEQ ID NO: 43570 - protein, 112 aa, Artificial Sequence; identical to SEQ ID NO: 42090
  Description of Artificial Sequence: Synthetic polypeptide
  VL of XENP29049

SEQ ID NO: 43571 - protein, 16 aa, Artificial Sequence
  Description of Artificial Sequence: Synthetic peptide
  XENP29049 vlCDR1
KSSQSIVHSNGNTFLE

SEQ ID NO: 43572 - protein, 7 aa, Artificial Sequence
  Description of Artificial Sequence: Synthetic peptide
  XENP29049 vlCDR2
KVSNRFS

SEQ ID NO: 43573 - protein, 9 aa, Artificial Sequence
  Description of Artificial Sequence: Synthetic peptide
  XENP29049 vlCDR3
FQGSHVPNT

SEQ ID NO: 43574 - protein, 446 aa, Artificial Sequence; identical to SEQ ID NO: 39254
  Description of Artificial Sequence: Synthetic polypeptide
  XENP29050 1C11_H3_L3.181_IgG1_PVA_/S267K Heavy Chain

SEQ ID NO: 43575 - protein, 117 aa, Artificial Sequence; identical to SEQ ID NO: 33034
  Description of Artificial Sequence: Synthetic polypeptide
  VH of XENP29050

SEQ ID NO: 43576 - protein, 5 aa, Artificial Sequence
  Description of Artificial Sequence: Synthetic peptide
  XENP29050 vhCDR1
HYGMN

SEQ ID NO: 43577 - protein, 17 aa, Artificial Sequence
  Description of Artificial Sequence: Synthetic peptide
  XENP29050 vhCDR2
WINTYTGEPTYADGFTG

SEQ ID NO: 43578 - protein, 8 aa, Artificial Sequence
  Description of Artificial Sequence: Synthetic peptide
  XENP29050 vhCDR3
DYYGSSPY

SEQ ID NO: 43579 - protein, 219 aa, Artificial Sequence; identical to SEQ ID NO: 42129
  Description of Artificial Sequence: Synthetic polypeptide
  XENP29050 1C11_H3_L3.181_IgG1_PVA_/S267K Light Chain

SEQ ID NO: 43580 - protein, 112 aa, Artificial Sequence; identical to SEQ ID NO: 42130
  Description of Artificial Sequence: Synthetic polypeptide
  VL of XENP29050

SEQ ID NO: 43581 - protein, 16 aa, Artificial Sequence
  Description of Artificial Sequence: Synthetic peptide
  XENP29050 vlCDR1
KSSQSIVHSNGNTYLE

SEQ ID NO: 43582 - protein, 7 aa, Artificial Sequence
  Description of Artificial Sequence: Synthetic peptide
  XENP29050 vlCDR2
KVSNRFS

SEQ ID NO: 43583 - protein, 9 aa, Artificial Sequence
  Description of Artificial Sequence: Synthetic peptide
  XENP29050 vlCDR3
FQGSHVPNT

SEQ ID NO: 43584 - protein, 446 aa, Artificial Sequence; identical to SEQ ID NO: 39254
  Description of Artificial Sequence: Synthetic polypeptide
  XENP29051 1C11_H3_L3.182_IgG1_PVA_/S267K Heavy Chain

SEQ ID NO: 43585 - protein, 117 aa, Artificial Sequence; identical to SEQ ID NO: 33034
  Description of Artificial Sequence: Synthetic polypeptide
  VH of XENP29051

SEQ ID NO: 43586 - protein, 5 aa, Artificial Sequence
  Description of Artificial Sequence: Synthetic peptide
  XENP29051 vhCDR1
HYGMN

SEQ ID NO: 43587 - protein, 17 aa, Artificial Sequence
  Description of Artificial Sequence: Synthetic peptide
  XENP29051 vhCDR2
WINTYTGEPTYADGFTG

SEQ ID NO: 43588 - protein, 8 aa, Artificial Sequence
  Description of Artificial Sequence: Synthetic peptide
  XENP29051 vhCDR3
DYYGSSPY

SEQ ID NO: 43589 - protein, 219 aa, Artificial Sequence; identical to SEQ ID NO: 42134
  Description of Artificial Sequence: Synthetic polypeptide
  XENP29051 1C11_H3_L3.182_IgG1_PVA_/S267K Light Chain

SEQ ID NO: 43590 - protein, 112 aa, Artificial Sequence; identical to SEQ ID NO: 42135
  Description of Artificial Sequence: Synthetic polypeptide
  VL of XENP29051

SEQ ID NO: 43591 - protein, 16 aa, Artificial Sequence
  Description of Artificial Sequence: Synthetic peptide
  XENP29051 vlCDR1
KSSQSIVHSNGNTYLE

SEQ ID NO: 43592 - protein, 7 aa, Artificial Sequence
  Description of Artificial Sequence: Synthetic peptide
  XENP29051 vlCDR2
KVSNRFS

SEQ ID NO: 43593 - protein, 9 aa, Artificial Sequence
  Description of Artificial Sequence: Synthetic peptide
  XENP29051 vlCDR3
FQGSHVPNT

SEQ ID NO: 43594 - protein, 446 aa, Artificial Sequence; identical to SEQ ID NO: 39254
  Description of Artificial Sequence: Synthetic polypeptide
  XENP29052 1C11_H3_L3.189_IgG1_PVA_/S267K Heavy Chain

SEQ ID NO: 43595 - protein, 117 aa, Artificial Sequence; identical to SEQ ID NO: 33034
  Description of Artificial Sequence: Synthetic polypeptide
  VH of XENP29052

SEQ ID NO: 43596 - protein, 5 aa, Artificial Sequence
  Description of Artificial Sequence: Synthetic peptide
  XENP29052 vhCDR1
HYGMN

SEQ ID NO: 43597 - protein, 17 aa, Artificial Sequence
  Description of Artificial Sequence: Synthetic peptide
  XENP29052 vhCDR2
WINTYTGEPTYADGFTG

SEQ ID NO: 43598 - protein, 8 aa, Artificial Sequence
  Description of Artificial Sequence: Synthetic peptide
  XENP29052 vhCDR3
DYYGSSPY

SEQ ID NO: 43599 - protein, 219 aa, Artificial Sequence; identical to SEQ ID NO: 42169
  Description of Artificial Sequence: Synthetic polypeptide
  XENP29052 1C11_H3_L3.189_IgG1_PVA_/S267K Light Chain

SEQ ID NO: 43600 - protein, 112 aa, Artificial Sequence; identical to SEQ ID NO: 42170
  Description of Artificial Sequence: Synthetic polypeptide
  VL of XENP29052

SEQ ID NO: 43601 - protein, 16 aa, Artificial Sequence
  Description of Artificial Sequence: Synthetic peptide
  XENP29052 vlCDR1
KSSQSIVHSNGNTYLE

SEQ ID NO: 43602 - protein, 7 aa, Artificial Sequence
  Description of Artificial Sequence: Synthetic peptide
  XENP29052 vlCDR2
KVSRRFS

SEQ ID NO: 43603 - protein, 9 aa, Artificial Sequence
  Description of Artificial Sequence: Synthetic peptide
  XENP29052 vlCDR3
FQGSHVPNT

SEQ ID NO: 43604 - protein, 446 aa, Artificial Sequence; identical to SEQ ID NO: 39254
  Description of Artificial Sequence: Synthetic polypeptide
  XENP29053 1C11_H3_L3.192_IgG1_PVA_/S267K Heavy Chain

SEQ ID NO: 43605 - protein, 117 aa, Artificial Sequence; identical to SEQ ID NO: 33034
  Description of Artificial Sequence: Synthetic polypeptide
  VH of XENP29053

SEQ ID NO: 43606 - protein, 5 aa, Artificial Sequence
  Description of Artificial Sequence: Synthetic peptide
  XENP29053 vhCDR1
HYGMN

SEQ ID NO: 43607 - protein, 17 aa, Artificial Sequence
  Description of Artificial Sequence: Synthetic peptide
  XENP29053 vhCDR2
WINTYTGEPTYADGFTG

SEQ ID NO: 43608 - protein, 8 aa, Artificial Sequence
  Description of Artificial Sequence: Synthetic peptide
  XENP29053 vhCDR3
DYYGSSPY

SEQ ID NO: 43609 - protein, 219 aa, Artificial Sequence; identical to SEQ ID NO: 42184
  Description of Artificial Sequence: Synthetic polypeptide
  XENP29053 1C11_H3_L3.192_IgG1_PVA_/S267K Light Chain

SEQ ID NO: 43610 - protein, 112 aa, Artificial Sequence; identical to SEQ ID NO: 42185
  Description of Artificial Sequence: Synthetic polypeptide
  VL of XENP29053

SEQ ID NO: 43611 - protein, 16 aa, Artificial Sequence
  Description of Artificial Sequence: Synthetic peptide
  XENP29053 vlCDR1
KSSQSIVHSNGNTYLE

SEQ ID NO: 43612 - protein, 7 aa, Artificial Sequence
  Description of Artificial Sequence: Synthetic peptide
  XENP29053 vlCDR2
KVSNRFS

SEQ ID NO: 43613 - protein, 9 aa, Artificial Sequence
  Description of Artificial Sequence: Synthetic peptide
  XENP29053 vlCDR3
FQASHVPNT

SEQ ID NO: 43614 - protein, 446 aa, Artificial Sequence; identical to SEQ ID NO: 39254
  Description of Artificial Sequence: Synthetic polypeptide
  XENP29054 1C11_H3_L3.193_IgG1_PVA_/S267K Heavy Chain

SEQ ID NO: 43615 - protein, 117 aa, Artificial Sequence; identical to SEQ ID NO: 33034
  Description of Artificial Sequence: Synthetic polypeptide
  VH of XENP29054

SEQ ID NO: 43616 - protein, 5 aa, Artificial Sequence
  Description of Artificial Sequence: Synthetic peptide
  XENP29054 vhCDR1
HYGMN

SEQ ID NO: 43617 - protein, 17 aa, Artificial Sequence
  Description of Artificial Sequence: Synthetic peptide
  XENP29054 vhCDR2
WINTYTGEPTYADGFTG

SEQ ID NO: 43618 - protein, 8 aa, Artificial Sequence
  Description of Artificial Sequence: Synthetic peptide
  XENP29054 vhCDR3
DYYGSSPY

SEQ ID NO: 43619 - protein, 219 aa, Artificial Sequence; identical to SEQ ID NO: 42189
  Description of Artificial Sequence: Synthetic polypeptide
  XENP29054 1C11_H3_L3.193_IgG1_PVA_/S267K Light Chain

SEQ ID NO: 43620 - protein, 112 aa, Artificial Sequence; identical to SEQ ID NO: 42190
  Description of Artificial Sequence: Synthetic polypeptide
  VL of XENP29054

SEQ ID NO: 43621 - protein, 16 aa, Artificial Sequence
  Description of Artificial Sequence: Synthetic peptide
  XENP29054 vlCDR1
KSSQSIVHSNGNTYLE

SEQ ID NO: 43622 - protein, 7 aa, Artificial Sequence
  Description of Artificial Sequence: Synthetic peptide
  XENP29054 vlCDR2
KVSNRFS

SEQ ID NO: 43623 - protein, 9 aa, Artificial Sequence
  Description of Artificial Sequence: Synthetic peptide
  XENP29054 vlCDR3
FQSSHVPNT

SEQ ID NO: 43624 - protein, 446 aa, Artificial Sequence; identical to SEQ ID NO: 39254
  Description of Artificial Sequence: Synthetic polypeptide
  XENP29055 1C11_H3_L3.196_IgG1_PVA_/S267K Heavy Chain

SEQ ID NO: 43625 - protein, 117 aa, Artificial Sequence; identical to SEQ ID NO: 33034
  Description of Artificial Sequence: Synthetic polypeptide
  VH of XENP29055

SEQ ID NO: 43626 - protein, 5 aa, Artificial Sequence
  Description of Artificial Sequence: Synthetic peptide
  XENP29055 vhCDR1
HYGMN

SEQ ID NO: 43627 - protein, 17 aa, Artificial Sequence
  Description of Artificial Sequence: Synthetic peptide
  XENP29055 vhCDR2
WINTYTGEPTYADGFTG

SEQ ID NO: 43628 - protein, 8 aa, Artificial Sequence
  Description of Artificial Sequence: Synthetic peptide
  XENP29055 vhCDR3
DYYGSSPY

SEQ ID NO: 43629 - protein, 219 aa, Artificial Sequence; identical to SEQ ID NO: 42204
  Description of Artificial Sequence: Synthetic polypeptide
  XENP29055 1C11_H3_L3.196_IgG1_PVA_/S267K Light Chain

SEQ ID NO: 43630 - protein, 112 aa, Artificial Sequence; identical to SEQ ID NO: 42205
  Description of Artificial Sequence: Synthetic polypeptide
  VL of XENP29055

SEQ ID NO: 43631 - protein, 16 aa, Artificial Sequence
  Description of Artificial Sequence: Synthetic peptide
  XENP29055 vlCDR1
KSSQSIVHSNGNTYLE

SEQ ID NO: 43632 - protein, 7 aa, Artificial Sequence
  Description of Artificial Sequence: Synthetic peptide
  XENP29055 vlCDR2
KVSNRFS

SEQ ID NO: 43633 - protein, 9 aa, Artificial Sequence
  Description of Artificial Sequence: Synthetic peptide
  XENP29055 vlCDR3
FQQSHVPNT

SEQ ID NO: 43634 - protein, 446 aa, Artificial Sequence; identical to SEQ ID NO: 39254
  Description of Artificial Sequence: Synthetic polypeptide
  XENP29056 1C11_H3_L3.198_IgG1_PVA_/S267K Heavy Chain

SEQ ID NO: 43635 - protein, 117 aa, Artificial Sequence; identical to SEQ ID NO: 33034
  Description of Artificial Sequence: Synthetic polypeptide
  VH of XENP29056

SEQ ID NO: 43636 - protein, 5 aa, Artificial Sequence
  Description of Artificial Sequence: Synthetic peptide
  XENP29056 vhCDR1
HYGMN

SEQ ID NO: 43637 - protein, 17 aa, Artificial Sequence
  Description of Artificial Sequence: Synthetic peptide
  XENP29056 vhCDR2
WINTYTGEPTYADGFTG

SEQ ID NO: 43638 - protein, 8 aa, Artificial Sequence
  Description of Artificial Sequence: Synthetic peptide
  XENP29056 vhCDR3
DYYGSSPY

SEQ ID NO: 43639 - protein, 219 aa, Artificial Sequence; identical to SEQ ID NO: 42214
  Description of Artificial Sequence: Synthetic polypeptide
  XENP29056 1C11_H3_L3.198_IgG1_PVA_/S267K Light Chain

SEQ ID NO: 43640 - protein, 112 aa, Artificial Sequence; identical to SEQ ID NO: 42215
  Description of Artificial Sequence: Synthetic polypeptide
  VL of XENP29056

SEQ ID NO: 43641 - protein, 16 aa, Artificial Sequence
  Description of Artificial Sequence: Synthetic peptide
  XENP29056 vlCDR1
KSSQSIVHSNGNTYLE

SEQ ID NO: 43642 - protein, 7 aa, Artificial Sequence
  Description of Artificial Sequence: Synthetic peptide
  XENP29056 vlCDR2
KVSNRFS

SEQ ID NO: 43643 - protein, 9 aa, Artificial Sequence
  Description of Artificial Sequence: Synthetic peptide
  XENP29056 vlCDR3
FQLSHVPNT

SEQ ID NO: 43644 - protein, 454 aa, Artificial Sequence
  Description of Artificial Sequence: Synthetic polypeptide
  XenCS500 Fab Chain 1 - [ICOS]_H0_ IgG1_pI(-)_Isosteric_A_/PVA_ /S267K/L368D/K370S
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 43645 - protein, 125 aa, Artificial Sequence
  Description of Artificial Sequence: Synthetic polypeptide
  XenCS500 VH ICOS H0L0
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSS

SEQ ID NO: 43646 - protein, 5 aa, Artificial Sequence
  Description of Artificial Sequence: Synthetic peptide
  XenCS500 vhCDR1
GYYMH

SEQ ID NO: 43647 - protein, 17 aa, Artificial Sequence
  Description of Artificial Sequence: Synthetic peptide
  XenCS500 vhCDR2
WINPHSGGTNYAQKFQG

SEQ ID NO: 43648 - protein, 16 aa, Artificial Sequence
  Description of Artificial Sequence: Synthetic peptide
  XenCS500 vhCDR3
TYYYDSSGYYHDAFDI

SEQ ID NO: 43649 - protein, 480 aa, Artificial Sequence
  Description of Artificial Sequence: Synthetic polypeptide
  XenCS500 scFv Chain 2 - 1C11[PD-1]_H3.234_L3.144_scFv(GKPGS)4_ Fc(216)_IgG1_C220S/PVA_/S267K/S364K/E357Q
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43650 - protein, 117 aa, Artificial Sequence; identical to SEQ ID NO: 40669
  Description of Artificial Sequence: Synthetic polypeptide
  VH of XenCS500

SEQ ID NO: 43651 - protein, 112 aa, Artificial Sequence; identical to SEQ ID NO: 40517
  Description of Artificial Sequence: Synthetic polypeptide
  VL of XenCS500

SEQ ID NO: 43652 - protein, 231 aa, Artificial Sequence; identical to SEQ ID NO: 21532
  Description of Artificial Sequence: Synthetic polypeptide
  Fc chain of XenCS500

SEQ ID NO: 43653 - protein, 5 aa, Artificial Sequence
  Description of Artificial Sequence: Synthetic peptide
  XenCS500 vhCDR1
HYGIN

SEQ ID NO: 43654 - protein, 17 aa, Artificial Sequence
  Description of Artificial Sequence: Synthetic peptide
  XenCS500 vhCDR2
WINTYTGEPYYAPGFQE

SEQ ID NO: 43655 - protein, 8 aa, Artificial Sequence
  Description of Artificial Sequence: Synthetic peptide
  XenCS500 vhCDR3
DYYGSSPY

SEQ ID NO: 43656 - protein, 16 aa, Artificial Sequence
  Description of Artificial Sequence: Synthetic peptide
  XenCS500 vlCDR1
KASQSIVHSNGNTYLE

SEQ ID NO: 43657 - protein, 7 aa, Artificial Sequence
  Description of Artificial Sequence: Synthetic peptide
  XenCS500 vlCDR2
KVSNRFS

SEQ ID NO: 43658 - protein, 9 aa, Artificial Sequence
  Description of Artificial Sequence: Synthetic peptide
  XenCS500 vlCDR3
FQGSHVPNT

SEQ ID NO: 43659 - protein, 214 aa, Artificial Sequence
  Description of Artificial Sequence: Synthetic polypeptide
  XenCS500 Light Chain 3 - [ICOS]_L0
DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43660 - protein, 107 aa, Artificial Sequence
  Description of Artificial Sequence: Synthetic polypeptide
  XenCS500 VL ICOS H0L0
DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 43661 - protein, 11 aa, Artificial Sequence
  Description of Artificial Sequence: Synthetic peptide
  XenCS500 vlCDR1
RASQGISRLLA

SEQ ID NO: 43662 - protein, 7 aa, Artificial Sequence
  Description of Artificial Sequence: Synthetic peptide
  XenCS500 vlCDR2
VASSLQS

SEQ ID NO: 43663 - protein, 9 aa, Artificial Sequence
  Description of Artificial Sequence: Synthetic peptide
  XenCS500 vlCDR3
QQANSFPWT

SEQ ID NO: 43664 - protein, 454 aa, Artificial Sequence
  Description of Artificial Sequence: Synthetic polypeptide
  XenCS501 Fab Chain 1 - [ICOS]_H0.66_ IgG1_pI(-)_Isosteric_A_/PVA_ /S267K/L368D/K370S
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 43665 - protein, 125 aa, Artificial Sequence
  Description of Artificial Sequence: Synthetic polypeptide
  XenCS501 VH_ICOS_H0.66_L0
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSS

SEQ ID NO: 43666 - protein, 5 aa, Artificial Sequence
  Description of Artificial Sequence: Synthetic peptide
  XenCS501 vhCDR1
GYYMH

SEQ ID NO: 43667 - protein, 17 aa, Artificial Sequence
  Description of Artificial Sequence: Synthetic peptide
  XenCS501 vhCDR2
WINPHSGETIYAQKFQG

SEQ ID NO: 43668 - protein, 16 aa, Artificial Sequence
  Description of Artificial Sequence: Synthetic peptide
  XenCS501 vhCDR3
TYYYDTSGYYHDAFDV

SEQ ID NO: 43669 - protein, 480 aa, Artificial Sequence; identical to SEQ ID NO: 43649
  Description of Artificial Sequence: Synthetic polypeptide
  XenCS501 scFv Chain 2 - 1C11[PD-1]_H3.234_L3.144_scFv(GKPGS)4_ Fc(216)_IgG1_C220S/PVA_/S267K/S364K/E357Q

SEQ ID NO: 43670 - protein, 117 aa, Artificial Sequence; identical to SEQ ID NO: 40669
  Description of Artificial Sequence: Synthetic polypeptide
  VH of XenCS501

SEQ ID NO: 43671 - protein, 112 aa, Artificial Sequence; identical to SEQ ID NO: 40517
  Description of Artificial Sequence: Synthetic polypeptide
  VL of XenCS501

SEQ ID NO: 43672 - protein, 231 aa, Artificial Sequence; identical to SEQ ID NO: 21532
  Description of Artificial Sequence: Synthetic polypeptide
  Fc chain of XenCS501

SEQ ID NO: 43673 - protein, 5 aa, Artificial Sequence
  Description of Artificial Sequence: Synthetic peptide
  XenCS501 vhCDR1
HYGIN

SEQ ID NO: 43674 - protein, 17 aa, Artificial Sequence
  Description of Artificial Sequence: Synthetic peptide
  XenCS501 vhCDR2
WINTYTGEPYYAPGFQE

SEQ ID NO: 43675 - protein, 8 aa, Artificial Sequence
  Description of Artificial Sequence: Synthetic peptide
  XenCS501 vhCDR3
DYYGSSPY

SEQ ID NO: 43676 - protein, 16 aa, Artificial Sequence
  Description of Artificial Sequence: Synthetic peptide
  XenCS501 vlCDR1
KASQSIVHSNGNTYLE

SEQ ID NO: 43677 - protein, 7 aa, Artificial Sequence
  Description of Artificial Sequence: Synthetic peptide
  XenCS501 vlCDR2
KVSNRFS

SEQ ID NO: 43678 - protein, 9 aa, Artificial Sequence
  Description of Artificial Sequence: Synthetic peptide
  XenCS501 vlCDR3
FQGSHVPNT

SEQ ID NO: 43679 - protein, 214 aa, Artificial Sequence; identical to SEQ ID NO: 43659
  Description of Artificial Sequence: Synthetic polypeptide
  XenCS501 Light Chain 3 - [ICOS]_L0

SEQ ID NO: 43680 - protein, 107 aa, Artificial Sequence; identical to SEQ ID NO: 43660
  Description of Artificial Sequence: Synthetic polypeptide
  XenCS501 VL_ICOS_H0.66_L0

SEQ ID NO: 43681 - protein, 11 aa, Artificial Sequence
  Description of Artificial Sequence: Synthetic peptide
  XenCS501 vlCDR1
RASQGISRLLA

SEQ ID NO: 43682 - protein, 7 aa, Artificial Sequence
  Description of Artificial Sequence: Synthetic peptide
  XenCS501 vlCDR2
VASSLQS

SEQ ID NO: 43683 - protein, 9 aa, Artificial Sequence
  Description of Artificial Sequence: Synthetic peptide
  XenCS501 vlCDR3
QQANSFPWT

SEQ ID NO: 43684 - protein, 447 aa, Artificial Sequence; identical to SEQ ID NO: 23356
  Description of Artificial Sequence: Synthetic polypeptide
  XenCS502 Fab Chain 1 - [CTLA-4]_H3_ IgG1_pI(-)_Isosteric_A_/PVA_ /S267K/L368D/K370S

SEQ ID NO: 43685 - protein, 118 aa, Artificial Sequence; identical to SEQ ID NO: 139
  Description of Artificial Sequence: Synthetic polypeptide
  VH of XenCS502

SEQ ID NO: 43686 - protein, 5 aa, Artificial Sequence
  Description of Artificial Sequence: Synthetic peptide
  XenCS502 vhCDR1
SYTMH

SEQ ID NO: 43687 - protein, 17 aa, Artificial Sequence
  Description of Artificial Sequence: Synthetic peptide
  XenCS502 vhCDR2
FISYDGNNKYYADSVKG

SEQ ID NO: 43688 - protein, 9 aa, Artificial Sequence
  Description of Artificial Sequence: Synthetic peptide
  XenCS502 vhCDR3
TGWLGPFDY

SEQ ID NO: 43689 - protein, 480 aa, Artificial Sequence; identical to SEQ ID NO: 43649
  Description of Artificial Sequence: Synthetic polypeptide
  XenCS502 scFv Chain 2 - 1C11[PD-1]_H3.234_L3.144_scFv(GKPGS)4_ Fc(216)_IgG1_C220S/PVA_/S267K/S364K/E357Q

SEQ ID NO: 43690 - protein, 117 aa, Artificial Sequence; identical to SEQ ID NO: 40669
  Description of Artificial Sequence: Synthetic polypeptide
  VH of XenCS502

SEQ ID NO: 43691 - protein, 112 aa, Artificial Sequence; identical to SEQ ID NO: 40517
  Description of Artificial Sequence: Synthetic polypeptide
  VL of XenCS502

SEQ ID NO: 43692 - protein, 231 aa, Artificial Sequence; identical to SEQ ID NO: 21532
  Description of Artificial Sequence: Synthetic polypeptide
  Fc chain of XenCS502

SEQ ID NO: 43693 - protein, 5 aa, Artificial Sequence
  Description of Artificial Sequence: Synthetic peptide
  XenCS502 vhCDR1
HYGIN

SEQ ID NO: 43694 - protein, 17 aa, Artificial Sequence
  Description of Artificial Sequence: Synthetic peptide
  XenCS502 vhCDR2
WINTYTGEPYYAPGFQE

SEQ ID NO: 43695 - protein, 8 aa, Artificial Sequence
  Description of Artificial Sequence: Synthetic peptide
  XenCS502 vhCDR3
DYYGSSPY

SEQ ID NO: 43696 - protein, 16 aa, Artificial Sequence
  Description of Artificial Sequence: Synthetic peptide
  XenCS502 vlCDR1
KASQSIVHSNGNTYLE

SEQ ID NO: 43697 - protein, 7 aa, Artificial Sequence
  Description of Artificial Sequence: Synthetic peptide
  XenCS502 vlCDR2
KVSNRFS

SEQ ID NO: 43698 - protein, 9 aa, Artificial Sequence
  Description of Artificial Sequence: Synthetic peptide
  XenCS502 vlCDR3
FQGSHVPNT

SEQ ID NO: 43699 - protein, 215 aa, Artificial Sequence; identical to SEQ ID NO: 4504
  Description of Artificial Sequence: Synthetic polypeptide
  XenCS502 Light Chain 3 - [CTLA-4]_L0.22

SEQ ID NO: 43700 - protein, 108 aa, Artificial Sequence; identical to SEQ ID NO: 1607
  Description of Artificial Sequence: Synthetic polypeptide
  VL of XenCS502

SEQ ID NO: 43701 - protein, 12 aa, Artificial Sequence
  Description of Artificial Sequence: Synthetic peptide
  XenCS502 vlCDR1
RASQSVSSSYLA

SEQ ID NO: 43702 - protein, 7 aa, Artificial Sequence
  Description of Artificial Sequence: Synthetic peptide
  XenCS502 vlCDR2
GAFSRAT

SEQ ID NO: 43703 - protein, 9 aa, Artificial Sequence
  Description of Artificial Sequence: Synthetic peptide
  XenCS502 vlCDR3
QQYGSSPWT

SEQ ID NO: 43704 - protein, 450 aa, Artificial Sequence; identical to SEQ ID NO: 22484
  Description of Artificial Sequence: Synthetic polypeptide
  XenCS503 Fab Chain 1 - 7G8_H3.30_ IgG1_pI(-)_Isosteric_A_/PVA_ /S267K/L368D/K370S

SEQ ID NO: 43705 - protein, 121 aa, Artificial Sequence; identical to SEQ ID NO: 22485
  Description of Artificial Sequence: Synthetic polypeptide
  VH of XENCS503

SEQ ID NO: 43706 - protein, 5 aa, Artificial Sequence
  Description of Artificial Sequence: Synthetic peptide
  XENCS503 vhCDR1
DAWMS

SEQ ID NO: 43707 - protein, 19 aa, Artificial Sequence
  Description of Artificial Sequence: Synthetic peptide
  XENCS503 vhCDR2
EISTKANNHATYYAESVKG

SEQ ID NO: 43708 - protein, 10 aa, Artificial Sequence
  Description of Artificial Sequence: Synthetic peptide
  XENCS503 vhCDR3
LATWDWYFDV

SEQ ID NO: 43709 - protein, 480 aa, Artificial Sequence; identical to SEQ ID NO: 43649
  Description of Artificial Sequence: Synthetic polypeptide
  XenCS503 scFv Chain 2 -1C11[PD-1]_H3.234_L3.144_scFv(GKPGS)4_ Fc(216)_IgG1_C220S/PVA_/S267K/S364K/E357Q

SEQ ID NO: 43710 - protein, 117 aa, Artificial Sequence; identical to SEQ ID NO: 40669
  Description of Artificial Sequence: Synthetic polypeptide
  VH of XENCS503

SEQ ID NO: 43711 - protein, 112 aa, Artificial Sequence; identical to SEQ ID NO: 40517
  Description of Artificial Sequence: Synthetic polypeptide
  VL of XENCS503

SEQ ID NO: 43712 - protein, 231 aa, Artificial Sequence; identical to SEQ ID NO: 21532
  Description of Artificial Sequence: Synthetic polypeptide
  Fc chain of XENCS503

SEQ ID NO: 43713 - protein, 5 aa, Artificial Sequence
  Description of Artificial Sequence: Synthetic peptide
  XENCS503 vhCDR1
HYGIN

SEQ ID NO: 43714 - protein, 17 aa, Artificial Sequence
  Description of Artificial Sequence: Synthetic peptide
  XENCS503 vhCDR2
WINTYTGEPYYAPGFQE

SEQ ID NO: 43715 - protein, 8 aa, Artificial Sequence
  Description of Artificial Sequence: Synthetic peptide
  XENCS503 vhCDR3
DYYGSSPY

SEQ ID NO: 43716 - protein, 16 aa, Artificial Sequence
  Description of Artificial Sequence: Synthetic peptide
  XENCS503 vlCDR1
KASQSIVHSNGNTYLE

SEQ ID NO: 43717 - protein, 7 aa, Artificial Sequence
  Description of Artificial Sequence: Synthetic peptide
  XENCS503 vlCDR2
KVSNRFS

SEQ ID NO: 43718 - protein, 9 aa, Artificial Sequence
  Description of Artificial Sequence: Synthetic peptide
  XENCS503 vlCDR3
FQGSHVPNT

SEQ ID NO: 43719 - protein, 218 aa, Artificial Sequence; identical to SEQ ID NO: 22599
  Description of Artificial Sequence: Synthetic polypeptide
  XenCS503 Light Chain 3 - 7G8_L1.34

SEQ ID NO: 43720 - protein, 111 aa, Artificial Sequence; identical to SEQ ID NO: 22600
  Description of Artificial Sequence: Synthetic polypeptide
  VL of XENCS503

SEQ ID NO: 43721 - protein, 15 aa, Artificial Sequence
  Description of Artificial Sequence: Synthetic peptide
  XENCS503 vlCDR1
RASQSVDYDGDSYMN

SEQ ID NO: 43722 - protein, 7 aa, Artificial Sequence
  Description of Artificial Sequence: Synthetic peptide
  XENCS503 vlCDR2
AASELES

SEQ ID NO: 43723 - protein, 9 aa, Artificial Sequence
  Description of Artificial Sequence: Synthetic peptide
  XENCS503 vlCDR3
QQSNEDPFT

SEQ ID NO: 43724 - protein, 447 aa, Artificial Sequence; identical to SEQ ID NO: 22084
  Description of Artificial Sequence: Synthetic polypeptide
  XenCS504 Fab Chain 1 - 2A11_H1.144_ IgG1_pI(-)_Isosteric_A_/PVA_ /S267K/L368D/K370S

SEQ ID NO: 43725 - protein, 118 aa, Artificial Sequence; identical to SEQ ID NO: 22085
  Description of Artificial Sequence: Synthetic polypeptide
  VH of XenCs504

SEQ ID NO: 43726 - protein, 5 aa, Artificial Sequence
  Description of Artificial Sequence: Synthetic peptide
  XenCs504 vhCDR1
DYFMH

SEQ ID NO: 43727 - protein, 17 aa, Artificial Sequence
  Description of Artificial Sequence: Synthetic peptide
  XenCs504 vhCDR2
WIDPELGDTEYAPKFQG

SEQ ID NO: 43728 - protein, 9 aa, Artificial Sequence
  Description of Artificial Sequence: Synthetic peptide
  XenCs504 vhCDR3
RGVYQALDY

SEQ ID NO: 43729 - protein, 480 aa, Artificial Sequence; identical to SEQ ID NO: 43649
  Description of Artificial Sequence: Synthetic polypeptide
  XenCS504 scFv Chain 2 - 1C11[PD-1]_H3.234_L3.144_scFv(GKPGS)4_ Fc(216)_IgG1_C220S/PVA_/S267K/S364K/E357Q

SEQ ID NO: 43730 - protein, 117 aa, Artificial Sequence; identical to SEQ ID NO: 40669
  Description of Artificial Sequence: Synthetic polypeptide
  VH of XenCs504

SEQ ID NO: 43731 - protein, 112 aa, Artificial Sequence; identical to SEQ ID NO: 40517
  Description of Artificial Sequence: Synthetic polypeptide
  VL of XenCs504

SEQ ID NO: 43732 - protein, 231 aa, Artificial Sequence; identical to SEQ ID NO: 21532
  Description of Artificial Sequence: Synthetic polypeptide
  Fc chain of XenCs504

SEQ ID NO: 43733 - protein, 5 aa, Artificial Sequence
  Description of Artificial Sequence: Synthetic peptide
  XenCs504 vhCDR1
HYGIN

SEQ ID NO: 43734 - protein, 17 aa, Artificial Sequence
  Description of Artificial Sequence: Synthetic peptide
  XenCs504 vhCDR2
WINTYTGEPYYAPGFQE

SEQ ID NO: 43735 - protein, 8 aa, Artificial Sequence
  Description of Artificial Sequence: Synthetic peptide
  XenCs504 vhCDR3
DYYGSSPY

SEQ ID NO: 43736 - protein, 16 aa, Artificial Sequence
  Description of Artificial Sequence: Synthetic peptide
  XenCs504 vlCDR1
KASQSIVHSNGNTYLE

SEQ ID NO: 43737 - protein, 7 aa, Artificial Sequence
  Description of Artificial Sequence: Synthetic peptide
  XenCs504 vlCDR2
KVSNRFS

SEQ ID NO: 43738 - protein, 9 aa, Artificial Sequence
  Description of Artificial Sequence: Synthetic peptide
  XenCs504 vlCDR3
FQGSHVPNT

SEQ ID NO: 43739 - protein, 214 aa, Artificial Sequence; identical to SEQ ID NO: 22279
  Description of Artificial Sequence: Synthetic polypeptide
  XenCS504 Light Chain 3 - 2A11_L2.142

SEQ ID NO: 43740 - protein, 107 aa, Artificial Sequence; identical to SEQ ID NO: 22280
  Description of Artificial Sequence: Synthetic polypeptide
  VL of XenCs504

SEQ ID NO: 43741 - protein, 11 aa, Artificial Sequence
  Description of Artificial Sequence: Synthetic peptide
  XenCs504 vlCDR1
QASQDIGNYLN

SEQ ID NO: 43742 - protein, 7 aa, Artificial Sequence
  Description of Artificial Sequence: Synthetic peptide
  XenCs504 vlCDR2
FTSYLHS

SEQ ID NO: 43743 - protein, 9 aa, Artificial Sequence
  Description of Artificial Sequence: Synthetic peptide
  XenCs504 vlCDR3
QQGNTLPYT

SEQ ID NO: 43744 - protein, 446 aa, Artificial Sequence
  Description of Artificial Sequence: Synthetic polypeptide
  XenCS505 Fab Chain 1 - 3H3_H1_ IgG1_pI(-)_Isosteric_A_/PVA_ /S267K/L368D/K370S
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 43745 - protein, 117 aa, Artificial Sequence; identical to SEQ ID NO: 36368
  Description of Artificial Sequence: Synthetic polypeptide
  VH of XenCS505

SEQ ID NO: 43746 - protein, 5 aa, Artificial Sequence
  Description of Artificial Sequence: Synthetic peptide
  XenCS505 vhCDR1
GYGVN

SEQ ID NO: 43747 - protein, 16 aa, Artificial Sequence
  Description of Artificial Sequence: Synthetic peptide
  XenCS505 vhCDR2
MIWGDGSTDYNSALKS

SEQ ID NO: 43748 - protein, 9 aa, Artificial Sequence
  Description of Artificial Sequence: Synthetic peptide
  XenCS505 vhCDR3
SYYTSDEDY

SEQ ID NO: 43749 - protein, 480 aa, Artificial Sequence; identical to SEQ ID NO: 43649
  Description of Artificial Sequence: Synthetic polypeptide
  XenCS505 scFv Chain 2 - 1C11[PD-1]_H3.234_L3.144_scFv(GKPGS)4_ Fc(216)_IgG1_C220S/PVA_/S267K/S364K/E357Q

SEQ ID NO: 43750 - protein, 117 aa, Artificial Sequence; identical to SEQ ID NO: 40669
  Description of Artificial Sequence: Synthetic polypeptide
  VH of XenCS505

SEQ ID NO: 43751 - protein, 112 aa, Artificial Sequence; identical to SEQ ID NO: 40517
  Description of Artificial Sequence: Synthetic polypeptide
  VL of XenCS505

SEQ ID NO: 43752 - protein, 231 aa, Artificial Sequence; identical to SEQ ID NO: 21532
  Description of Artificial Sequence: Synthetic polypeptide
  Fc chain of XenCS505

SEQ ID NO: 43753 - protein, 5 aa, Artificial Sequence
  Description of Artificial Sequence: Synthetic peptide
  XenCS505 vhCDR1
HYGIN

SEQ ID NO: 43754 - protein, 17 aa, Artificial Sequence
  Description of Artificial Sequence: Synthetic peptide
  XenCS505 vhCDR2
WINTYTGEPYYAPGFQE

SEQ ID NO: 43755 - protein, 8 aa, Artificial Sequence
  Description of Artificial Sequence: Synthetic peptide
  XenCS505 vhCDR3
DYYGSSPY

SEQ ID NO: 43756 - protein, 16 aa, Artificial Sequence
  Description of Artificial Sequence: Synthetic peptide
  XenCS505 vlCDR1
KASQSIVHSNGNTYLE

SEQ ID NO: 43757 - protein, 7 aa, Artificial Sequence
  Description of Artificial Sequence: Synthetic peptide
  XenCS505 vlCDR2
KVSNRFS

SEQ ID NO: 43758 - protein, 9 aa, Artificial Sequence
  Description of Artificial Sequence: Synthetic peptide
  XenCS505 vlCDR3
FQGSHVPNT

SEQ ID NO: 43759 - protein, 219 aa, Artificial Sequence; identical to SEQ ID NO: 36512
  Description of Artificial Sequence: Synthetic polypeptide
  XenCS505 Light Chain 3 - 3H3_L2.1

SEQ ID NO: 43760 - protein, 112 aa, Artificial Sequence; identical to SEQ ID NO: 36513
  Description of Artificial Sequence: Synthetic polypeptide
  VL of XenCS505

SEQ ID NO: 43761 - protein, 17 aa, Artificial Sequence
  Description of Artificial Sequence: Synthetic peptide
  XenCS505 vlCDR1
KSSQSLLNSRTRKNYLA

SEQ ID NO: 43762 - protein, 7 aa, Artificial Sequence
  Description of Artificial Sequence: Synthetic peptide
  XenCS505 vlCDR2
WASTRES

SEQ ID NO: 43763 - protein, 8 aa, Artificial Sequence
  Description of Artificial Sequence: Synthetic peptide
  XenCS505 vlCDR3
KQSYSLRT

SEQ ID NO: 43764 - protein, 447 aa, Artificial Sequence; identical to SEQ ID NO: 23236
  Description of Artificial Sequence: Synthetic polypeptide
  XENCS:506 Fab Chain 1 - 9C6_H1.1_ IgG1_pI(-)_Isosteric_A_/PVA_ /S267K/L368D/K370S

SEQ ID NO: 43765 - protein, 118 aa, Artificial Sequence; identical to SEQ ID NO: 21205
  Description of Artificial Sequence: Synthetic polypeptide
  VH of XENCS:506

SEQ ID NO: 43766 - protein, 5 aa, Artificial Sequence
  Description of Artificial Sequence: Synthetic peptide
  XENCS:506 vhCDR1
GYGVN

SEQ ID NO: 43767 - protein, 16 aa, Artificial Sequence
  Description of Artificial Sequence: Synthetic peptide
  XENCS:506 vhCDR2
MIWIDGSTDYNSKFQG

SEQ ID NO: 43768 - protein, 10 aa, Artificial Sequence
  Description of Artificial Sequence: Synthetic peptide
  XENCS:506 vhCDR3
DRPDGRAMDY

SEQ ID NO: 43769 - protein, 480 aa, Artificial Sequence; identical to SEQ ID NO: 43649
  Description of Artificial Sequence: Synthetic polypeptide
  XENCS:506 scFv Chain 2 - 1C11[PD-1]_H3.234_L3.144_scFv(GKPGS)4_ Fc(216)_IgG1_C220S/PVA_/S267K/S364K/E357Q

SEQ ID NO: 43770 - protein, 117 aa, Artificial Sequence; identical to SEQ ID NO: 40669
  Description of Artificial Sequence: Synthetic polypeptide
  VH of XENCS:506

SEQ ID NO: 43771 - protein, 112 aa, Artificial Sequence; identical to SEQ ID NO: 40517
  Description of Artificial Sequence: Synthetic polypeptide
  VL of XENCS:506

SEQ ID NO: 43772 - protein, 231 aa, Artificial Sequence; identical to SEQ ID NO: 21532
  Description of Artificial Sequence: Synthetic polypeptide
  Fc chain of XENCS:506

SEQ ID NO: 43773 - protein, 5 aa, Artificial Sequence
  Description of Artificial Sequence: Synthetic peptide
  XENCS:506 vhCDR1
HYGIN

SEQ ID NO: 43774 - protein, 17 aa, Artificial Sequence
  Description of Artificial Sequence: Synthetic peptide
  XENCS:506 vhCDR2
WINTYTGEPYYAPGFQE

SEQ ID NO: 43775 - protein, 8 aa, Artificial Sequence
  Description of Artificial Sequence: Synthetic peptide
  XENCS:506 vhCDR3
DYYGSSPY

SEQ ID NO: 43776 - protein, 16 aa, Artificial Sequence
  Description of Artificial Sequence: Synthetic peptide
  XENCS:506 vlCDR1
KASQSIVHSNGNTYLE

SEQ ID NO: 43777 - protein, 7 aa, Artificial Sequence
  Description of Artificial Sequence: Synthetic peptide
  XENCS:506 vlCDR2
KVSNRFS

SEQ ID NO: 43778 - protein, 9 aa, Artificial Sequence
  Description of Artificial Sequence: Synthetic peptide
  XENCS:506 vlCDR3
FQGSHVPNT

SEQ ID NO: 43779 - protein, 213 aa, Artificial Sequence; identical to SEQ ID NO: 21050
  Description of Artificial Sequence: Synthetic polypeptide
  XENCS:506 Light Chain 3 - 9C6_L1

SEQ ID NO: 43780 - protein, 106 aa, Artificial Sequence; identical to SEQ ID NO: 21051
  Description of Artificial Sequence: Synthetic polypeptide
  VL of XENCS:506

SEQ ID NO: 43781 - protein, 11 aa, Artificial Sequence
  Description of Artificial Sequence: Synthetic peptide
  XENCS:506 vlCDR1
KASQSVSNDVA

SEQ ID NO: 43782 - protein, 7 aa, Artificial Sequence
  Description of Artificial Sequence: Synthetic peptide
  XENCS:506 vlCDR2
YASNRYT

SEQ ID NO: 43783 - protein, 8 aa, Artificial Sequence
  Description of Artificial Sequence: Synthetic peptide
  XENCS:506 vlCDR3
QQDYSSPT

SEQ ID NO: 43784 - protein, 454 aa, Artificial Sequence; identical to SEQ ID NO: 43644
  Description of Artificial Sequence: Synthetic polypeptide
  XenCS507 Fab Chain 1 - [ICOS]_H0_ IgG1_pI(-)_Isosteric_A_/PVA_ /S267K/L368D/K370S

SEQ ID NO: 43785 - protein, 125 aa, Artificial Sequence; identical to SEQ ID NO: 43645
  Description of Artificial Sequence: Synthetic polypeptide
  VH of XENCS507

SEQ ID NO: 43786 - protein, 5 aa, Artificial Sequence
  Description of Artificial Sequence: Synthetic peptide
  XENCS507 vhCDR1
GYYMH

SEQ ID NO: 43787 - protein, 17 aa, Artificial Sequence
  Description of Artificial Sequence: Synthetic peptide
  XENCS507 vhCDR2
WINPHSGGTNYAQKFQG

SEQ ID NO: 43788 - protein, 16 aa, Artificial Sequence
  Description of Artificial Sequence: Synthetic peptide
  XENCS507 vhCDR3
TYYYDSSGYYHDAFDI

SEQ ID NO: 43789 - protein, 480 aa, Artificial Sequence
  Description of Artificial Sequence: Synthetic polypeptide
  XenCS507 scFv Chain 2 - 1C11[PD-1]_H3.240_L3.148_scFv(GKPGS)4_ Fc(216)_IgG1_C220S/PVA_/S267K/S364K/E357Q
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43790 - protein, 117 aa, Artificial Sequence; identical to SEQ ID NO: 40831
  Description of Artificial Sequence: Synthetic polypeptide
  VH of XENCS507

SEQ ID NO: 43791 - protein, 112 aa, Artificial Sequence; identical to SEQ ID NO: 33009
  Description of Artificial Sequence: Synthetic polypeptide
  VL of XENCS507

SEQ ID NO: 43792 - protein, 231 aa, Artificial Sequence; identical to SEQ ID NO: 21532
  Description of Artificial Sequence: Synthetic polypeptide
  Fc chain of XENCS507

SEQ ID NO: 43793 - protein, 5 aa, Artificial Sequence
  Description of Artificial Sequence: Synthetic peptide
  XENCS507 vhCDR1
HYGIN

SEQ ID NO: 43794 - protein, 17 aa, Artificial Sequence
  Description of Artificial Sequence: Synthetic peptide
  XENCS507 vhCDR2
WINTYTGEPYYAPGFQE

SEQ ID NO: 43795 - protein, 8 aa, Artificial Sequence
  Description of Artificial Sequence: Synthetic peptide
  XENCS507 vhCDR3
DYYGSSPY

SEQ ID NO: 43796 - protein, 16 aa, Artificial Sequence
  Description of Artificial Sequence: Synthetic peptide
  XENCS507 vlCDR1
KSSQSIVHSNGNTYLE

SEQ ID NO: 43797 - protein, 7 aa, Artificial Sequence
  Description of Artificial Sequence: Synthetic peptide
  XENCS507 vlCDR2
KVSNRFS

SEQ ID NO: 43798 - protein, 9 aa, Artificial Sequence
  Description of Artificial Sequence: Synthetic peptide
  XENCS507 vlCDR3
FQGSHVPNT

SEQ ID NO: 43799 - protein, 214 aa, Artificial Sequence; identical to SEQ ID NO: 43659
  Description of Artificial Sequence: Synthetic polypeptide
  XenCS507 Light Chain 3 - [ICOS]_L0

SEQ ID NO: 43800 - protein, 107 aa, Artificial Sequence; identical to SEQ ID NO: 43660
  Description of Artificial Sequence: Synthetic polypeptide
  VL of XENCS507

SEQ ID NO: 43801 - protein, 11 aa, Artificial Sequence
  Description of Artificial Sequence: Synthetic peptide
  XENCS507 vlCDR1
RASQGISRLLA

SEQ ID NO: 43802 - protein, 7 aa, Artificial Sequence
  Description of Artificial Sequence: Synthetic peptide
  XENCS507 vlCDR2
VASSLQS

SEQ ID NO: 43803 - protein, 9 aa, Artificial Sequence
  Description of Artificial Sequence: Synthetic peptide
  XENCS507 vlCDR3
QQANSFPWT

SEQ ID NO: 43804 - protein, 454 aa, Artificial Sequence; identical to SEQ ID NO: 43664
  Description of Artificial Sequence: Synthetic polypeptide
  XenCS508 Fab Chain 1 - [ICOS]_H0.66_ IgG1_pI(-)_Isosteric_A_/PVA_ /S267K/L368D/K370S

SEQ ID NO: 43805 - protein, 125 aa, Artificial Sequence; identical to SEQ ID NO: 43665
  Description of Artificial Sequence: Synthetic polypeptide
  VH of XENCS508

SEQ ID NO: 43806 - protein, 5 aa, Artificial Sequence
  Description of Artificial Sequence: Synthetic peptide
  XENCS508 vhCDR1
GYYMH

SEQ ID NO: 43807 - protein, 17 aa, Artificial Sequence
  Description of Artificial Sequence: Synthetic peptide
  XENCS508 vhCDR2
WINPHSGETIYAQKFQG

SEQ ID NO: 43808 - protein, 16 aa, Artificial Sequence
  Description of Artificial Sequence: Synthetic peptide
  XENCS508 vhCDR3
TYYYDTSGYYHDAFDV

SEQ ID NO: 43809 - protein, 480 aa, Artificial Sequence; identical to SEQ ID NO: 43789
  Description of Artificial Sequence: Synthetic polypeptide
  XenCS508 scFv Chain 2 - 1C11[PD-1]_H3.240_L3.148_scFv(GKPGS)4_ Fc(216)_IgG1_C220S/PVA_/S267K/S364K/E357Q

SEQ ID NO: 43810 - protein, 117 aa, Artificial Sequence; identical to SEQ ID NO: 40831
  Description of Artificial Sequence: Synthetic polypeptide
  VH of XENCS508

SEQ ID NO: 43811 - protein, 112 aa, Artificial Sequence; identical to SEQ ID NO: 33009
  Description of Artificial Sequence: Synthetic polypeptide
  VL of XENCS508

SEQ ID NO: 43812 - protein, 231 aa, Artificial Sequence; identical to SEQ ID NO: 21532
  Description of Artificial Sequence: Synthetic polypeptide
  Fc chain of XENCS508

SEQ ID NO: 43813 - protein, 5 aa, Artificial Sequence
  Description of Artificial Sequence: Synthetic peptide
  XENCS508 vhCDR1
HYGIN

SEQ ID NO: 43814 - protein, 17 aa, Artificial Sequence
  Description of Artificial Sequence: Synthetic peptide
  XENCS508 vhCDR2
WINTYTGEPYYAPGFQE

SEQ ID NO: 43815 - protein, 8 aa, Artificial Sequence
  Description of Artificial Sequence: Synthetic peptide
  XENCS508 vhCDR3
DYYGSSPY

SEQ ID NO: 43816 - protein, 16 aa, Artificial Sequence
  Description of Artificial Sequence: Synthetic peptide
  XENCS508 vlCDR1
KSSQSIVHSNGNTYLE

SEQ ID NO: 43817 - protein, 7 aa, Artificial Sequence
  Description of Artificial Sequence: Synthetic peptide
  XENCS508 vlCDR2
KVSNRFS

SEQ ID NO: 43818 - protein, 9 aa, Artificial Sequence
  Description of Artificial Sequence: Synthetic peptide
  XENCS508 vlCDR3
FQGSHVPNT

SEQ ID NO: 43819 - protein, 214 aa, Artificial Sequence; identical to SEQ ID NO: 43659
  Description of Artificial Sequence: Synthetic polypeptide
  XenCS508 Light Chain 3 - [ICOS]_L0

SEQ ID NO: 43820 - protein, 107 aa, Artificial Sequence; identical to SEQ ID NO: 43660
  Description of Artificial Sequence: Synthetic polypeptide
  VL of XENCS508

SEQ ID NO: 43821 - protein, 11 aa, Artificial Sequence
  Description of Artificial Sequence: Synthetic peptide
  XENCS508 vlCDR1
RASQGISRLLA

SEQ ID NO: 43822 - protein, 7 aa, Artificial Sequence
  Description of Artificial Sequence: Synthetic peptide
  XENCS508 vlCDR2
VASSLQS

SEQ ID NO: 43823 - protein, 9 aa, Artificial Sequence
  Description of Artificial Sequence: Synthetic peptide
  XENCS508 vlCDR3
QQANSFPWT

SEQ ID NO: 43824 - protein, 447 aa, Artificial Sequence; identical to SEQ ID NO: 23356
  Description of Artificial Sequence: Synthetic polypeptide
  XenCS509 Fab Chain 1 - [CTLA-4]_H3_ IgG1_pI(-)_Isosteric_A_/PVA_ /S267K/L368D/K370S

SEQ ID NO: 43825 - protein, 118 aa, Artificial Sequence; identical to SEQ ID NO: 139
  Description of Artificial Sequence: Synthetic polypeptide
  VH of XENCS509

SEQ ID NO: 43826 - protein, 5 aa, Artificial Sequence
  Description of Artificial Sequence: Synthetic peptide
  XENCS509 vhCDR1
SYTMH

SEQ ID NO: 43827 - protein, 17 aa, Artificial Sequence
  Description of Artificial Sequence: Synthetic peptide
  XENCS509 vhCDR2
FISYDGNNKYYADSVKG

SEQ ID NO: 43828 - protein, 9 aa, Artificial Sequence
  Description of Artificial Sequence: Synthetic peptide
  XENCS509 vhCDR3
TGWLGPFDY

SEQ ID NO: 43829 - protein, 480 aa, Artificial Sequence; identical to SEQ ID NO: 43789
  Description of Artificial Sequence: Synthetic polypeptide
  XenCS509 scFv Chain 2 - 1C11[PD-1]_H3.240_L3.148_scFv(GKPGS)4_ Fc(216)_IgG1_C220S/PVA_/S267K/S364K/E357Q

SEQ ID NO: 43830 - protein, 117 aa, Artificial Sequence; identical to SEQ ID NO: 40831
  Description of Artificial Sequence: Synthetic polypeptide
  VH of XENCS509

SEQ ID NO: 43831 - protein, 112 aa, Artificial Sequence; identical to SEQ ID NO: 33009
  Description of Artificial Sequence: Synthetic polypeptide
  VL of XENCS509

SEQ ID NO: 43832 - protein, 231 aa, Artificial Sequence; identical to SEQ ID NO: 21532
  Description of Artificial Sequence: Synthetic polypeptide
  Fc chain of XENCS509

SEQ ID NO: 43833 - protein, 5 aa, Artificial Sequence
  Description of Artificial Sequence: Synthetic peptide
  XENCS509 vhCDR1
HYGIN

SEQ ID NO: 43834 - protein, 17 aa, Artificial Sequence
  Description of Artificial Sequence: Synthetic peptide
  XENCS509 vhCDR2
WINTYTGEPYYAPGFQE

SEQ ID NO: 43835 - protein, 8 aa, Artificial Sequence
  Description of Artificial Sequence: Synthetic peptide
  XENCS509 vhCDR3
DYYGSSPY

SEQ ID NO: 43836 - protein, 16 aa, Artificial Sequence
  Description of Artificial Sequence: Synthetic peptide
  XENCS509 vlCDR1
KSSQSIVHSNGNTYLE

SEQ ID NO: 43837 - protein, 7 aa, Artificial Sequence
  Description of Artificial Sequence: Synthetic peptide
  XENCS509 vlCDR2
KVSNRFS

SEQ ID NO: 43838 - protein, 9 aa, Artificial Sequence
  Description of Artificial Sequence: Synthetic peptide
  XENCS509 vlCDR3
FQGSHVPNT

SEQ ID NO: 43839 - protein, 215 aa, Artificial Sequence; identical to SEQ ID NO: 4504
  Description of Artificial Sequence: Synthetic polypeptide
  XenCS509 Light Chain 3 - [CTLA-4]_L0.22

SEQ ID NO: 43840 - protein, 108 aa, Artificial Sequence; identical to SEQ ID NO: 1607
  Description of Artificial Sequence: Synthetic polypeptide
  VL of XENCS509

SEQ ID NO: 43841 - protein, 12 aa, Artificial Sequence
  Description of Artificial Sequence: Synthetic peptide
  XENCS509 vlCDR1
RASQSVSSSYLA

SEQ ID NO: 43842 - protein, 7 aa, Artificial Sequence
  Description of Artificial Sequence: Synthetic peptide
  XENCS509 vlCDR2
GAFSRAT

SEQ ID NO: 43843 - protein, 9 aa, Artificial Sequence
  Description of Artificial Sequence: Synthetic peptide
  XENCS509 vlCDR3
QQYGSSPWT

SEQ ID NO: 43844 - protein, 450 aa, Artificial Sequence; identical to SEQ ID NO: 22484
  Description of Artificial Sequence: Synthetic polypeptide
  XenCS510 Fab Chain 1 - 7G8_H3.30_ IgG1_pI(-)_Isosteric_A_/PVA_ /S267K/L368D/K370S

SEQ ID NO: 43845 - protein, 121 aa, Artificial Sequence; identical to SEQ ID NO: 22485
  Description of Artificial Sequence: Synthetic polypeptide
  VH of XENCs510

SEQ ID NO: 43846 - protein, 5 aa, Artificial Sequence
  Description of Artificial Sequence: Synthetic peptide
  XENCs510 vhCDR1
DAWMS

SEQ ID NO: 43847 - protein, 19 aa, Artificial Sequence
  Description of Artificial Sequence: Synthetic peptide
  XENCs510 vhCDR2
EISTKANNHATYYAESVKG

SEQ ID NO: 43848 - protein, 10 aa, Artificial Sequence
  Description of Artificial Sequence: Synthetic peptide
  XENCs510 vhCDR3
LATWDWYFDV

SEQ ID NO: 43849 - protein, 480 aa, Artificial Sequence; identical to SEQ ID NO: 43789
  Description of Artificial Sequence: Synthetic polypeptide
  XenCS510 scFv Chain 2 -1C11[PD-1]_H3.240_L3.148_scFv(GKPGS)4_ Fc(216)_IgG1_C220S/PVA_/S267K/S364K/E357Q

SEQ ID NO: 43850 - protein, 117 aa, Artificial Sequence; identical to SEQ ID NO: 40831
  Description of Artificial Sequence: Synthetic polypeptide
  VH of XENCs510

SEQ ID NO: 43851 - protein, 112 aa, Artificial Sequence; identical to SEQ ID NO: 33009
  Description of Artificial Sequence: Synthetic polypeptide
  VL of XENCs510

SEQ ID NO: 43852 - protein, 231 aa, Artificial Sequence; identical to SEQ ID NO: 21532
  Description of Artificial Sequence: Synthetic polypeptide
  Fc chain of XENCs510

SEQ ID NO: 43853 - protein, 5 aa, Artificial Sequence
  Description of Artificial Sequence: Synthetic peptide
  XENCs510 vhCDR1
HYGIN

SEQ ID NO: 43854 - protein, 17 aa, Artificial Sequence
  Description of Artificial Sequence: Synthetic peptide
  XENCs510 vhCDR2
WINTYTGEPYYAPGFQE

SEQ ID NO: 43855 - protein, 8 aa, Artificial Sequence
  Description of Artificial Sequence: Synthetic peptide
  XENCs510 vhCDR3
DYYGSSPY

SEQ ID NO: 43856 - protein, 16 aa, Artificial Sequence
  Description of Artificial Sequence: Synthetic peptide
  XENCs510 vlCDR1
KSSQSIVHSNGNTYLE

SEQ ID NO: 43857 - protein, 7 aa, Artificial Sequence
  Description of Artificial Sequence: Synthetic peptide
  XENCs510 vlCDR2
KVSNRFS

SEQ ID NO: 43858 - protein, 9 aa, Artificial Sequence
  Description of Artificial Sequence: Synthetic peptide
  XENCs510 vlCDR3
FQGSHVPNT

SEQ ID NO: 43859 - protein, 218 aa, Artificial Sequence; identical to SEQ ID NO: 22599
  Description of Artificial Sequence: Synthetic polypeptide
  XenCS510 Light Chain 3 - 7G8_L1.34

SEQ ID NO: 43860 - protein, 111 aa, Artificial Sequence; identical to SEQ ID NO: 22600
  Description of Artificial Sequence: Synthetic polypeptide
  VL of XENCs510

SEQ ID NO: 43861 - protein, 15 aa, Artificial Sequence
  Description of Artificial Sequence: Synthetic peptide
  XENCs510 vlCDR1
RASQSVDYDGDSYMN

SEQ ID NO: 43862 - protein, 7 aa, Artificial Sequence
  Description of Artificial Sequence: Synthetic peptide
  XENCs510 vlCDR2
AASELES

SEQ ID NO: 43863 - protein, 9 aa, Artificial Sequence
  Description of Artificial Sequence: Synthetic peptide
  XENCs510 vlCDR3
QQSNEDPFT

SEQ ID NO: 43864 - protein, 447 aa, Artificial Sequence; identical to SEQ ID NO: 22084
  Description of Artificial Sequence: Synthetic polypeptide
  XenCS511 Fab Chain 1 - 2A11_H1.144_ IgG1_pI(-)_Isosteric_A_/PVA_ /S267K/L368D/K370S

SEQ ID NO: 43865 - protein, 118 aa, Artificial Sequence; identical to SEQ ID NO: 22085
  Description of Artificial Sequence: Synthetic polypeptide
  VH of XENCS511

SEQ ID NO: 43866 - protein, 5 aa, Artificial Sequence
  Description of Artificial Sequence: Synthetic peptide
  XENCS511 vhCDR1
DYFMH

SEQ ID NO: 43867 - protein, 17 aa, Artificial Sequence
  Description of Artificial Sequence: Synthetic peptide
  XENCS511 vhCDR2
WIDPELGDTEYAPKFQG

SEQ ID NO: 43868 - protein, 9 aa, Artificial Sequence
  Description of Artificial Sequence: Synthetic peptide
  XENCS511 vhCDR3
RGVYQALDY

SEQ ID NO: 43869 - protein, 480 aa, Artificial Sequence; identical to SEQ ID NO: 43789
  Description of Artificial Sequence: Synthetic polypeptide
  XenCS511 scFv Chain 2 - 1C11[PD-1]_H3.240_L3.148_scFv(GKPGS)4_ Fc(216)_IgG1_C220S/PVA_/S267K/S364K/E357Q

SEQ ID NO: 43870 - protein, 117 aa, Artificial Sequence; identical to SEQ ID NO: 40831
  Description of Artificial Sequence: Synthetic polypeptide
  VH of XENCS511

SEQ ID NO: 43871 - protein, 112 aa, Artificial Sequence; identical to SEQ ID NO: 33009
  Description of Artificial Sequence: Synthetic polypeptide
  VL of XENCS511

SEQ ID NO: 43872 - protein, 231 aa, Artificial Sequence; identical to SEQ ID NO: 21532
  Description of Artificial Sequence: Synthetic polypeptide
  Fc chain of XENCS511

SEQ ID NO: 43873 - protein, 5 aa, Artificial Sequence
  Description of Artificial Sequence: Synthetic peptide
  XENCS511 vhCDR1
HYGIN

SEQ ID NO: 43874 - protein, 17 aa, Artificial Sequence
  Description of Artificial Sequence: Synthetic peptide
  XENCS511 vhCDR2
WINTYTGEPYYAPGFQE

SEQ ID NO: 43875 - protein, 8 aa, Artificial Sequence
  Description of Artificial Sequence: Synthetic peptide
  XENCS511 vhCDR3
DYYGSSPY

SEQ ID NO: 43876 - protein, 16 aa, Artificial Sequence
  Description of Artificial Sequence: Synthetic peptide
  XENCS511 vlCDR1
KSSQSIVHSNGNTYLE

SEQ ID NO: 43877 - protein, 7 aa, Artificial Sequence
  Description of Artificial Sequence: Synthetic peptide
  XENCS511 vlCDR2
KVSNRFS

SEQ ID NO: 43878 - protein, 9 aa, Artificial Sequence
  Description of Artificial Sequence: Synthetic peptide
  XENCS511 vlCDR3
FQGSHVPNT

SEQ ID NO: 43879 - protein, 214 aa, Artificial Sequence; identical to SEQ ID NO: 22279
  Description of Artificial Sequence: Synthetic polypeptide
  XenCS511 Light Chain 3 - 2A11_L2.142

SEQ ID NO: 43880 - protein, 107 aa, Artificial Sequence; identical to SEQ ID NO: 22280
  Description of Artificial Sequence: Synthetic polypeptide
  VL of XENCS511

SEQ ID NO: 43881 - protein, 11 aa, Artificial Sequence
  Description of Artificial Sequence: Synthetic peptide
  XENCS511 vlCDR1
QASQDIGNYLN

SEQ ID NO: 43882 - protein, 7 aa, Artificial Sequence
  Description of Artificial Sequence: Synthetic peptide
  XENCS511 vlCDR2
FTSYLHS

SEQ ID NO: 43883 - protein, 9 aa, Artificial Sequence
  Description of Artificial Sequence: Synthetic peptide
  XENCS511 vlCDR3
QQGNTLPYT

SEQ ID NO: 43884 - protein, 446 aa, Artificial Sequence; identical to SEQ ID NO: 43744
  Description of Artificial Sequence: Synthetic polypeptide
  XenCS512 Chain 1 - 3H3_H1_ IgG1_pI(-)_Isosteric_A_/PVA_ /S267K/L368D/K370S

SEQ ID NO: 43885 - protein, 117 aa, Artificial Sequence; identical to SEQ ID NO: 36368
  Description of Artificial Sequence: Synthetic polypeptide
  VH of XENCS512

SEQ ID NO: 43886 - protein, 5 aa, Artificial Sequence
  Description of Artificial Sequence: Synthetic peptide
  XENCS512 vhCDR1
GYGVN

SEQ ID NO: 43887 - protein, 16 aa, Artificial Sequence
  Description of Artificial Sequence: Synthetic peptide
  XENCS512 vhCDR2
MIWGDGSTDYNSALKS

SEQ ID NO: 43888 - protein, 9 aa, Artificial Sequence
  Description of Artificial Sequence: Synthetic peptide
  XENCS512 vhCDR3
SYYTSDEDY

SEQ ID NO: 43889 - protein, 480 aa, Artificial Sequence; identical to SEQ ID NO: 43789
  Description of Artificial Sequence: Synthetic polypeptide
  XenCS512 Chain 2 - 1C11[PD-1]_H3.240_L3.148_scFv(GKPGS)4_Fc(216)_ IgG1_C220S/PVA_/S267K/S364K/E357Q

SEQ ID NO: 43890 - protein, 117 aa, Artificial Sequence; identical to SEQ ID NO: 40831
  Description of Artificial Sequence: Synthetic polypeptide
  VH of XENCS512

SEQ ID NO: 43891 - protein, 112 aa, Artificial Sequence; identical to SEQ ID NO: 33009
  Description of Artificial Sequence: Synthetic polypeptide
  VL of XENCS512

SEQ ID NO: 43892 - protein, 231 aa, Artificial Sequence; identical to SEQ ID NO: 21532
  Description of Artificial Sequence: Synthetic polypeptide
  Fc chain of XENCS512

SEQ ID NO: 43893 - protein, 5 aa, Artificial Sequence
  Description of Artificial Sequence: Synthetic peptide
  XENCS512 vhCDR1
HYGIN

SEQ ID NO: 43894 - protein, 17 aa, Artificial Sequence
  Description of Artificial Sequence: Synthetic peptide
  XENCS512 vhCDR2
WINTYTGEPYYAPGFQE

SEQ ID NO: 43895 - protein, 8 aa, Artificial Sequence
  Description of Artificial Sequence: Synthetic peptide
  XENCS512 vhCDR3
DYYGSSPY

SEQ ID NO: 43896 - protein, 16 aa, Artificial Sequence
  Description of Artificial Sequence: Synthetic peptide
  XENCS512 vlCDR1
KSSQSIVHSNGNTYLE

SEQ ID NO: 43897 - protein, 7 aa, Artificial Sequence
  Description of Artificial Sequence: Synthetic peptide
  XENCS512 vlCDR2
KVSNRFS

SEQ ID NO: 43898 - protein, 9 aa, Artificial Sequence
  Description of Artificial Sequence: Synthetic peptide
  XENCS512 vlCDR3
FQGSHVPNT

SEQ ID NO: 43899 - protein, 219 aa, Artificial Sequence; identical to SEQ ID NO: 36512
  Description of Artificial Sequence: Synthetic polypeptide
  XenCS512 Chain 3 - 3H3_L2.1

SEQ ID NO: 43900 - protein, 112 aa, Artificial Sequence; identical to SEQ ID NO: 36513
  Description of Artificial Sequence: Synthetic polypeptide
  VL of XENCS512

SEQ ID NO: 43901 - protein, 17 aa, Artificial Sequence
  Description of Artificial Sequence: Synthetic peptide
  XENCS512 vlCDR1
KSSQSLLNSRTRKNYLA

SEQ ID NO: 43902 - protein, 7 aa, Artificial Sequence
  Description of Artificial Sequence: Synthetic peptide
  XENCS512 vlCDR2
WASTRES

SEQ ID NO: 43903 - protein, 8 aa, Artificial Sequence
  Description of Artificial Sequence: Synthetic peptide
  XENCS512 vlCDR3
KQSYSLRT

SEQ ID NO: 43904 - protein, 447 aa, Artificial Sequence; identical to SEQ ID NO: 23236
  Description of Artificial Sequence: Synthetic polypeptide
  XenCS513 Chain 1 - 9C6_H1.1_ IgG1_pI(-)_Isosteric_A_/PVA_ /S267K/L368D/K370S

SEQ ID NO: 43905 - protein, 118 aa, Artificial Sequence; identical to SEQ ID NO: 21205
  Description of Artificial Sequence: Synthetic polypeptide
  VH of XENCS513

SEQ ID NO: 43906 - protein, 5 aa, Artificial Sequence
  Description of Artificial Sequence: Synthetic peptide
  XENCS513 vhCDR1
GYGVN

SEQ ID NO: 43907 - protein, 16 aa, Artificial Sequence
  Description of Artificial Sequence: Synthetic peptide
  XENCS513 vhCDR2
MIWIDGSTDYNSKFQG

SEQ ID NO: 43908 - protein, 10 aa, Artificial Sequence
  Description of Artificial Sequence: Synthetic peptide
  XENCS513 vhCDR3
DRPDGRAMDY

SEQ ID NO: 43909 - protein, 480 aa, Artificial Sequence; identical to SEQ ID NO: 43789
  Description of Artificial Sequence: Synthetic polypeptide
  XenCS513 Chain 2 - 1C11[PD-1]_H3.240_L3.148_scFv(GKPGS)4_Fc(216)_ IgG1_C220S/PVA_/S267K/S364K/E357Q

SEQ ID NO: 43910 - protein, 117 aa, Artificial Sequence; identical to SEQ ID NO: 40831
  Description of Artificial Sequence: Synthetic polypeptide
  VH of XENCS513

SEQ ID NO: 43911 - protein, 112 aa, Artificial Sequence; identical to SEQ ID NO: 33009
  Description of Artificial Sequence: Synthetic polypeptide
  VL of XENCS513

SEQ ID NO: 43912 - protein, 231 aa, Artificial Sequence; identical to SEQ ID NO: 21532
  Description of Artificial Sequence: Synthetic polypeptide
  Fc chain of XENCS513

SEQ ID NO: 43913 - protein, 5 aa, Artificial Sequence
  Description of Artificial Sequence: Synthetic peptide
  XENCS513 vhCDR1
HYGIN

SEQ ID NO: 43914 - protein, 17 aa, Artificial Sequence
  Description of Artificial Sequence: Synthetic peptide
  XENCS513 vhCDR2
WINTYTGEPYYAPGFQE

SEQ ID NO: 43915 - protein, 8 aa, Artificial Sequence
  Description of Artificial Sequence: Synthetic peptide
  XENCS513 vhCDR3
DYYGSSPY

SEQ ID NO: 43916 - protein, 16 aa, Artificial Sequence
  Description of Artificial Sequence: Synthetic peptide
  XENCS513 vlCDR1
KSSQSIVHSNGNTYLE

SEQ ID NO: 43917 - protein, 7 aa, Artificial Sequence
  Description of Artificial Sequence: Synthetic peptide
  XENCS513 vlCDR2
KVSNRFS

SEQ ID NO: 43918 - protein, 9 aa, Artificial Sequence
  Description of Artificial Sequence: Synthetic peptide
  XENCS513 vlCDR3
FQGSHVPNT

SEQ ID NO: 43919 - protein, 213 aa, Artificial Sequence; identical to SEQ ID NO: 21050
  Description of Artificial Sequence: Synthetic polypeptide
  XenCS513 Chain 3 - 9C6_L1

SEQ ID NO: 43920 - protein, 106 aa, Artificial Sequence; identical to SEQ ID NO: 21051
  Description of Artificial Sequence: Synthetic polypeptide
  VL of XENCS513

SEQ ID NO: 43921 - protein, 11 aa, Artificial Sequence
  Description of Artificial Sequence: Synthetic peptide
  XENCS513 vlCDR1
KASQSVSNDVA

SEQ ID NO: 43922 - protein, 7 aa, Artificial Sequence
  Description of Artificial Sequence: Synthetic peptide
  XENCS513 vlCDR2
YASNRYT

SEQ ID NO: 43923 - protein, 8 aa, Artificial Sequence
  Description of Artificial Sequence: Synthetic peptide
  XENCS513 vlCDR3
QQDYSSPT

SEQ ID NO: 43924 - protein, 454 aa, Artificial Sequence; identical to SEQ ID NO: 43644
  Description of Artificial Sequence: Synthetic polypeptide
  XenCS514 Chain 1 - [ICOS]_H0_ IgG1_pI(-)_Isosteric_A_/PVA_ /S267K/L368D/K370S

SEQ ID NO: 43925 - protein, 125 aa, Artificial Sequence; identical to SEQ ID NO: 43645
  Description of Artificial Sequence: Synthetic polypeptide
  VH of XENCS514

SEQ ID NO: 43926 - protein, 5 aa, Artificial Sequence
  Description of Artificial Sequence: Synthetic peptide
  XENCS514 vhCDR1
GYYMH

SEQ ID NO: 43927 - protein, 17 aa, Artificial Sequence
  Description of Artificial Sequence: Synthetic peptide
  XENCS514 vhCDR2
WINPHSGGTNYAQKFQG

SEQ ID NO: 43928 - protein, 16 aa, Artificial Sequence
  Description of Artificial Sequence: Synthetic peptide
  XENCS514 vhCDR3
TYYYDSSGYYHDAFDI

SEQ ID NO: 43929 - protein, 480 aa, Artificial Sequence
  Description of Artificial Sequence: Synthetic polypeptide
  XenCS514 Chain 2 - 1C11[PD-1]_H3.241_L3.148_scFv(GKPGS)4_Fc(216)_ IgG1_C220S/PVA_/S267K/S364K/E357Q
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43930 - protein, 117 aa, Artificial Sequence; identical to SEQ ID NO: 40840
  Description of Artificial Sequence: Synthetic polypeptide
  VH of XENCS514

SEQ ID NO: 43931 - protein, 112 aa, Artificial Sequence; identical to SEQ ID NO: 33009
  Description of Artificial Sequence: Synthetic polypeptide
  VL of XENCS514

SEQ ID NO: 43932 - protein, 231 aa, Artificial Sequence; identical to SEQ ID NO: 21532
  Description of Artificial Sequence: Synthetic polypeptide
  Fc chain of XENCS514

SEQ ID NO: 43933 - protein, 5 aa, Artificial Sequence
  Description of Artificial Sequence: Synthetic peptide
  XENCS514 vhCDR1
HYGIN

SEQ ID NO: 43934 - protein, 17 aa, Artificial Sequence
  Description of Artificial Sequence: Synthetic peptide
  XENCS514 vhCDR2
WINTYTGEPYYAPGFQE

SEQ ID NO: 43935 - protein, 8 aa, Artificial Sequence
  Description of Artificial Sequence: Synthetic peptide
  XENCS514 vhCDR3
DYYGSSPY

SEQ ID NO: 43936 - protein, 16 aa, Artificial Sequence
  Description of Artificial Sequence: Synthetic peptide
  XENCS514 vlCDR1
KSSQSIVHSNGNTYLE

SEQ ID NO: 43937 - protein, 7 aa, Artificial Sequence
  Description of Artificial Sequence: Synthetic peptide
  XENCS514 vlCDR2
KVSNRFS

SEQ ID NO: 43938 - protein, 9 aa, Artificial Sequence
  Description of Artificial Sequence: Synthetic peptide
  XENCS514 vlCDR3
FQGSHVPNT

SEQ ID NO: 43939 - protein, 214 aa, Artificial Sequence; identical to SEQ ID NO: 43659
  Description of Artificial Sequence: Synthetic polypeptide
  XenCS514 Chain 3 - [ICOS]_L0

SEQ ID NO: 43940 - protein, 107 aa, Artificial Sequence; identical to SEQ ID NO: 43660
  Description of Artificial Sequence: Synthetic polypeptide
  VL of XENCS514

SEQ ID NO: 43941 - protein, 11 aa, Artificial Sequence
  Description of Artificial Sequence: Synthetic peptide
  XENCS514 vlCDR1
RASQGISRLLA

SEQ ID NO: 43942 - protein, 7 aa, Artificial Sequence
  Description of Artificial Sequence: Synthetic peptide
  XENCS514 vlCDR2
VASSLQS

SEQ ID NO: 43943 - protein, 9 aa, Artificial Sequence
  Description of Artificial Sequence: Synthetic peptide
  XENCS514 vlCDR3
QQANSFPWT

SEQ ID NO: 43944 - protein, 454 aa, Artificial Sequence; identical to SEQ ID NO: 43664
  Description of Artificial Sequence: Synthetic polypeptide
  XenCS515 Chain 1 - [ICOS]_H0.66_ IgG1_pI(-)_Isosteric_A_/PVA_ /S267K/L368D/K370S

SEQ ID NO: 43945 - protein, 125 aa, Artificial Sequence; identical to SEQ ID NO: 43665
  Description of Artificial Sequence: Synthetic polypeptide
  VH of XENCS515

SEQ ID NO: 43946 - protein, 5 aa, Artificial Sequence
  Description of Artificial Sequence: Synthetic peptide
  XENCS515 vhCDR1
GYYMH

SEQ ID NO: 43947 - protein, 17 aa, Artificial Sequence
  Description of Artificial Sequence: Synthetic peptide
  XENCS515 vhCDR2
WINPHSGETIYAQKFQG

SEQ ID NO: 43948 - protein, 16 aa, Artificial Sequence
  Description of Artificial Sequence: Synthetic peptide
  XENCS515 vhCDR3
TYYYDTSGYYHDAFDV

SEQ ID NO: 43949 - protein, 480 aa, Artificial Sequence; identical to SEQ ID NO: 43929
  Description of Artificial Sequence: Synthetic polypeptide
  XenCS515 Chain 2 - 1C11[PD-1]_H3.241_L3.148_scFv(GKPGS)4_Fc(216)_ IgG1_C220S/PVA_/S267K/S364K/E357Q

SEQ ID NO: 43950 - protein, 117 aa, Artificial Sequence; identical to SEQ ID NO: 40840
  Description of Artificial Sequence: Synthetic polypeptide
  VH of XENCS515

SEQ ID NO: 43951 - protein, 112 aa, Artificial Sequence; identical to SEQ ID NO: 33009
  Description of Artificial Sequence: Synthetic polypeptide
  VL of XENCS515

SEQ ID NO: 43952 - protein, 231 aa, Artificial Sequence; identical to SEQ ID NO: 21532
  Description of Artificial Sequence: Synthetic polypeptide
  Fc chain of XENCS515

SEQ ID NO: 43953 - protein, 5 aa, Artificial Sequence
  Description of Artificial Sequence: Synthetic peptide
  XENCS515 vhCDR1
HYGIN

SEQ ID NO: 43954 - protein, 17 aa, Artificial Sequence
  Description of Artificial Sequence: Synthetic peptide
  XENCS515 vhCDR2
WINTYTGEPYYAPGFQE

SEQ ID NO: 43955 - protein, 8 aa, Artificial Sequence
  Description of Artificial Sequence: Synthetic peptide
  XENCS515 vhCDR3
DYYGSSPY

SEQ ID NO: 43956 - protein, 16 aa, Artificial Sequence
  Description of Artificial Sequence: Synthetic peptide
  XENCS515 vlCDR1
KSSQSIVHSNGNTYLE

SEQ ID NO: 43957 - protein, 7 aa, Artificial Sequence
  Description of Artificial Sequence: Synthetic peptide
  XENCS515 vlCDR2
KVSNRFS

SEQ ID NO: 43958 - protein, 9 aa, Artificial Sequence
  Description of Artificial Sequence: Synthetic peptide
  XENCS515 vlCDR3
FQGSHVPNT

SEQ ID NO: 43959 - protein, 214 aa, Artificial Sequence; identical to SEQ ID NO: 43659
  Description of Artificial Sequence: Synthetic polypeptide
  XenCS515 Chain 3 - [ICOS]_L0

SEQ ID NO: 43960 - protein, 107 aa, Artificial Sequence; identical to SEQ ID NO: 43660
  Description of Artificial Sequence: Synthetic polypeptide
  VL of XENCS515

SEQ ID NO: 43961 - protein, 11 aa, Artificial Sequence
  Description of Artificial Sequence: Synthetic peptide
  XENCS515 vlCDR1
RASQGISRLLA

SEQ ID NO: 43962 - protein, 7 aa, Artificial Sequence
  Description of Artificial Sequence: Synthetic peptide
  XENCS515 vlCDR2
VASSLQS

SEQ ID NO: 43963 - protein, 9 aa, Artificial Sequence
  Description of Artificial Sequence: Synthetic peptide
  XENCS515 vlCDR3
QQANSFPWT

SEQ ID NO: 43964 - protein, 447 aa, Artificial Sequence; identical to SEQ ID NO: 23356
  Description of Artificial Sequence: Synthetic polypeptide
  XenCS516 Chain 1 - [CTLA-4]_H3_ IgG1_pI(-)_Isosteric_A_/PVA_ /S267K/L368D/K370S

SEQ ID NO: 43965 - protein, 118 aa, Artificial Sequence; identical to SEQ ID NO: 139
  Description of Artificial Sequence: Synthetic polypeptide
  VH of XENCS516

SEQ ID NO: 43966 - protein, 5 aa, Artificial Sequence
  Description of Artificial Sequence: Synthetic peptide
  XENCS516 vhCDR1
SYTMH

SEQ ID NO: 43967 - protein, 17 aa, Artificial Sequence
  Description of Artificial Sequence: Synthetic peptide
  XENCS516 vhCDR2
FISYDGNNKYYADSVKG

SEQ ID NO: 43968 - protein, 9 aa, Artificial Sequence
  Description of Artificial Sequence: Synthetic peptide
  XENCS516 vhCDR3
TGWLGPFDY

SEQ ID NO: 43969 - protein, 480 aa, Artificial Sequence; identical to SEQ ID NO: 43929
  Description of Artificial Sequence: Synthetic polypeptide
  XenCS516 Chain 2 - 1C11[PD-1]_H3.241_L3.148_scFv(GKPGS)4_Fc(216)_ IgG1_C220S/PVA_/S267K/S364K/E357Q

SEQ ID NO: 43970 - protein, 117 aa, Artificial Sequence; identical to SEQ ID NO: 40840
  Description of Artificial Sequence: Synthetic polypeptide
  VH of XENCS516

SEQ ID NO: 43971 - protein, 112 aa, Artificial Sequence; identical to SEQ ID NO: 33009
  Description of Artificial Sequence: Synthetic polypeptide
  VL of XENCS516

SEQ ID NO: 43972 - protein, 231 aa, Artificial Sequence; identical to SEQ ID NO: 21532
  Description of Artificial Sequence: Synthetic polypeptide
  Fc chain of XENCS516

SEQ ID NO: 43973 - protein, 5 aa, Artificial Sequence
  Description of Artificial Sequence: Synthetic peptide
  XENCS516 vhCDR1
HYGIN

SEQ ID NO: 43974 - protein, 17 aa, Artificial Sequence
  Description of Artificial Sequence: Synthetic peptide
  XENCS516 vhCDR2
WINTYTGEPYYAPGFQE

SEQ ID NO: 43975 - protein, 8 aa, Artificial Sequence
  Description of Artificial Sequence: Synthetic peptide
  XENCS516 vhCDR3
DYYGSSPY

SEQ ID NO: 43976 - protein, 16 aa, Artificial Sequence
  Description of Artificial Sequence: Synthetic peptide
  XENCS516 vlCDR1
KSSQSIVHSNGNTYLE

SEQ ID NO: 43977 - protein, 7 aa, Artificial Sequence
  Description of Artificial Sequence: Synthetic peptide
  XENCS516 vlCDR2
KVSNRFS

SEQ ID NO: 43978 - protein, 9 aa, Artificial Sequence
  Description of Artificial Sequence: Synthetic peptide
  XENCS516 vlCDR3
FQGSHVPNT

SEQ ID NO: 43979 - protein, 215 aa, Artificial Sequence; identical to SEQ ID NO: 4504
  Description of Artificial Sequence: Synthetic polypeptide
  XenCS516 Chain 3 - [CTLA-4]_L0.22

SEQ ID NO: 43980 - protein, 108 aa, Artificial Sequence; identical to SEQ ID NO: 1607
  Description of Artificial Sequence: Synthetic polypeptide
  VL of XENCS516

SEQ ID NO: 43981 - protein, 12 aa, Artificial Sequence
  Description of Artificial Sequence: Synthetic peptide
  XENCS516 vlCDR1
RASQSVSSSYLA

SEQ ID NO: 43982 - protein, 7 aa, Artificial Sequence
  Description of Artificial Sequence: Synthetic peptide
  XENCS516 vlCDR2
GAFSRAT

SEQ ID NO: 43983 - protein, 9 aa, Artificial Sequence
  Description of Artificial Sequence: Synthetic peptide
  XENCS516 vlCDR3
QQYGSSPWT

SEQ ID NO: 43984 - protein, 450 aa, Artificial Sequence; identical to SEQ ID NO: 22484
  Description of Artificial Sequence: Synthetic polypeptide
  XenCS517 Chain 1 - 7G8_H3.30_ IgG1_pI(-)_Isosteric_A_/PVA_ /S267K/L368D/K370S

SEQ ID NO: 43985 - protein, 121 aa, Artificial Sequence; identical to SEQ ID NO: 22485
  Description of Artificial Sequence: Synthetic polypeptide
  VH of XENCS517

SEQ ID NO: 43986 - protein, 5 aa, Artificial Sequence
  Description of Artificial Sequence: Synthetic peptide
  XENCS517 vhCDR1
DAWMS

SEQ ID NO: 43987 - protein, 19 aa, Artificial Sequence
  Description of Artificial Sequence: Synthetic peptide
  XENCS517 vhCDR2
EISTKANNHATYYAESVKG

SEQ ID NO: 43988 - protein, 10 aa, Artificial Sequence
  Description of Artificial Sequence: Synthetic peptide
  XENCS517 vhCDR3
LATWDWYFDV

SEQ ID NO: 43989 - protein, 480 aa, Artificial Sequence; identical to SEQ ID NO: 43929
  Description of Artificial Sequence: Synthetic polypeptide
  XenCS517 Chain 2 -1C11[PD-1]_H3.241_L3.148_scFv(GKPGS)4_Fc(216)_ IgG1_C220S/PVA_/S267K/S364K/E357Q

SEQ ID NO: 43990 - protein, 117 aa, Artificial Sequence; identical to SEQ ID NO: 40840
  Description of Artificial Sequence: Synthetic polypeptide
  VH of XENCS517

SEQ ID NO: 43991 - protein, 112 aa, Artificial Sequence; identical to SEQ ID NO: 33009
  Description of Artificial Sequence: Synthetic polypeptide
  VL of XENCS517

SEQ ID NO: 43992 - protein, 231 aa, Artificial Sequence; identical to SEQ ID NO: 21532
  Description of Artificial Sequence: Synthetic polypeptide
  Fc chain of XENCS517

SEQ ID NO: 43993 - protein, 5 aa, Artificial Sequence
  Description of Artificial Sequence: Synthetic peptide
  XENCS517 vhCDR1
HYGIN

SEQ ID NO: 43994 - protein, 17 aa, Artificial Sequence
  Description of Artificial Sequence: Synthetic peptide
  XENCS517 vhCDR2
WINTYTGEPYYAPGFQE

SEQ ID NO: 43995 - protein, 8 aa, Artificial Sequence
  Description of Artificial Sequence: Synthetic peptide
  XENCS517 vhCDR3
DYYGSSPY

SEQ ID NO: 43996 - protein, 16 aa, Artificial Sequence
  Description of Artificial Sequence: Synthetic peptide
  XENCS517 vlCDR1
KSSQSIVHSNGNTYLE

SEQ ID NO: 43997 - protein, 7 aa, Artificial Sequence
  Description of Artificial Sequence: Synthetic peptide
  XENCS517 vlCDR2
KVSNRFS

SEQ ID NO: 43998 - protein, 9 aa, Artificial Sequence
  Description of Artificial Sequence: Synthetic peptide
  XENCS517 vlCDR3
FQGSHVPNT

SEQ ID NO: 43999 - protein, 218 aa, Artificial Sequence; identical to SEQ ID NO: 22599
  Description of Artificial Sequence: Synthetic polypeptide
  XenCS517 Chain 3 - 7G8_L1.34

SEQ ID NO: 44000 - protein, 111 aa, Artificial Sequence; identical to SEQ ID NO: 22600
  Description of Artificial Sequence: Synthetic polypeptide
  VL of XENCS517

SEQ ID NO: 44001 - protein, 15 aa, Artificial Sequence
  Description of Artificial Sequence: Synthetic peptide
  XENCS517 vlCDR1
RASQSVDYDGDSYMN

SEQ ID NO: 44002 - protein, 7 aa, Artificial Sequence
  Description of Artificial Sequence: Synthetic peptide
  XENCS517 vlCDR2
AASELES

SEQ ID NO: 44003 - protein, 9 aa, Artificial Sequence
  Description of Artificial Sequence: Synthetic peptide
  XENCS517 vlCDR3
QQSNEDPFT

SEQ ID NO: 44004 - protein, 447 aa, Artificial Sequence; identical to SEQ ID NO: 22084
  Description of Artificial Sequence: Synthetic polypeptide
  XenCS518 Chain 1 - 2A11_H1.144_ IgG1_pI(-)_Isosteric_A_/PVA_ /S267K/L368D/K370S

SEQ ID NO: 44005 - protein, 118 aa, Artificial Sequence; identical to SEQ ID NO: 22085
  Description of Artificial Sequence: Synthetic polypeptide
  VH of XENCS518

SEQ ID NO: 44006 - protein, 5 aa, Artificial Sequence
  Description of Artificial Sequence: Synthetic peptide
  XENCS518 vhCDR1
DYFMH

SEQ ID NO: 44007 - protein, 17 aa, Artificial Sequence
  Description of Artificial Sequence: Synthetic peptide
  XENCS518 vhCDR2
WIDPELGDTEYAPKFQG

SEQ ID NO: 44008 - protein, 9 aa, Artificial Sequence
  Description of Artificial Sequence: Synthetic peptide
  XENCS518 vhCDR3
RGVYQALDY

SEQ ID NO: 44009 - protein, 480 aa, Artificial Sequence; identical to SEQ ID NO: 43929
  Description of Artificial Sequence: Synthetic polypeptide
  XenCS518 Chain 2 - 1C11[PD-1]_H3.241_L3.148_scFv(GKPGS)4_Fc(216)_ IgG1_C220S/PVA_/S267K/S364K/E357Q

SEQ ID NO: 44010 - protein, 117 aa, Artificial Sequence; identical to SEQ ID NO: 40840
  Description of Artificial Sequence: Synthetic polypeptide
  VH of XENCS518

SEQ ID NO: 44011 - protein, 112 aa, Artificial Sequence; identical to SEQ ID NO: 33009
  Description of Artificial Sequence: Synthetic polypeptide
  VL of XENCS518

SEQ ID NO: 44012 - protein, 231 aa, Artificial Sequence; identical to SEQ ID NO: 21532
  Description of Artificial Sequence: Synthetic polypeptide
  Fc chain of XENCS518

SEQ ID NO: 44013 - protein, 5 aa, Artificial Sequence
  Description of Artificial Sequence: Synthetic peptide
  XENCS518 vhCDR1
HYGIN

SEQ ID NO: 44014 - protein, 17 aa, Artificial Sequence
  Description of Artificial Sequence: Synthetic peptide
  XENCS518 vhCDR2
WINTYTGEPYYAPGFQE

SEQ ID NO: 44015 - protein, 8 aa, Artificial Sequence
  Description of Artificial Sequence: Synthetic peptide
  XENCS518 vhCDR3
DYYGSSPY

SEQ ID NO: 44016 - protein, 16 aa, Artificial Sequence
  Description of Artificial Sequence: Synthetic peptide
  XENCS518 vlCDR1
KSSQSIVHSNGNTYLE

SEQ ID NO: 44017 - protein, 7 aa, Artificial Sequence
  Description of Artificial Sequence: Synthetic peptide
  XENCS518 vlCDR2
KVSNRFS

SEQ ID NO: 44018 - protein, 9 aa, Artificial Sequence
  Description of Artificial Sequence: Synthetic peptide
  XENCS518 vlCDR3
FQGSHVPNT

SEQ ID NO: 44019 - protein, 214 aa, Artificial Sequence; identical to SEQ ID NO: 22279
  Description of Artificial Sequence: Synthetic polypeptide
  XenCS518 Chain 3 - 2A11_L2.142

SEQ ID NO: 44020 - protein, 107 aa, Artificial Sequence; identical to SEQ ID NO: 22280
  Description of Artificial Sequence: Synthetic polypeptide
  VL of XENCS518

SEQ ID NO: 44021 - protein, 11 aa, Artificial Sequence
  Description of Artificial Sequence: Synthetic peptide
  XENCS518 vlCDR1
QASQDIGNYLN

SEQ ID NO: 44022 - protein, 7 aa, Artificial Sequence
  Description of Artificial Sequence: Synthetic peptide
  XENCS518 vlCDR2
FTSYLHS

SEQ ID NO: 44023 - protein, 9 aa, Artificial Sequence
  Description of Artificial Sequence: Synthetic peptide
  XENCS518 vlCDR3
QQGNTLPYT

SEQ ID NO: 44024 - protein, 446 aa, Artificial Sequence; identical to SEQ ID NO: 43744
  Description of Artificial Sequence: Synthetic polypeptide
  XenCS519 Chain 1 - 3H3_H1_ IgG1_pI(-)_Isosteric_A_/PVA_ /S267K/L368D/K370S

SEQ ID NO: 44025 - protein, 117 aa, Artificial Sequence; identical to SEQ ID NO: 36368
  Description of Artificial Sequence: Synthetic polypeptide
  VH of XENCS519

SEQ ID NO: 44026 - protein, 5 aa, Artificial Sequence
  Description of Artificial Sequence: Synthetic peptide
  XENCS519 vhCDR1
GYGVN

SEQ ID NO: 44027 - protein, 16 aa, Artificial Sequence
  Description of Artificial Sequence: Synthetic peptide
  XENCS519 vhCDR2
MIWGDGSTDYNSALKS

SEQ ID NO: 44028 - protein, 9 aa, Artificial Sequence
  Description of Artificial Sequence: Synthetic peptide
  XENCS519 vhCDR3
SYYTSDEDY

SEQ ID NO: 44029 - protein, 480 aa, Artificial Sequence; identical to SEQ ID NO: 43929
  Description of Artificial Sequence: Synthetic polypeptide
  XenCS519 Chain 2 - 1C11[PD-1]_H3.241_L3.148_scFv(GKPGS)4_Fc(216)_ IgG1_C220S/PVA_/S267K/S364K/E357Q

SEQ ID NO: 44030 - protein, 117 aa, Artificial Sequence; identical to SEQ ID NO: 40840
  Description of Artificial Sequence: Synthetic polypeptide
  VH of XENCS519

SEQ ID NO: 44031 - protein, 112 aa, Artificial Sequence; identical to SEQ ID NO: 33009
  Description of Artificial Sequence: Synthetic polypeptide
  VL of XENCS519

SEQ ID NO: 44032 - protein, 231 aa, Artificial Sequence; identical to SEQ ID NO: 21532
  Description of Artificial Sequence: Synthetic polypeptide
  Fc chain of XENCS519

SEQ ID NO: 44033 - protein, 5 aa, Artificial Sequence
  Description of Artificial Sequence: Synthetic peptide
  XENCS519 vhCDR1
HYGIN

SEQ ID NO: 44034 - protein, 17 aa, Artificial Sequence
  Description of Artificial Sequence: Synthetic peptide
  XENCS519 vhCDR2
WINTYTGEPYYAPGFQE

SEQ ID NO: 44035 - protein, 8 aa, Artificial Sequence
  Description of Artificial Sequence: Synthetic peptide
  XENCS519 vhCDR3
DYYGSSPY

SEQ ID NO: 44036 - protein, 16 aa, Artificial Sequence
  Description of Artificial Sequence: Synthetic peptide
  XENCS519 vlCDR1
KSSQSIVHSNGNTYLE

SEQ ID NO: 44037 - protein, 7 aa, Artificial Sequence
  Description of Artificial Sequence: Synthetic peptide
  XENCS519 vlCDR2
KVSNRFS

SEQ ID NO: 44038 - protein, 9 aa, Artificial Sequence
  Description of Artificial Sequence: Synthetic peptide
  XENCS519 vlCDR3
FQGSHVPNT

SEQ ID NO: 44039 - protein, 219 aa, Artificial Sequence; identical to SEQ ID NO: 36512
  Description of Artificial Sequence: Synthetic polypeptide
  XenCS519 Chain 3 - 3H3_L2.1

SEQ ID NO: 44040 - protein, 112 aa, Artificial Sequence; identical to SEQ ID NO: 36513
  Description of Artificial Sequence: Synthetic polypeptide
  VL of XENCS519

SEQ ID NO: 44041 - protein, 17 aa, Artificial Sequence
  Description of Artificial Sequence: Synthetic peptide
  XENCS519 vlCDR1
KSSQSLLNSRTRKNYLA

SEQ ID NO: 44042 - protein, 7 aa, Artificial Sequence
  Description of Artificial Sequence: Synthetic peptide
  XENCS519 vlCDR2
WASTRES

SEQ ID NO: 44043 - protein, 8 aa, Artificial Sequence
  Description of Artificial Sequence: Synthetic peptide
  XENCS519 vlCDR3
KQSYSLRT

SEQ ID NO: 44044 - protein, 447 aa, Artificial Sequence; identical to SEQ ID NO: 23236
  Description of Artificial Sequence: Synthetic polypeptide
  XenCS520 Chain 1 - 9C6_H1.1_ IgG1_pI(-)_Isosteric_A_/PVA_ /S267K/L368D/K370S

SEQ ID NO: 44045 - protein, 118 aa, Artificial Sequence; identical to SEQ ID NO: 21205
  Description of Artificial Sequence: Synthetic polypeptide
  VH of XENCS520

SEQ ID NO: 44046 - protein, 5 aa, Artificial Sequence
  Description of Artificial Sequence: Synthetic peptide
  XENCS520 vhCDR1
GYGVN

SEQ ID NO: 44047 - protein, 16 aa, Artificial Sequence
  Description of Artificial Sequence: Synthetic peptide
  XENCS520 vhCDR2
MIWIDGSTDYNSKFQG

SEQ ID NO: 44048 - protein, 10 aa, Artificial Sequence
  Description of Artificial Sequence: Synthetic peptide
  XENCS520 vhCDR3
DRPDGRAMDY

SEQ ID NO: 44049 - protein, 480 aa, Artificial Sequence; identical to SEQ ID NO: 43929
  Description of Artificial Sequence: Synthetic polypeptide
  XenCS520 Chain 2 - 1C11[PD-1]_H3.241_L3.148_scFv(GKPGS)4_Fc(216)_ IgG1_C220S/PVA_/S267K/S364K/E357Q

SEQ ID NO: 44050 - protein, 117 aa, Artificial Sequence; identical to SEQ ID NO: 40840
  Description of Artificial Sequence: Synthetic polypeptide
  VH of XENCS520

SEQ ID NO: 44051 - protein, 112 aa, Artificial Sequence; identical to SEQ ID NO: 33009
  Description of Artificial Sequence: Synthetic polypeptide
  VL of XENCS520

SEQ ID NO: 44052 - protein, 231 aa, Artificial Sequence; identical to SEQ ID NO: 21532
  Description of Artificial Sequence: Synthetic polypeptide
  Fc chain of XENCS520

SEQ ID NO: 44053 - protein, 5 aa, Artificial Sequence
  Description of Artificial Sequence: Synthetic peptide
  XENCS520 vhCDR1
HYGIN

SEQ ID NO: 44054 - protein, 17 aa, Artificial Sequence
  Description of Artificial Sequence: Synthetic peptide
  XENCS520 vhCDR2
WINTYTGEPYYAPGFQE

SEQ ID NO: 44055 - protein, 8 aa, Artificial Sequence
  Description of Artificial Sequence: Synthetic peptide
  XENCS520 vhCDR3
DYYGSSPY

SEQ ID NO: 44056 - protein, 16 aa, Artificial Sequence
  Description of Artificial Sequence: Synthetic peptide
  XENCS520 vlCDR1
KSSQSIVHSNGNTYLE

SEQ ID NO: 44057 - protein, 7 aa, Artificial Sequence
  Description of Artificial Sequence: Synthetic peptide
  XENCS520 vlCDR2
KVSNRFS

SEQ ID NO: 44058 - protein, 9 aa, Artificial Sequence
  Description of Artificial Sequence: Synthetic peptide
  XENCS520 vlCDR3
FQGSHVPNT

SEQ ID NO: 44059 - protein, 213 aa, Artificial Sequence; identical to SEQ ID NO: 21050
  Description of Artificial Sequence: Synthetic polypeptide
  XenCS520 Chain 3 - 9C6_L1

SEQ ID NO: 44060 - protein, 106 aa, Artificial Sequence; identical to SEQ ID NO: 21051
  Description of Artificial Sequence: Synthetic polypeptide
  VL of XENCS520

SEQ ID NO: 44061 - protein, 11 aa, Artificial Sequence
  Description of Artificial Sequence: Synthetic peptide
  XENCS520 vlCDR1
KASQSVSNDVA

SEQ ID NO: 44062 - protein, 7 aa, Artificial Sequence
  Description of Artificial Sequence: Synthetic peptide
  XENCS520 vlCDR2
YASNRYT

SEQ ID NO: 44063 - protein, 8 aa, Artificial Sequence
  Description of Artificial Sequence: Synthetic peptide
  XENCS520 vlCDR3
QQDYSSPT

SEQ ID NO: 44064 - protein, 454 aa, Artificial Sequence; identical to SEQ ID NO: 43644
  Description of Artificial Sequence: Synthetic polypeptide
  XenCS521 Chain 1 - [ICOS]_H0_ IgG1_pI(-)_Isosteric_A_/PVA_ /S267K/L368D/K370S

SEQ ID NO: 44065 - protein, 125 aa, Artificial Sequence; identical to SEQ ID NO: 43645
  Description of Artificial Sequence: Synthetic polypeptide
  VH of XENCS521

SEQ ID NO: 44066 - protein, 5 aa, Artificial Sequence
  Description of Artificial Sequence: Synthetic peptide
  XENCS521 vhCDR1
GYYMH

SEQ ID NO: 44067 - protein, 17 aa, Artificial Sequence
  Description of Artificial Sequence: Synthetic peptide
  XENCS521 vhCDR2
WINPHSGGTNYAQKFQG

SEQ ID NO: 44068 - protein, 16 aa, Artificial Sequence
  Description of Artificial Sequence: Synthetic peptide
  XENCS521 vhCDR3
TYYYDSSGYYHDAFDI

SEQ ID NO: 44069 - protein, 480 aa, Artificial Sequence
  Description of Artificial Sequence: Synthetic polypeptide
  XenCS521 Chain 2 - 1C11[PD-1]_H3.241_L3.92_scFv(GKPGS)4_Fc(216)_ IgG1_C220S/PVA_/S267K/S364K/E357Q
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44070 - protein, 117 aa, Artificial Sequence; identical to SEQ ID NO: 40840
  Description of Artificial Sequence: Synthetic polypeptide
  VH of XENCS521

SEQ ID NO: 44071 - protein, 112 aa, Artificial Sequence; identical to SEQ ID NO: 39932
  Description of Artificial Sequence: Synthetic polypeptide
  VL of XENCS521

SEQ ID NO: 44072 - protein, 231 aa, Artificial Sequence; identical to SEQ ID NO: 21532
  Description of Artificial Sequence: Synthetic polypeptide
  Fc chain of XENCS521

SEQ ID NO: 44073 - protein, 5 aa, Artificial Sequence
  Description of Artificial Sequence: Synthetic peptide
  XENCS521 vhCDR1
HYGIN

SEQ ID NO: 44074 - protein, 17 aa, Artificial Sequence
  Description of Artificial Sequence: Synthetic peptide
  XENCS521 vhCDR2
WINTYTGEPYYAPGFQE

SEQ ID NO: 44075 - protein, 8 aa, Artificial Sequence
  Description of Artificial Sequence: Synthetic peptide
  XENCS521 vhCDR3
DYYGSSPY

SEQ ID NO: 44076 - protein, 16 aa, Artificial Sequence
  Description of Artificial Sequence: Synthetic peptide
  XENCS521 vlCDR1
KASQSIVHSNGNTYLE

SEQ ID NO: 44077 - protein, 7 aa, Artificial Sequence
  Description of Artificial Sequence: Synthetic peptide
  XENCS521 vlCDR2
KVSNRFT

SEQ ID NO: 44078 - protein, 9 aa, Artificial Sequence
  Description of Artificial Sequence: Synthetic peptide
  XENCS521 vlCDR3
FQGSHVPNT

SEQ ID NO: 44079 - protein, 214 aa, Artificial Sequence; identical to SEQ ID NO: 43659
  Description of Artificial Sequence: Synthetic polypeptide
  XenCS521 Chain 3 - [ICOS]_L0

SEQ ID NO: 44080 - protein, 107 aa, Artificial Sequence; identical to SEQ ID NO: 43660
  Description of Artificial Sequence: Synthetic polypeptide
  VL of XENCS521

SEQ ID NO: 44081 - protein, 11 aa, Artificial Sequence
  Description of Artificial Sequence: Synthetic peptide
  XENCS521 vlCDR1
RASQGISRLLA

SEQ ID NO: 44082 - protein, 7 aa, Artificial Sequence
  Description of Artificial Sequence: Synthetic peptide
  XENCS521 vlCDR2
VASSLQS

SEQ ID NO: 44083 - protein, 9 aa, Artificial Sequence
  Description of Artificial Sequence: Synthetic peptide
  XENCS521 vlCDR3
QQANSFPWT

SEQ ID NO: 44084 - protein, 454 aa, Artificial Sequence; identical to SEQ ID NO: 43664
  Description of Artificial Sequence: Synthetic polypeptide
  XenCS522 Chain 1 - [ICOS]_H0.66_ IgG1_pI(-)_Isosteric_A_/PVA_ /S267K/L368D/K370S

SEQ ID NO: 44085 - protein, 125 aa, Artificial Sequence; identical to SEQ ID NO: 43665
  Description of Artificial Sequence: Synthetic polypeptide
  VH of XENCS522

SEQ ID NO: 44086 - protein, 5 aa, Artificial Sequence
  Description of Artificial Sequence: Synthetic peptide
  XENCS522 vhCDR1
GYYMH

SEQ ID NO: 44087 - protein, 17 aa, Artificial Sequence
  Description of Artificial Sequence: Synthetic peptide
  XENCS522 vhCDR2
WINPHSGETIYAQKFQG

SEQ ID NO: 44088 - protein, 16 aa, Artificial Sequence
  Description of Artificial Sequence: Synthetic peptide
  XENCS522 vhCDR3
TYYYDTSGYYHDAFDV

SEQ ID NO: 44089 - protein, 480 aa, Artificial Sequence; identical to SEQ ID NO: 44069
  Description of Artificial Sequence: Synthetic polypeptide
  XenCS522 Chain 2 - 1C11[PD-1]_H3.241_L3.92_scFv(GKPGS)4_Fc(216)_ IgG1_C220S/PVA_/S267K/S364K/E357Q

SEQ ID NO: 44090 - protein, 117 aa, Artificial Sequence; identical to SEQ ID NO: 40840
  Description of Artificial Sequence: Synthetic polypeptide
  VH of XENCS522

SEQ ID NO: 44091 - protein, 112 aa, Artificial Sequence; identical to SEQ ID NO: 39932
  Description of Artificial Sequence: Synthetic polypeptide
  VL of XENCS522

SEQ ID NO: 44092 - protein, 231 aa, Artificial Sequence; identical to SEQ ID NO: 21532
  Description of Artificial Sequence: Synthetic polypeptide
  Fc chain of XENCS522

SEQ ID NO: 44093 - protein, 5 aa, Artificial Sequence
  Description of Artificial Sequence: Synthetic peptide
  XENCS522 vhCDR1
HYGIN

SEQ ID NO: 44094 - protein, 17 aa, Artificial Sequence
  Description of Artificial Sequence: Synthetic peptide
  XENCS522 vhCDR2
WINTYTGEPYYAPGFQE

SEQ ID NO: 44095 - protein, 8 aa, Artificial Sequence
  Description of Artificial Sequence: Synthetic peptide
  XENCS522 vhCDR3
DYYGSSPY

SEQ ID NO: 44096 - protein, 16 aa, Artificial Sequence
  Description of Artificial Sequence: Synthetic peptide
  XENCS522 vlCDR1
KASQSIVHSNGNTYLE

SEQ ID NO: 44097 - protein, 7 aa, Artificial Sequence
  Description of Artificial Sequence: Synthetic peptide
  XENCS522 vlCDR2
KVSNRFT

SEQ ID NO: 44098 - protein, 9 aa, Artificial Sequence
  Description of Artificial Sequence: Synthetic peptide
  XENCS522 vlCDR3
FQGSHVPNT

SEQ ID NO: 44099 - protein, 214 aa, Artificial Sequence; identical to SEQ ID NO: 43659
  Description of Artificial Sequence: Synthetic polypeptide
  XenCS522 Chain 3 - [ICOS]_L0

SEQ ID NO: 44100 - protein, 107 aa, Artificial Sequence; identical to SEQ ID NO: 43660
  Description of Artificial Sequence: Synthetic polypeptide
  VL of XENCS522

SEQ ID NO: 44101 - protein, 11 aa, Artificial Sequence
  Description of Artificial Sequence: Synthetic peptide
  XENCS522 vlCDR1
RASQGISRLLA

SEQ ID NO: 44102 - protein, 7 aa, Artificial Sequence
  Description of Artificial Sequence: Synthetic peptide
  XENCS522 vlCDR2
VASSLQS

SEQ ID NO: 44103 - protein, 9 aa, Artificial Sequence
  Description of Artificial Sequence: Synthetic peptide
  XENCS522 vlCDR3
QQANSFPWT

SEQ ID NO: 44104 - protein, 447 aa, Artificial Sequence; identical to SEQ ID NO: 23356
  Description of Artificial Sequence: Synthetic polypeptide
  XenCS523 Chain 1 - [CTLA-4]_H3_ IgG1_pI(-)_Isosteric_A_/PVA_ /S267K/L368D/K370S

SEQ ID NO: 44105 - protein, 118 aa, Artificial Sequence; identical to SEQ ID NO: 139
  Description of Artificial Sequence: Synthetic polypeptide
  VH of XENCS523

SEQ ID NO: 44106 - protein, 5 aa, Artificial Sequence
  Description of Artificial Sequence: Synthetic peptide
  XENCS523 vhCDR1
SYTMH

SEQ ID NO: 44107 - protein, 17 aa, Artificial Sequence
  Description of Artificial Sequence: Synthetic peptide
  XENCS523 vhCDR2
FISYDGNNKYYADSVKG

SEQ ID NO: 44108 - protein, 9 aa, Artificial Sequence
  Description of Artificial Sequence: Synthetic peptide
  XENCS523 vhCDR3
TGWLGPFDY

SEQ ID NO: 44109 - protein, 480 aa, Artificial Sequence; identical to SEQ ID NO: 44069
  Description of Artificial Sequence: Synthetic polypeptide
  XenCS523 Chain 2 - 1C11[PD-1]_H3.241_L3.92_scFv(GKPGS)4_Fc(216)_ IgG1_C220S/PVA_/S267K/S364K/E357Q

SEQ ID NO: 44110 - protein, 117 aa, Artificial Sequence; identical to SEQ ID NO: 40840
  Description of Artificial Sequence: Synthetic polypeptide
  VH of XENCS523

SEQ ID NO: 44111 - protein, 112 aa, Artificial Sequence; identical to SEQ ID NO: 39932
  Description of Artificial Sequence: Synthetic polypeptide
  VL of XENCS523

SEQ ID NO: 44112 - protein, 231 aa, Artificial Sequence; identical to SEQ ID NO: 21532
  Description of Artificial Sequence: Synthetic polypeptide
  Fc chain of XENCS523

SEQ ID NO: 44113 - protein, 5 aa, Artificial Sequence
  Description of Artificial Sequence: Synthetic peptide
  XENCS523 vhCDR1
HYGIN

SEQ ID NO: 44114 - protein, 17 aa, Artificial Sequence
  Description of Artificial Sequence: Synthetic peptide
  XENCS523 vhCDR2
WINTYTGEPYYAPGFQE

SEQ ID NO: 44115 - protein, 8 aa, Artificial Sequence
  Description of Artificial Sequence: Synthetic peptide
  XENCS523 vhCDR3
DYYGSSPY

SEQ ID NO: 44116 - protein, 16 aa, Artificial Sequence
  Description of Artificial Sequence: Synthetic peptide
  XENCS523 vlCDR1
KASQSIVHSNGNTYLE

SEQ ID NO: 44117 - protein, 7 aa, Artificial Sequence
  Description of Artificial Sequence: Synthetic peptide
  XENCS523 vlCDR2
KVSNRFT

SEQ ID NO: 44118 - protein, 9 aa, Artificial Sequence
  Description of Artificial Sequence: Synthetic peptide
  XENCS523 vlCDR3
FQGSHVPNT

SEQ ID NO: 44119 - protein, 215 aa, Artificial Sequence; identical to SEQ ID NO: 4504
  Description of Artificial Sequence: Synthetic polypeptide
  XenCS523 Chain 3 - [CTLA-4]_L0.22

SEQ ID NO: 44120 - protein, 108 aa, Artificial Sequence; identical to SEQ ID NO: 1607
  Description of Artificial Sequence: Synthetic polypeptide
  VL of XENCS523

SEQ ID NO: 44121 - protein, 12 aa, Artificial Sequence
  Description of Artificial Sequence: Synthetic peptide
  XENCS523 vlCDR1
RASQSVSSSYLA

SEQ ID NO: 44122 - protein, 7 aa, Artificial Sequence
  Description of Artificial Sequence: Synthetic peptide
  XENCS523 vlCDR2
GAFSRAT

SEQ ID NO: 44123 - protein, 9 aa, Artificial Sequence
  Description of Artificial Sequence: Synthetic peptide
  XENCS523 vlCDR3
QQYGSSPWT

SEQ ID NO: 44124 - protein, 450 aa, Artificial Sequence; identical to SEQ ID NO: 22484
  Description of Artificial Sequence: Synthetic polypeptide
  XenCS524 Chain 1 - 7G8_H3.30_ IgG1_pI(-)_Isosteric_A_/PVA_ /S267K/L368D/K370S

SEQ ID NO: 44125 - protein, 121 aa, Artificial Sequence; identical to SEQ ID NO: 22485
  Description of Artificial Sequence: Synthetic polypeptide
  VH of XENCS524

SEQ ID NO: 44126 - protein, 5 aa, Artificial Sequence
  Description of Artificial Sequence: Synthetic peptide
  XENCS524 vhCDR1
DAWMS

SEQ ID NO: 44127 - protein, 19 aa, Artificial Sequence
  Description of Artificial Sequence: Synthetic peptide
  XENCS524 vhCDR2
EISTKANNHATYYAESVKG

SEQ ID NO: 44128 - protein, 10 aa, Artificial Sequence
  Description of Artificial Sequence: Synthetic peptide
  XENCS524 vhCDR3
LATWDWYFDV

SEQ ID NO: 44129 - protein, 480 aa, Artificial Sequence; identical to SEQ ID NO: 44069
  Description of Artificial Sequence: Synthetic polypeptide
  XenCS524 Chain 2 -1C11[PD-1]_H3.241_L3.92_scFv(GKPGS)4_Fc(216)_ IgG1_C220S/PVA_/S267K/S364K/E357Q

SEQ ID NO: 44130 - protein, 117 aa, Artificial Sequence; identical to SEQ ID NO: 40840
  Description of Artificial Sequence: Synthetic polypeptide
  VH of XENCS524

SEQ ID NO: 44131 - protein, 112 aa, Artificial Sequence; identical to SEQ ID NO: 39932
  Description of Artificial Sequence: Synthetic polypeptide
  VL of XENCS524

SEQ ID NO: 44132 - protein, 231 aa, Artificial Sequence; identical to SEQ ID NO: 21532
  Description of Artificial Sequence: Synthetic polypeptide
  Fc chain of XENCS524

SEQ ID NO: 44133 - protein, 5 aa, Artificial Sequence
  Description of Artificial Sequence: Synthetic peptide
  XENCS524 vhCDR1
HYGIN

SEQ ID NO: 44134 - protein, 17 aa, Artificial Sequence
  Description of Artificial Sequence: Synthetic peptide
  XENCS524 vhCDR2
WINTYTGEPYYAPGFQE

SEQ ID NO: 44135 - protein, 8 aa, Artificial Sequence
  Description of Artificial Sequence: Synthetic peptide
  XENCS524 vhCDR3
DYYGSSPY

SEQ ID NO: 44136 - protein, 16 aa, Artificial Sequence
  Description of Artificial Sequence: Synthetic peptide
  XENCS524 vlCDR1
KASQSIVHSNGNTYLE

SEQ ID NO: 44137 - protein, 7 aa, Artificial Sequence
  Description of Artificial Sequence: Synthetic peptide
  XENCS524 vlCDR2
KVSNRFT

SEQ ID NO: 44138 - protein, 9 aa, Artificial Sequence
  Description of Artificial Sequence: Synthetic peptide
  XENCS524 vlCDR3
FQGSHVPNT

SEQ ID NO: 44139 - protein, 218 aa, Artificial Sequence; identical to SEQ ID NO: 22599
  Description of Artificial Sequence: Synthetic polypeptide
  XenCS524 Chain 3 - 7G8_L1.34

SEQ ID NO: 44140 - protein, 111 aa, Artificial Sequence; identical to SEQ ID NO: 22600
  Description of Artificial Sequence: Synthetic polypeptide
  VL of XENCS524

SEQ ID NO: 44141 - protein, 15 aa, Artificial Sequence
  Description of Artificial Sequence: Synthetic peptide
  XENCS524 vlCDR1
RASQSVDYDGDSYMN

SEQ ID NO: 44142 - protein, 7 aa, Artificial Sequence
  Description of Artificial Sequence: Synthetic peptide
  XENCS524 vlCDR2
AASELES

SEQ ID NO: 44143 - protein, 9 aa, Artificial Sequence
  Description of Artificial Sequence: Synthetic peptide
  XENCS524 vlCDR3
QQSNEDPFT

SEQ ID NO: 44144 - protein, 447 aa, Artificial Sequence; identical to SEQ ID NO: 22084
  Description of Artificial Sequence: Synthetic polypeptide
  XenCS525 Chain 1 - 2A11_H1.144_ IgG1_pI(-)_Isosteric_A_/PVA_ /S267K/L368D/K370S

SEQ ID NO: 44145 - protein, 118 aa, Artificial Sequence; identical to SEQ ID NO: 22085
  Description of Artificial Sequence: Synthetic polypeptide
  VH of XENCS525

SEQ ID NO: 44146 - protein, 5 aa, Artificial Sequence
  Description of Artificial Sequence: Synthetic peptide
  XENCS525 vhCDR1
DYFMH

SEQ ID NO: 44147 - protein, 17 aa, Artificial Sequence
  Description of Artificial Sequence: Synthetic peptide
  XENCS525 vhCDR2
WIDPELGDTEYAPKFQG

SEQ ID NO: 44148 - protein, 9 aa, Artificial Sequence
  Description of Artificial Sequence: Synthetic peptide
  XENCS525 vhCDR3
RGVYQALDY

SEQ ID NO: 44149 - protein, 480 aa, Artificial Sequence; identical to SEQ ID NO: 44069
  Description of Artificial Sequence: Synthetic polypeptide
  XenCS525 Chain 2 - 1C11[PD-1]_H3.241_L3.92_scFv(GKPGS)4_Fc(216)_ IgG1_C220S/PVA_/S267K/S364K/E357Q

SEQ ID NO: 44150 - protein, 117 aa, Artificial Sequence; identical to SEQ ID NO: 40840
  Description of Artificial Sequence: Synthetic polypeptide
  VH of XENCS525

SEQ ID NO: 44151 - protein, 112 aa, Artificial Sequence; identical to SEQ ID NO: 39932
  Description of Artificial Sequence: Synthetic polypeptide
  VL of XENCS525

SEQ ID NO: 44152 - protein, 231 aa, Artificial Sequence; identical to SEQ ID NO: 21532
  Description of Artificial Sequence: Synthetic polypeptide
  Fc chain of XENCS525

SEQ ID NO: 44153 - protein, 5 aa, Artificial Sequence
  Description of Artificial Sequence: Synthetic peptide
  XENCS525 vhCDR1
HYGIN

SEQ ID NO: 44154 - protein, 17 aa, Artificial Sequence
  Description of Artificial Sequence: Synthetic peptide
  XENCS525 vhCDR2
WINTYTGEPYYAPGFQE

SEQ ID NO: 44155 - protein, 8 aa, Artificial Sequence
  Description of Artificial Sequence: Synthetic peptide
  XENCS525 vhCDR3
DYYGSSPY

SEQ ID NO: 44156 - protein, 16 aa, Artificial Sequence
  Description of Artificial Sequence: Synthetic peptide
  XENCS525 vlCDR1
KASQSIVHSNGNTYLE

SEQ ID NO: 44157 - protein, 7 aa, Artificial Sequence
  Description of Artificial Sequence: Synthetic peptide
  XENCS525 vlCDR2
KVSNRFT

SEQ ID NO: 44158 - protein, 9 aa, Artificial Sequence
  Description of Artificial Sequence: Synthetic peptide
  XENCS525 vlCDR3
FQGSHVPNT

SEQ ID NO: 44159 - protein, 214 aa, Artificial Sequence; identical to SEQ ID NO: 22279
  Description of Artificial Sequence: Synthetic polypeptide
  XenCS525 Chain 3 - 2A11_L2.142

SEQ ID NO: 44160 - protein, 107 aa, Artificial Sequence; identical to SEQ ID NO: 22280
  Description of Artificial Sequence: Synthetic polypeptide
  VL of XENCS525

SEQ ID NO: 44161 - protein, 11 aa, Artificial Sequence
  Description of Artificial Sequence: Synthetic peptide
  XENCS525 vlCDR1
QASQDIGNYLN

SEQ ID NO: 44162 - protein, 7 aa, Artificial Sequence
  Description of Artificial Sequence: Synthetic peptide
  XENCS525 vlCDR2
FTSYLHS

SEQ ID NO: 44163 - protein, 9 aa, Artificial Sequence
  Description of Artificial Sequence: Synthetic peptide
  XENCS525 vlCDR3
QQGNTLPYT

SEQ ID NO: 44164 - protein, 446 aa, Artificial Sequence; identical to SEQ ID NO: 43744
  Description of Artificial Sequence: Synthetic polypeptide
  XenCS526 Chain 1 - 3H3_H1_ IgG1_pI(-)_Isosteric_A_/PVA_ /S267K/L368D/K370S

SEQ ID NO: 44165 - protein, 117 aa, Artificial Sequence; identical to SEQ ID NO: 36368
  Description of Artificial Sequence: Synthetic polypeptide
  VH of XENCS526

SEQ ID NO: 44166 - protein, 5 aa, Artificial Sequence
  Description of Artificial Sequence: Synthetic peptide
  XENCS526 vhCDR1
GYGVN

SEQ ID NO: 44167 - protein, 16 aa, Artificial Sequence
  Description of Artificial Sequence: Synthetic peptide
  XENCS526 vhCDR2
MIWGDGSTDYNSALKS

SEQ ID NO: 44168 - protein, 9 aa, Artificial Sequence
  Description of Artificial Sequence: Synthetic peptide
  XENCS526 vhCDR3
SYYTSDEDY

SEQ ID NO: 44169 - protein, 480 aa, Artificial Sequence; identical to SEQ ID NO: 44069
  Description of Artificial Sequence: Synthetic polypeptide
  XenCS526 Chain 2 - 1C11[PD-1]_H3.241_L3.92_scFv(GKPGS)4_Fc(216)_ IgG1_C220S/PVA_/S267K/S364K/E357Q

SEQ ID NO: 44170 - protein, 117 aa, Artificial Sequence; identical to SEQ ID NO: 40840
  Description of Artificial Sequence: Synthetic polypeptide
  VH of XENCS526

SEQ ID NO: 44171 - protein, 112 aa, Artificial Sequence; identical to SEQ ID NO: 39932
  Description of Artificial Sequence: Synthetic polypeptide
  VL of XENCS526

SEQ ID NO: 44172 - protein, 231 aa, Artificial Sequence; identical to SEQ ID NO: 21532
  Description of Artificial Sequence: Synthetic polypeptide
  Fc chain of XENCS526

SEQ ID NO: 44173 - protein, 5 aa, Artificial Sequence
  Description of Artificial Sequence: Synthetic peptide
  XENCS526 vhCDR1
HYGIN

SEQ ID NO: 44174 - protein, 17 aa, Artificial Sequence
  Description of Artificial Sequence: Synthetic peptide
  XENCS526 vhCDR2
WINTYTGEPYYAPGFQE

SEQ ID NO: 44175 - protein, 8 aa, Artificial Sequence
  Description of Artificial Sequence: Synthetic peptide
  XENCS526 vhCDR3
DYYGSSPY

SEQ ID NO: 44176 - protein, 16 aa, Artificial Sequence
  Description of Artificial Sequence: Synthetic peptide
  XENCS526 vlCDR1
KASQSIVHSNGNTYLE

SEQ ID NO: 44177 - protein, 7 aa, Artificial Sequence
  Description of Artificial Sequence: Synthetic peptide
  XENCS526 vlCDR2
KVSNRFT

SEQ ID NO: 44178 - protein, 9 aa, Artificial Sequence
  Description of Artificial Sequence: Synthetic peptide
  XENCS526 vlCDR3
FQGSHVPNT

SEQ ID NO: 44179 - protein, 219 aa, Artificial Sequence; identical to SEQ ID NO: 36512
  Description of Artificial Sequence: Synthetic polypeptide
  XenCS526 Chain 3 - 3H3_L2.1

SEQ ID NO: 44180 - protein, 112 aa, Artificial Sequence; identical to SEQ ID NO: 36513
  Description of Artificial Sequence: Synthetic polypeptide
  VL of XENCS526

SEQ ID NO: 44181 - protein, 17 aa, Artificial Sequence
  Description of Artificial Sequence: Synthetic peptide
  XENCS526 vlCDR1
KSSQSLLNSRTRKNYLA

SEQ ID NO: 44182 - protein, 7 aa, Artificial Sequence
  Description of Artificial Sequence: Synthetic peptide
  XENCS526 vlCDR2
WASTRES

SEQ ID NO: 44183 - protein, 8 aa, Artificial Sequence
  Description of Artificial Sequence: Synthetic peptide
  XENCS526 vlCDR3
KQSYSLRT

SEQ ID NO: 44184 - protein, 447 aa, Artificial Sequence; identical to SEQ ID NO: 23236
  Description of Artificial Sequence: Synthetic polypeptide
  XenCS527 Chain 1 - 9C6_H1.1_ IgG1_pI(-)_Isosteric_A_/PVA_ /S267K/L368D/K370S

SEQ ID NO: 44185 - protein, 118 aa, Artificial Sequence; identical to SEQ ID NO: 21205
  Description of Artificial Sequence: Synthetic polypeptide
  VH of XENCS527

SEQ ID NO: 44186 - protein, 5 aa, Artificial Sequence
  Description of Artificial Sequence: Synthetic peptide
  XENCS527 vhCDR1
GYGVN

SEQ ID NO: 44187 - protein, 16 aa, Artificial Sequence
  Description of Artificial Sequence: Synthetic peptide
  XENCS527 vhCDR2
MIWIDGSTDYNSKFQG

SEQ ID NO: 44188 - protein, 10 aa, Artificial Sequence
  Description of Artificial Sequence: Synthetic peptide
  XENCS527 vhCDR3
DRPDGRAMDY

SEQ ID NO: 44189 - protein, 480 aa, Artificial Sequence; identical to SEQ ID NO: 44069
  Description of Artificial Sequence: Synthetic polypeptide
  XenCS527 Chain 2 - 1C11[PD-1]_H3.241_L3.92_scFv(GKPGS)4_Fc(216)_ IgG1_C220S/PVA_/S267K/S364K/E357Q

SEQ ID NO: 44190 - protein, 117 aa, Artificial Sequence; identical to SEQ ID NO: 40840
  Description of Artificial Sequence: Synthetic polypeptide
  VH of XENCS527

SEQ ID NO: 44191 - protein, 112 aa, Artificial Sequence; identical to SEQ ID NO: 39932
  Description of Artificial Sequence: Synthetic polypeptide
  VL of XENCS527

SEQ ID NO: 44192 - protein, 231 aa, Artificial Sequence; identical to SEQ ID NO: 21532
  Description of Artificial Sequence: Synthetic polypeptide
  Fc chain of XENCS527

SEQ ID NO: 44193 - protein, 5 aa, Artificial Sequence
  Description of Artificial Sequence: Synthetic peptide
  XENCS527 vhCDR1
HYGIN

SEQ ID NO: 44194 - protein, 17 aa, Artificial Sequence
  Description of Artificial Sequence: Synthetic peptide
  XENCS527 vhCDR2
WINTYTGEPYYAPGFQE

SEQ ID NO: 44195 - protein, 8 aa, Artificial Sequence
  Description of Artificial Sequence: Synthetic peptide
  XENCS527 vhCDR3
DYYGSSPY

SEQ ID NO: 44196 - protein, 16 aa, Artificial Sequence
  Description of Artificial Sequence: Synthetic peptide
  XENCS527 vlCDR1
KASQSIVHSNGNTYLE

SEQ ID NO: 44197 - protein, 7 aa, Artificial Sequence
  Description of Artificial Sequence: Synthetic peptide
  XENCS527 vlCDR2
KVSNRFT

SEQ ID NO: 44198 - protein, 9 aa, Artificial Sequence
  Description of Artificial Sequence: Synthetic peptide
  XENCS527 vlCDR3
FQGSHVPNT

SEQ ID NO: 44199 - protein, 213 aa, Artificial Sequence; identical to SEQ ID NO: 21050
  Description of Artificial Sequence: Synthetic polypeptide
  XenCS527 Chain 3 - 9C6_L1

SEQ ID NO: 44200 - protein, 106 aa, Artificial Sequence; identical to SEQ ID NO: 21051
  Description of Artificial Sequence: Synthetic polypeptide
  VL of XENCS527

SEQ ID NO: 44201 - protein, 11 aa, Artificial Sequence
  Description of Artificial Sequence: Synthetic peptide
  XENCS527 vlCDR1
KASQSVSNDVA

SEQ ID NO: 44202 - protein, 7 aa, Artificial Sequence
  Description of Artificial Sequence: Synthetic peptide
  XENCS527 vlCDR2
YASNRYT

SEQ ID NO: 44203 - protein, 8 aa, Artificial Sequence
  Description of Artificial Sequence: Synthetic peptide
  XENCS527 vlCDR3
QQDYSSPT

SEQ ID NO: 44204 - protein, 454 aa, Artificial Sequence
  Description of Artificial Sequence: Synthetic polypeptide
  XenCS528 Chain 1 - [ICOS]_H0_ IgG1_pI(-)_Isosteric_A_/PVA_ /S267K/L368D/K370S/M428L/N434S
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 44205 - protein, 125 aa, Artificial Sequence; identical to SEQ ID NO: 43645
  Description of Artificial Sequence: Synthetic polypeptide
  VH of XENCS528

SEQ ID NO: 44206 - protein, 5 aa, Artificial Sequence
  Description of Artificial Sequence: Synthetic peptide
  XENCS528 vhCDR1
GYYMH

SEQ ID NO: 44207 - protein, 17 aa, Artificial Sequence
  Description of Artificial Sequence: Synthetic peptide
  XENCS528 vhCDR2
WINPHSGGTNYAQKFQG

SEQ ID NO: 44208 - protein, 16 aa, Artificial Sequence
  Description of Artificial Sequence: Synthetic peptide
  XENCS528 vhCDR3
TYYYDSSGYYHDAFDI

SEQ ID NO: 44209 - protein, 480 aa, Artificial Sequence
  Description of Artificial Sequence: Synthetic polypeptide
  XenCS528 Chain 2 - 1C11[PD-1]_H3.234_L3.144_scFv(GKPGS)4_Fc(216)_ IgG1_C220S/PVA_/S267K/S364K/E357Q/M428L/N434S
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 44210 - protein, 117 aa, Artificial Sequence; identical to SEQ ID NO: 40669
  Description of Artificial Sequence: Synthetic polypeptide
  VH of XENCS528

SEQ ID NO: 44211 - protein, 112 aa, Artificial Sequence; identical to SEQ ID NO: 40517
  Description of Artificial Sequence: Synthetic polypeptide
  VL of XENCS528

SEQ ID NO: 44212 - protein, 231 aa, Artificial Sequence; identical to SEQ ID NO: 21572
  Description of Artificial Sequence: Synthetic polypeptide
  Fc chain of XENCS528

SEQ ID NO: 44213 - protein, 5 aa, Artificial Sequence
  Description of Artificial Sequence: Synthetic peptide
  XENCS528 vhCDR1
HYGIN

SEQ ID NO: 44214 - protein, 17 aa, Artificial Sequence
  Description of Artificial Sequence: Synthetic peptide
  XENCS528 vhCDR2
WINTYTGEPYYAPGFQE

SEQ ID NO: 44215 - protein, 8 aa, Artificial Sequence
  Description of Artificial Sequence: Synthetic peptide
  XENCS528 vhCDR3
DYYGSSPY

SEQ ID NO: 44216 - protein, 16 aa, Artificial Sequence
  Description of Artificial Sequence: Synthetic peptide
  XENCS528 vlCDR1
KASQSIVHSNGNTYLE

SEQ ID NO: 44217 - protein, 7 aa, Artificial Sequence
  Description of Artificial Sequence: Synthetic peptide
  XENCS528 vlCDR2
KVSNRFS

SEQ ID NO: 44218 - protein, 9 aa, Artificial Sequence
  Description of Artificial Sequence: Synthetic peptide
  XENCS528 vlCDR3
FQGSHVPNT

SEQ ID NO: 44219 - protein, 214 aa, Artificial Sequence; identical to SEQ ID NO: 43659
  Description of Artificial Sequence: Synthetic polypeptide
  XenCS528 Chain 3 - [ICOS]_L0

SEQ ID NO: 44220 - protein, 107 aa, Artificial Sequence; identical to SEQ ID NO: 43660
  Description of Artificial Sequence: Synthetic polypeptide
  VL of XENCS528

SEQ ID NO: 44221 - protein, 11 aa, Artificial Sequence
  Description of Artificial Sequence: Synthetic peptide
  XENCS528 vlCDR1
RASQGISRLLA

SEQ ID NO: 44222 - protein, 7 aa, Artificial Sequence
  Description of Artificial Sequence: Synthetic peptide
  XENCS528 vlCDR2
VASSLQS

SEQ ID NO: 44223 - protein, 9 aa, Artificial Sequence
  Description of Artificial Sequence: Synthetic peptide
  XENCS528 vlCDR3
QQANSFPWT

SEQ ID NO: 44224 - protein, 454 aa, Artificial Sequence
  Description of Artificial Sequence: Synthetic polypeptide
  XenCS529 Chain 1 - [ICOS]_H0.66_ IgG1_pI(-)_Isosteric_A_/PVA_ /S267K/L368D/K370S/M428L/N434S
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 44225 - protein, 125 aa, Artificial Sequence; identical to SEQ ID NO: 43665
  Description of Artificial Sequence: Synthetic polypeptide
  VH of XENCS529

SEQ ID NO: 44226 - protein, 5 aa, Artificial Sequence
  Description of Artificial Sequence: Synthetic peptide
  XENCS529 vhCDR1
GYYMH

SEQ ID NO: 44227 - protein, 17 aa, Artificial Sequence
  Description of Artificial Sequence: Synthetic peptide
  XENCS529 vhCDR2
WINPHSGETIYAQKFQG

SEQ ID NO: 44228 - protein, 16 aa, Artificial Sequence
  Description of Artificial Sequence: Synthetic peptide
  XENCS529 vhCDR3
TYYYDTSGYYHDAFDV

SEQ ID NO: 44229 - protein, 480 aa, Artificial Sequence; identical to SEQ ID NO: 44209
  Description of Artificial Sequence: Synthetic polypeptide
  XenCS529 Chain 2 - 1C11[PD-1]_H3.234_L3.144_scFv(GKPGS)4_Fc(216)_ IgG1_C220S/PVA_/S267K/S364K/E357Q/M428L/N434S

SEQ ID NO: 44230 - protein, 117 aa, Artificial Sequence; identical to SEQ ID NO: 40669
  Description of Artificial Sequence: Synthetic polypeptide
  VH of XENCS529

SEQ ID NO: 44231 - protein, 112 aa, Artificial Sequence; identical to SEQ ID NO: 40517
  Description of Artificial Sequence: Synthetic polypeptide
  VL of XENCS529

SEQ ID NO: 44232 - protein, 231 aa, Artificial Sequence; identical to SEQ ID NO: 21572
  Description of Artificial Sequence: Synthetic polypeptide
  Fc chain of XENCS529

SEQ ID NO: 44233 - protein, 5 aa, Artificial Sequence
  Description of Artificial Sequence: Synthetic peptide
  XENCS529 vhCDR1
HYGIN

SEQ ID NO: 44234 - protein, 17 aa, Artificial Sequence
  Description of Artificial Sequence: Synthetic peptide
  XENCS529 vhCDR2
WINTYTGEPYYAPGFQE

SEQ ID NO: 44235 - protein, 8 aa, Artificial Sequence
  Description of Artificial Sequence: Synthetic peptide
  XENCS529 vhCDR3
DYYGSSPY

SEQ ID NO: 44236 - protein, 16 aa, Artificial Sequence
  Description of Artificial Sequence: Synthetic peptide
  XENCS529 vlCDR1
KASQSIVHSNGNTYLE

SEQ ID NO: 44237 - protein, 7 aa, Artificial Sequence
  Description of Artificial Sequence: Synthetic peptide
  XENCS529 vlCDR2
KVSNRFS

SEQ ID NO: 44238 - protein, 9 aa, Artificial Sequence
  Description of Artificial Sequence: Synthetic peptide
  XENCS529 vlCDR3
FQGSHVPNT

SEQ ID NO: 44239 - protein, 214 aa, Artificial Sequence; identical to SEQ ID NO: 43659
  Description of Artificial Sequence: Synthetic polypeptide
  XenCS529 Chain 3 - [ICOS]_L0

SEQ ID NO: 44240 - protein, 107 aa, Artificial Sequence; identical to SEQ ID NO: 43660
  Description of Artificial Sequence: Synthetic polypeptide
  VL of XENCS529

SEQ ID NO: 44241 - protein, 11 aa, Artificial Sequence
  Description of Artificial Sequence: Synthetic peptide
  XENCS529 vlCDR1
RASQGISRLLA

SEQ ID NO: 44242 - protein, 7 aa, Artificial Sequence
  Description of Artificial Sequence: Synthetic peptide
  XENCS529 vlCDR2
VASSLQS

SEQ ID NO: 44243 - protein, 9 aa, Artificial Sequence
  Description of Artificial Sequence: Synthetic peptide
  XENCS529 vlCDR3
QQANSFPWT

SEQ ID NO: 44244 - protein, 447 aa, Artificial Sequence; identical to SEQ ID NO: 23556
  Description of Artificial Sequence: Synthetic polypeptide
  XenCS530 Chain 1 - [CTLA-4]_H3_ IgG1_pI(-)_Isosteric_A_/PVA_ /S267K/L368D/K370S/M428L/N434S

SEQ ID NO: 44245 - protein, 118 aa, Artificial Sequence; identical to SEQ ID NO: 139
  Description of Artificial Sequence: Synthetic polypeptide
  VH of XENCS530

SEQ ID NO: 44246 - protein, 5 aa, Artificial Sequence
  Description of Artificial Sequence: Synthetic peptide
  XENCS530 vhCDR1
SYTMH

SEQ ID NO: 44247 - protein, 17 aa, Artificial Sequence
  Description of Artificial Sequence: Synthetic peptide
  XENCS530 vhCDR2
FISYDGNNKYYADSVKG

SEQ ID NO: 44248 - protein, 9 aa, Artificial Sequence
  Description of Artificial Sequence: Synthetic peptide
  XENCS530 vhCDR3
TGWLGPFDY

SEQ ID NO: 44249 - protein, 480 aa, Artificial Sequence; identical to SEQ ID NO: 44209
  Description of Artificial Sequence: Synthetic polypeptide
  XenCS530 Chain 2 - 1C11[PD-1]_H3.234_L3.144_scFv(GKPGS)4_Fc(216)_ IgG1_C220S/PVA_/S267K/S364K/E357Q/M428L/N434S

SEQ ID NO: 44250 - protein, 117 aa, Artificial Sequence; identical to SEQ ID NO: 40669
  Description of Artificial Sequence: Synthetic polypeptide
  VH of XENCS530

SEQ ID NO: 44251 - protein, 112 aa, Artificial Sequence; identical to SEQ ID NO: 40517
  Description of Artificial Sequence: Synthetic polypeptide
  VL of XENCS530

SEQ ID NO: 44252 - protein, 231 aa, Artificial Sequence; identical to SEQ ID NO: 21572
  Description of Artificial Sequence: Synthetic polypeptide
  Fc chain of XENCS530

SEQ ID NO: 44253 - protein, 5 aa, Artificial Sequence
  Description of Artificial Sequence: Synthetic peptide
  XENCS530 vhCDR1
HYGIN

SEQ ID NO: 44254 - protein, 17 aa, Artificial Sequence
  Description of Artificial Sequence: Synthetic peptide
  XENCS530 vhCDR2
WINTYTGEPYYAPGFQE

SEQ ID NO: 44255 - protein, 8 aa, Artificial Sequence
  Description of Artificial Sequence: Synthetic peptide
  XENCS530 vhCDR3
DYYGSSPY

SEQ ID NO: 44256 - protein, 16 aa, Artificial Sequence
  Description of Artificial Sequence: Synthetic peptide
  XENCS530 vlCDR1
KASQSIVHSNGNTYLE

SEQ ID NO: 44257 - protein, 7 aa, Artificial Sequence
  Description of Artificial Sequence: Synthetic peptide
  XENCS530 vlCDR2
KVSNRFS

SEQ ID NO: 44258 - protein, 9 aa, Artificial Sequence
  Description of Artificial Sequence: Synthetic peptide
  XENCS530 vlCDR3
FQGSHVPNT

SEQ ID NO: 44259 - protein, 215 aa, Artificial Sequence; identical to SEQ ID NO: 4504
  Description of Artificial Sequence: Synthetic polypeptide
  XenCS530 Chain 3 - [CTLA-4]_L0.22

SEQ ID NO: 44260 - protein, 108 aa, Artificial Sequence; identical to SEQ ID NO: 1607
  Description of Artificial Sequence: Synthetic polypeptide
  VL of XENCS530

SEQ ID NO: 44261 - protein, 12 aa, Artificial Sequence
  Description of Artificial Sequence: Synthetic peptide
  XENCS530 vlCDR1
RASQSVSSSYLA

SEQ ID NO: 44262 - protein, 7 aa, Artificial Sequence
  Description of Artificial Sequence: Synthetic peptide
  XENCS530 vlCDR2
GAFSRAT

SEQ ID NO: 44263 - protein, 9 aa, Artificial Sequence
  Description of Artificial Sequence: Synthetic peptide
  XENCS530 vlCDR3
QQYGSSPWT

SEQ ID NO: 44264 - protein, 450 aa, Artificial Sequence; identical to SEQ ID NO: 35607
  Description of Artificial Sequence: Synthetic polypeptide
  XenCS531 Chain 1 - 7G8_H3.30_ IgG1_pI(-)_Isosteric_A_/PVA_ /S267K/L368D/K370S/M428L/N434S

SEQ ID NO: 44265 - protein, 121 aa, Artificial Sequence; identical to SEQ ID NO: 22485
  Description of Artificial Sequence: Synthetic polypeptide
  VH of XENCS531

SEQ ID NO: 44266 - protein, 5 aa, Artificial Sequence
  Description of Artificial Sequence: Synthetic peptide
  XENCS531 vhCDR1
DAWMS

SEQ ID NO: 44267 - protein, 19 aa, Artificial Sequence
  Description of Artificial Sequence: Synthetic peptide
  XENCS531 vhCDR2
EISTKANNHATYYAESVKG

SEQ ID NO: 44268 - protein, 10 aa, Artificial Sequence
  Description of Artificial Sequence: Synthetic peptide
  XENCS531 vhCDR3
LATWDWYFDV

SEQ ID NO: 44269 - protein, 480 aa, Artificial Sequence; identical to SEQ ID NO: 44209
  Description of Artificial Sequence: Synthetic polypeptide
  XenCS531 Chain 2 -1C11[PD-1]_H3.234_L3.144_scFv(GKPGS)4_Fc(216)_ IgG1_C220S/PVA_/S267K/S364K/E357Q/M428L/N434S

SEQ ID NO: 44270 - protein, 117 aa, Artificial Sequence; identical to SEQ ID NO: 40669
  Description of Artificial Sequence: Synthetic polypeptide
  VH of XENCS531

SEQ ID NO: 44271 - protein, 112 aa, Artificial Sequence; identical to SEQ ID NO: 40517
  Description of Artificial Sequence: Synthetic polypeptide
  VL of XENCS531

SEQ ID NO: 44272 - protein, 231 aa, Artificial Sequence; identical to SEQ ID NO: 21572
  Description of Artificial Sequence: Synthetic polypeptide
  Fc chain of XENCS531

SEQ ID NO: 44273 - protein, 5 aa, Artificial Sequence
  Description of Artificial Sequence: Synthetic peptide
  XENCS531 vhCDR1
HYGIN

SEQ ID NO: 44274 - protein, 17 aa, Artificial Sequence
  Description of Artificial Sequence: Synthetic peptide
  XENCS531 vhCDR2
WINTYTGEPYYAPGFQE

SEQ ID NO: 44275 - protein, 8 aa, Artificial Sequence
  Description of Artificial Sequence: Synthetic peptide
  XENCS531 vhCDR3
DYYGSSPY

SEQ ID NO: 44276 - protein, 16 aa, Artificial Sequence
  Description of Artificial Sequence: Synthetic peptide
  XENCS531 vlCDR1
KASQSIVHSNGNTYLE

SEQ ID NO: 44277 - protein, 7 aa, Artificial Sequence
  Description of Artificial Sequence: Synthetic peptide
  XENCS531 vlCDR2
KVSNRFS

SEQ ID NO: 44278 - protein, 9 aa, Artificial Sequence
  Description of Artificial Sequence: Synthetic peptide
  XENCS531 vlCDR3
FQGSHVPNT

SEQ ID NO: 44279 - protein, 218 aa, Artificial Sequence; identical to SEQ ID NO: 22599
  Description of Artificial Sequence: Synthetic polypeptide
  XenCS531 Chain 3 - 7G8_L1.34

SEQ ID NO: 44280 - protein, 111 aa, Artificial Sequence; identical to SEQ ID NO: 22600
  Description of Artificial Sequence: Synthetic polypeptide
  VL of XENCS531

SEQ ID NO: 44281 - protein, 15 aa, Artificial Sequence
  Description of Artificial Sequence: Synthetic peptide
  XENCS531 vlCDR1
RASQSVDYDGDSYMN

SEQ ID NO: 44282 - protein, 7 aa, Artificial Sequence
  Description of Artificial Sequence: Synthetic peptide
  XENCS531 vlCDR2
AASELES

SEQ ID NO: 44283 - protein, 9 aa, Artificial Sequence
  Description of Artificial Sequence: Synthetic peptide
  XENCS531 vlCDR3
QQSNEDPFT

SEQ ID NO: 44284 - protein, 447 aa, Artificial Sequence; identical to SEQ ID NO: 35647
  Description of Artificial Sequence: Synthetic polypeptide
  XenCS532 Chain 1 - 2A11_H1.144_ IgG1_pI(-)_Isosteric_A_/PVA_ /S267K/L368D/K370S/M428L/N434S

SEQ ID NO: 44285 - protein, 118 aa, Artificial Sequence; identical to SEQ ID NO: 22085
  Description of Artificial Sequence: Synthetic polypeptide
  VH of XENCS532

SEQ ID NO: 44286 - protein, 5 aa, Artificial Sequence
  Description of Artificial Sequence: Synthetic peptide
  XENCS532 vhCDR1
DYFMH

SEQ ID NO: 44287 - protein, 17 aa, Artificial Sequence
  Description of Artificial Sequence: Synthetic peptide
  XENCS532 vhCDR2
WIDPELGDTEYAPKFQG

SEQ ID NO: 44288 - protein, 9 aa, Artificial Sequence
  Description of Artificial Sequence: Synthetic peptide
  XENCS532 vhCDR3
RGVYQALDY

SEQ ID NO: 44289 - protein, 480 aa, Artificial Sequence; identical to SEQ ID NO: 44209
  Description of Artificial Sequence: Synthetic polypeptide
  XenCS532 Chain 2 - 1C11[PD-1]_H3.234_L3.144_scFv(GKPGS)4_Fc(216)_ IgG1_C220S/PVA_/S267K/S364K/E357Q/M428L/N434S

SEQ ID NO: 44290 - protein, 117 aa, Artificial Sequence; identical to SEQ ID NO: 40669
  Description of Artificial Sequence: Synthetic polypeptide
  VH of XENCS532

SEQ ID NO: 44291 - protein, 112 aa, Artificial Sequence; identical to SEQ ID NO: 40517
  Description of Artificial Sequence: Synthetic polypeptide
  VL of XENCS532

SEQ ID NO: 44292 - protein, 231 aa, Artificial Sequence; identical to SEQ ID NO: 21572
  Description of Artificial Sequence: Synthetic polypeptide
  Fc chain of XENCS532

SEQ ID NO: 44293 - protein, 5 aa, Artificial Sequence
  Description of Artificial Sequence: Synthetic peptide
  XENCS532 vhCDR1
HYGIN

SEQ ID NO: 44294 - protein, 17 aa, Artificial Sequence
  Description of Artificial Sequence: Synthetic peptide
  XENCS532 vhCDR2
WINTYTGEPYYAPGFQE

SEQ ID NO: 44295 - protein, 8 aa, Artificial Sequence
  Description of Artificial Sequence: Synthetic peptide
  XENCS532 vhCDR3
DYYGSSPY

SEQ ID NO: 44296 - protein, 16 aa, Artificial Sequence
  Description of Artificial Sequence: Synthetic peptide
  XENCS532 vlCDR1
KASQSIVHSNGNTYLE

SEQ ID NO: 44297 - protein, 7 aa, Artificial Sequence
  Description of Artificial Sequence: Synthetic peptide
  XENCS532 vlCDR2
KVSNRFS

SEQ ID NO: 44298 - protein, 9 aa, Artificial Sequence
  Description of Artificial Sequence: Synthetic peptide
  XENCS532 vlCDR3
FQGSHVPNT

SEQ ID NO: 44299 - protein, 214 aa, Artificial Sequence; identical to SEQ ID NO: 22279
  Description of Artificial Sequence: Synthetic polypeptide
  XenCS532 Chain 3 - 2A11_L2.142

SEQ ID NO: 44300 - protein, 107 aa, Artificial Sequence; identical to SEQ ID NO: 22280
  Description of Artificial Sequence: Synthetic polypeptide
  VL of XENCS532

SEQ ID NO: 44301 - protein, 11 aa, Artificial Sequence
  Description of Artificial Sequence: Synthetic peptide
  XENCS532 vlCDR1
QASQDIGNYLN

SEQ ID NO: 44302 - protein, 7 aa, Artificial Sequence
  Description of Artificial Sequence: Synthetic peptide
  XENCS532 vlCDR2
FTSYLHS

SEQ ID NO: 44303 - protein, 9 aa, Artificial Sequence
  Description of Artificial Sequence: Synthetic peptide
  XENCS532 vlCDR3
QQGNTLPYT

SEQ ID NO: 44304 - protein, 446 aa, Artificial Sequence
  Description of Artificial Sequence: Synthetic polypeptide
  XenCS533 Chain 1 - 3H3_H1_ IgG1_pI(-)_Isosteric_A_/PVA_ /S267K/L368D/K370S/M428L/N434S
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 44305 - protein, 117 aa, Artificial Sequence; identical to SEQ ID NO: 36368
  Description of Artificial Sequence: Synthetic polypeptide
  VH of XENCS533

SEQ ID NO: 44306 - protein, 5 aa, Artificial Sequence
  Description of Artificial Sequence: Synthetic peptide
  XENCS533 vhCDR1
GYGVN

SEQ ID NO: 44307 - protein, 16 aa, Artificial Sequence
  Description of Artificial Sequence: Synthetic peptide
  XENCS533 vhCDR2
MIWGDGSTDYNSALKS

SEQ ID NO: 44308 - protein, 9 aa, Artificial Sequence
  Description of Artificial Sequence: Synthetic peptide
  XENCS533 vhCDR3
SYYTSDEDY

SEQ ID NO: 44309 - protein, 480 aa, Artificial Sequence; identical to SEQ ID NO: 44209
  Description of Artificial Sequence: Synthetic polypeptide
  XenCS533 Chain 2 - 1C11[PD-1]_H3.234_L3.144_scFv(GKPGS)4_Fc(216)_ IgG1_C220S/PVA_/S267K/S364K/E357Q/M428L/N434S

SEQ ID NO: 44310 - protein, 117 aa, Artificial Sequence; identical to SEQ ID NO: 40669
  Description of Artificial Sequence: Synthetic polypeptide
  VH of XENCS533

SEQ ID NO: 44311 - protein, 112 aa, Artificial Sequence; identical to SEQ ID NO: 40517
  Description of Artificial Sequence: Synthetic polypeptide
  VL of XENCS533

SEQ ID NO: 44312 - protein, 231 aa, Artificial Sequence; identical to SEQ ID NO: 21572
  Description of Artificial Sequence: Synthetic polypeptide
  Fc chain of XENCS533

SEQ ID NO: 44313 - protein, 5 aa, Artificial Sequence
  Description of Artificial Sequence: Synthetic peptide
  XENCS533 vhCDR1
HYGIN

SEQ ID NO: 44314 - protein, 17 aa, Artificial Sequence
  Description of Artificial Sequence: Synthetic peptide
  XENCS533 vhCDR2
WINTYTGEPYYAPGFQE

SEQ ID NO: 44315 - protein, 8 aa, Artificial Sequence
  Description of Artificial Sequence: Synthetic peptide
  XENCS533 vhCDR3
DYYGSSPY

SEQ ID NO: 44316 - protein, 16 aa, Artificial Sequence
  Description of Artificial Sequence: Synthetic peptide
  XENCS533 vlCDR1
KASQSIVHSNGNTYLE

SEQ ID NO: 44317 - protein, 7 aa, Artificial Sequence
  Description of Artificial Sequence: Synthetic peptide
  XENCS533 vlCDR2
KVSNRFS

SEQ ID NO: 44318 - protein, 9 aa, Artificial Sequence
  Description of Artificial Sequence: Synthetic peptide
  XENCS533 vlCDR3
FQGSHVPNT

SEQ ID NO: 44319 - protein, 219 aa, Artificial Sequence; identical to SEQ ID NO: 36512
  Description of Artificial Sequence: Synthetic polypeptide
  XenCS533 Chain 3 - 3H3_L2.1

SEQ ID NO: 44320 - protein, 112 aa, Artificial Sequence; identical to SEQ ID NO: 36513
  Description of Artificial Sequence: Synthetic polypeptide
  VL of XENCS533

SEQ ID NO: 44321 - protein, 17 aa, Artificial Sequence
  Description of Artificial Sequence: Synthetic peptide
  XENCS533 vlCDR1
KSSQSLLNSRTRKNYLA

SEQ ID NO: 44322 - protein, 7 aa, Artificial Sequence
  Description of Artificial Sequence: Synthetic peptide
  XENCS533 vlCDR2
WASTRES

SEQ ID NO: 44323 - protein, 8 aa, Artificial Sequence
  Description of Artificial Sequence: Synthetic peptide
  XENCS533 vlCDR3
KQSYSLRT

SEQ ID NO: 44324 - protein, 447 aa, Artificial Sequence; identical to SEQ ID NO: 36147
  Description of Artificial Sequence: Synthetic polypeptide
  XenCS534 Chain 1 - 9C6_H1.1_ IgG1_pI(-)_Isosteric_A_/PVA_ /S267K/L368D/K370S/M428L/N434S

SEQ ID NO: 44325 - protein, 118 aa, Artificial Sequence; identical to SEQ ID NO: 21205
  Description of Artificial Sequence: Synthetic polypeptide
  VH of XENCS534

SEQ ID NO: 44326 - protein, 5 aa, Artificial Sequence
  Description of Artificial Sequence: Synthetic peptide
  XENCS534 vhCDR1
GYGVN

SEQ ID NO: 44327 - protein, 16 aa, Artificial Sequence
  Description of Artificial Sequence: Synthetic peptide
  XENCS534 vhCDR2
MIWIDGSTDYNSKFQG

SEQ ID NO: 44328 - protein, 10 aa, Artificial Sequence
  Description of Artificial Sequence: Synthetic peptide
  XENCS534 vhCDR3
DRPDGRAMDY

SEQ ID NO: 44329 - protein, 480 aa, Artificial Sequence; identical to SEQ ID NO: 44209
  Description of Artificial Sequence: Synthetic polypeptide
  XenCS534 Chain 2 - 1C11[PD-1]_H3.234_L3.144_scFv(GKPGS)4_Fc(216)_ IgG1_C220S/PVA_/S267K/S364K/E357Q/M428L/N434S

SEQ ID NO: 44330 - protein, 117 aa, Artificial Sequence; identical to SEQ ID NO: 40669
  Description of Artificial Sequence: Synthetic polypeptide
  VH of XENCS534

SEQ ID NO: 44331 - protein, 112 aa, Artificial Sequence; identical to SEQ ID NO: 40517
  Description of Artificial Sequence: Synthetic polypeptide
  VL of XENCS534

SEQ ID NO: 44332 - protein, 231 aa, Artificial Sequence; identical to SEQ ID NO: 21572
  Description of Artificial Sequence: Synthetic polypeptide
  Fc chain of XENCS534

SEQ ID NO: 44333 - protein, 5 aa, Artificial Sequence
  Description of Artificial Sequence: Synthetic peptide
  XENCS534 vhCDR1
HYGIN

SEQ ID NO: 44334 - protein, 17 aa, Artificial Sequence
  Description of Artificial Sequence: Synthetic peptide
  XENCS534 vhCDR2
WINTYTGEPYYAPGFQE

SEQ ID NO: 44335 - protein, 8 aa, Artificial Sequence
  Description of Artificial Sequence: Synthetic peptide
  XENCS534 vhCDR3
DYYGSSPY

SEQ ID NO: 44336 - protein, 16 aa, Artificial Sequence
  Description of Artificial Sequence: Synthetic peptide
  XENCS534 vlCDR1
KASQSIVHSNGNTYLE

SEQ ID NO: 44337 - protein, 7 aa, Artificial Sequence
  Description of Artificial Sequence: Synthetic peptide
  XENCS534 vlCDR2
KVSNRFS

SEQ ID NO: 44338 - protein, 9 aa, Artificial Sequence
  Description of Artificial Sequence: Synthetic peptide
  XENCS534 vlCDR3
FQGSHVPNT

SEQ ID NO: 44339 - protein, 213 aa, Artificial Sequence; identical to SEQ ID NO: 21050
  Description of Artificial Sequence: Synthetic polypeptide
  XenCS534 Chain 3 - 9C6_L1

SEQ ID NO: 44340 - protein, 106 aa, Artificial Sequence; identical to SEQ ID NO: 21051
  Description of Artificial Sequence: Synthetic polypeptide
  VL of XENCS534

SEQ ID NO: 44341 - protein, 11 aa, Artificial Sequence
  Description of Artificial Sequence: Synthetic peptide
  XENCS534 vlCDR1
KASQSVSNDVA

SEQ ID NO: 44342 - protein, 7 aa, Artificial Sequence
  Description of Artificial Sequence: Synthetic peptide
  XENCS534 vlCDR2
YASNRYT

SEQ ID NO: 44343 - protein, 8 aa, Artificial Sequence
  Description of Artificial Sequence: Synthetic peptide
  XENCS534 vlCDR3
QQDYSSPT

SEQ ID NO: 44344 - protein, 454 aa, Artificial Sequence; identical to SEQ ID NO: 44204
  Description of Artificial Sequence: Synthetic polypeptide
  XenCS535 Chain 1 - [ICOS]_H0_ IgG1_pI(-)_Isosteric_A_/PVA_ /S267K/L368D/K370S/M428L/N434S

SEQ ID NO: 44345 - protein, 125 aa, Artificial Sequence; identical to SEQ ID NO: 43645
  Description of Artificial Sequence: Synthetic polypeptide
  VH of XENCS535

SEQ ID NO: 44346 - protein, 5 aa, Artificial Sequence
  Description of Artificial Sequence: Synthetic peptide
  XENCS535 vhCDR1
GYYMH

SEQ ID NO: 44347 - protein, 17 aa, Artificial Sequence
  Description of Artificial Sequence: Synthetic peptide
  XENCS535 vhCDR2
WINPHSGGTNYAQKFQG

SEQ ID NO: 44348 - protein, 16 aa, Artificial Sequence
  Description of Artificial Sequence: Synthetic peptide
  XENCS535 vhCDR3
TYYYDSSGYYHDAFDI

SEQ ID NO: 44349 - protein, 480 aa, Artificial Sequence
  Description of Artificial Sequence: Synthetic polypeptide
  XenCS535 Chain 2 - 1C11[PD-1]_H3.240_L3.148_scFv(GKPGS)4_Fc(216)_ IgG1_C220S/PVA_/S267K/S364K/E357Q/M428L/N434S
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 44350 - protein, 117 aa, Artificial Sequence; identical to SEQ ID NO: 40831
  Description of Artificial Sequence: Synthetic polypeptide
  VH of XENCS535

SEQ ID NO: 44351 - protein, 112 aa, Artificial Sequence; identical to SEQ ID NO: 33009
  Description of Artificial Sequence: Synthetic polypeptide
  VL of XENCS535

SEQ ID NO: 44352 - protein, 231 aa, Artificial Sequence; identical to SEQ ID NO: 21572
  Description of Artificial Sequence: Synthetic polypeptide
  Fc chain of XENCS535

SEQ ID NO: 44353 - protein, 5 aa, Artificial Sequence
  Description of Artificial Sequence: Synthetic peptide
  XENCS535 vhCDR1
HYGIN

SEQ ID NO: 44354 - protein, 17 aa, Artificial Sequence
  Description of Artificial Sequence: Synthetic peptide
  XENCS535 vhCDR2
WINTYTGEPYYAPGFQE

SEQ ID NO: 44355 - protein, 8 aa, Artificial Sequence
  Description of Artificial Sequence: Synthetic peptide
  XENCS535 vhCDR3
DYYGSSPY

SEQ ID NO: 44356 - protein, 16 aa, Artificial Sequence
  Description of Artificial Sequence: Synthetic peptide
  XENCS535 vlCDR1
KSSQSIVHSNGNTYLE

SEQ ID NO: 44357 - protein, 7 aa, Artificial Sequence
  Description of Artificial Sequence: Synthetic peptide
  XENCS535 vlCDR2
KVSNRFS

SEQ ID NO: 44358 - protein, 9 aa, Artificial Sequence
  Description of Artificial Sequence: Synthetic peptide
  XENCS535 vlCDR3
FQGSHVPNT

SEQ ID NO: 44359 - protein, 214 aa, Artificial Sequence; identical to SEQ ID NO: 43659
  Description of Artificial Sequence: Synthetic polypeptide
  XenCS535 Chain 3 - [ICOS]_L0

SEQ ID NO: 44360 - protein, 107 aa, Artificial Sequence; identical to SEQ ID NO: 43660
  Description of Artificial Sequence: Synthetic polypeptide
  VL of XENCS535

SEQ ID NO: 44361 - protein, 11 aa, Artificial Sequence
  Description of Artificial Sequence: Synthetic peptide
  XENCS535 vlCDR1
RASQGISRLLA

SEQ ID NO: 44362 - protein, 7 aa, Artificial Sequence
  Description of Artificial Sequence: Synthetic peptide
  XENCS535 vlCDR2
VASSLQS

SEQ ID NO: 44363 - protein, 9 aa, Artificial Sequence
  Description of Artificial Sequence: Synthetic peptide
  XENCS535 vlCDR3
QQANSFPWT

SEQ ID NO: 44364 - protein, 454 aa, Artificial Sequence; identical to SEQ ID NO: 44224
  Description of Artificial Sequence: Synthetic polypeptide
  XenCS536 Chain 1 - [ICOS]_H0.66_ IgG1_pI(-)_Isosteric_A_/PVA_ /S267K/L368D/K370S/M428L/N434S

SEQ ID NO: 44365 - protein, 125 aa, Artificial Sequence; identical to SEQ ID NO: 43665
  Description of Artificial Sequence: Synthetic polypeptide
  VH of XENCS536

SEQ ID NO: 44366 - protein, 5 aa, Artificial Sequence
  Description of Artificial Sequence: Synthetic peptide
  XENCS536 vhCDR1
GYYMH

SEQ ID NO: 44367 - protein, 17 aa, Artificial Sequence
  Description of Artificial Sequence: Synthetic peptide
  XENCS536 vhCDR2
WINPHSGETIYAQKFQG

SEQ ID NO: 44368 - protein, 16 aa, Artificial Sequence
  Description of Artificial Sequence: Synthetic peptide
  XENCS536 vhCDR3
TYYYDTSGYYHDAFDV

SEQ ID NO: 44369 - protein, 480 aa, Artificial Sequence; identical to SEQ ID NO: 44349
  Description of Artificial Sequence: Synthetic polypeptide
  XenCS536 Chain 2 - 1C11[PD-1]_H3.240_L3.148_scFv(GKPGS)4_Fc(216)_ IgG1_C220S/PVA_/S267K/S364K/E357Q/M428L/N434S

SEQ ID NO: 44370 - protein, 117 aa, Artificial Sequence; identical to SEQ ID NO: 40831
  Description of Artificial Sequence: Synthetic polypeptide
  VH of XENCS536

SEQ ID NO: 44371 - protein, 112 aa, Artificial Sequence; identical to SEQ ID NO: 33009
  Description of Artificial Sequence: Synthetic polypeptide
  VL of XENCS536

SEQ ID NO: 44372 - protein, 231 aa, Artificial Sequence; identical to SEQ ID NO: 21572
  Description of Artificial Sequence: Synthetic polypeptide
  Fc chain of XENCS536

SEQ ID NO: 44373 - protein, 5 aa, Artificial Sequence
  Description of Artificial Sequence: Synthetic peptide
  XENCS536 vhCDR1
HYGIN

SEQ ID NO: 44374 - protein, 17 aa, Artificial Sequence
  Description of Artificial Sequence: Synthetic peptide
  XENCS536 vhCDR2
WINTYTGEPYYAPGFQE

SEQ ID NO: 44375 - protein, 8 aa, Artificial Sequence
  Description of Artificial Sequence: Synthetic peptide
  XENCS536 vhCDR3
DYYGSSPY

SEQ ID NO: 44376 - protein, 16 aa, Artificial Sequence
  Description of Artificial Sequence: Synthetic peptide
  XENCS536 vlCDR1
KSSQSIVHSNGNTYLE

SEQ ID NO: 44377 - protein, 7 aa, Artificial Sequence
  Description of Artificial Sequence: Synthetic peptide
  XENCS536 vlCDR2
KVSNRFS

SEQ ID NO: 44378 - protein, 9 aa, Artificial Sequence
  Description of Artificial Sequence: Synthetic peptide
  XENCS536 vlCDR3
FQGSHVPNT

SEQ ID NO: 44379 - protein, 214 aa, Artificial Sequence; identical to SEQ ID NO: 43659
  Description of Artificial Sequence: Synthetic polypeptide
  XenCS536 Chain 3 - [ICOS]_L0

SEQ ID NO: 44380 - protein, 107 aa, Artificial Sequence; identical to SEQ ID NO: 43660
  Description of Artificial Sequence: Synthetic polypeptide
  VL of XENCS536

SEQ ID NO: 44381 - protein, 11 aa, Artificial Sequence
  Description of Artificial Sequence: Synthetic peptide
  XENCS536 vlCDR1
RASQGISRLLA

SEQ ID NO: 44382 - protein, 7 aa, Artificial Sequence
  Description of Artificial Sequence: Synthetic peptide
  XENCS536 vlCDR2
VASSLQS

SEQ ID NO: 44383 - protein, 9 aa, Artificial Sequence
  Description of Artificial Sequence: Synthetic peptide
  XENCS536 vlCDR3
QQANSFPWT

SEQ ID NO: 44384 - protein, 447 aa, Artificial Sequence; identical to SEQ ID NO: 23556
  Description of Artificial Sequence: Synthetic polypeptide
  XenCS537 Chain 1 - [CTLA-4]_H3_ IgG1_pI(-)_Isosteric_A_/PVA_ /S267K/L368D/K370S/M428L/N434S

SEQ ID NO: 44385 - protein, 118 aa, Artificial Sequence; identical to SEQ ID NO: 139
  Description of Artificial Sequence: Synthetic polypeptide
  VH of XENCS537

SEQ ID NO: 44386 - protein, 5 aa, Artificial Sequence
  Description of Artificial Sequence: Synthetic peptide
  XENCS537 vhCDR1
SYTMH

SEQ ID NO: 44387 - protein, 17 aa, Artificial Sequence
  Description of Artificial Sequence: Synthetic peptide
  XENCS537 vhCDR2
FISYDGNNKYYADSVKG

SEQ ID NO: 44388 - protein, 9 aa, Artificial Sequence
  Description of Artificial Sequence: Synthetic peptide
  XENCS537 vhCDR3
TGWLGPFDY

SEQ ID NO: 44389 - protein, 480 aa, Artificial Sequence; identical to SEQ ID NO: 44349
  Description of Artificial Sequence: Synthetic polypeptide
  XenCS537 Chain 2 - 1C11[PD-1]_H3.240_L3.148_scFv(GKPGS)4_Fc(216)_ IgG1_C220S/PVA_/S267K/S364K/E357Q/M428L/N434S

SEQ ID NO: 44390 - protein, 117 aa, Artificial Sequence; identical to SEQ ID NO: 40831
  Description of Artificial Sequence: Synthetic polypeptide
  VH of XENCS537

SEQ ID NO: 44391 - protein, 112 aa, Artificial Sequence; identical to SEQ ID NO: 33009
  Description of Artificial Sequence: Synthetic polypeptide
  VL of XENCS537

SEQ ID NO: 44392 - protein, 231 aa, Artificial Sequence; identical to SEQ ID NO: 21572
  Description of Artificial Sequence: Synthetic polypeptide
  Fc chain of XENCS537

SEQ ID NO: 44393 - protein, 5 aa, Artificial Sequence
  Description of Artificial Sequence: Synthetic peptide
  XENCS537 vhCDR1
HYGIN

SEQ ID NO: 44394 - protein, 17 aa, Artificial Sequence
  Description of Artificial Sequence: Synthetic peptide
  XENCS537 vhCDR2
WINTYTGEPYYAPGFQE

SEQ ID NO: 44395 - protein, 8 aa, Artificial Sequence
  Description of Artificial Sequence: Synthetic peptide
  XENCS537 vhCDR3
DYYGSSPY

SEQ ID NO: 44396 - protein, 16 aa, Artificial Sequence
  Description of Artificial Sequence: Synthetic peptide
  XENCS537 vlCDR1
KSSQSIVHSNGNTYLE

SEQ ID NO: 44397 - protein, 7 aa, Artificial Sequence
  Description of Artificial Sequence: Synthetic peptide
  XENCS537 vlCDR2
KVSNRFS

SEQ ID NO: 44398 - protein, 9 aa, Artificial Sequence
  Description of Artificial Sequence: Synthetic peptide
  XENCS537 vlCDR3
FQGSHVPNT

SEQ ID NO: 44399 - protein, 215 aa, Artificial Sequence; identical to SEQ ID NO: 4504
  Description of Artificial Sequence: Synthetic polypeptide
  XenCS537 Chain 3 - [CTLA-4]_L0.22

SEQ ID NO: 44400 - protein, 108 aa, Artificial Sequence; identical to SEQ ID NO: 1607
  Description of Artificial Sequence: Synthetic polypeptide
  VL of XENCS537

SEQ ID NO: 44401 - protein, 12 aa, Artificial Sequence
  Description of Artificial Sequence: Synthetic peptide
  XENCS537 vlCDR1
RASQSVSSSYLA

SEQ ID NO: 44402 - protein, 7 aa, Artificial Sequence
  Description of Artificial Sequence: Synthetic peptide
  XENCS537 vlCDR2
GAFSRAT

SEQ ID NO: 44403 - protein, 9 aa, Artificial Sequence
  Description of Artificial Sequence: Synthetic peptide
  XENCS537 vlCDR3
QQYGSSPWT

SEQ ID NO: 44404 - protein, 450 aa, Artificial Sequence; identical to SEQ ID NO: 35607
  Description of Artificial Sequence: Synthetic polypeptide
  XenCS538 Chain 1 - 7G8_H3.30_ IgG1_pI(-)_Isosteric_A_/PVA_ /S267K/L368D/K370S/M428L/N434S

SEQ ID NO: 44405 - protein, 121 aa, Artificial Sequence; identical to SEQ ID NO: 22485
  Description of Artificial Sequence: Synthetic polypeptide
  VH of XENCS538

SEQ ID NO: 44406 - protein, 5 aa, Artificial Sequence
  Description of Artificial Sequence: Synthetic peptide
  XENCS538 vhCDR1
DAWMS

SEQ ID NO: 44407 - protein, 19 aa, Artificial Sequence
  Description of Artificial Sequence: Synthetic peptide
  XENCS538 vhCDR2
EISTKANNHATYYAESVKG

SEQ ID NO: 44408 - protein, 10 aa, Artificial Sequence
  Description of Artificial Sequence: Synthetic peptide
  XENCS538 vhCDR3
LATWDWYFDV

SEQ ID NO: 44409 - protein, 480 aa, Artificial Sequence; identical to SEQ ID NO: 44349
  Description of Artificial Sequence: Synthetic polypeptide
  XenCS538 Chain 2 -1C11[PD-1]_H3.240_L3.148_scFv(GKPGS)4_Fc(216)_ IgG1_C220S/PVA_/S267K/S364K/E357Q/M428L/N434S

SEQ ID NO: 44410 - protein, 117 aa, Artificial Sequence; identical to SEQ ID NO: 40831
  Description of Artificial Sequence: Synthetic polypeptide
  VH of XENCS538

SEQ ID NO: 44411 - protein, 112 aa, Artificial Sequence; identical to SEQ ID NO: 33009
  Description of Artificial Sequence: Synthetic polypeptide
  VL of XENCS538

SEQ ID NO: 44412 - protein, 231 aa, Artificial Sequence; identical to SEQ ID NO: 21572
  Description of Artificial Sequence: Synthetic polypeptide
  Fc chain of XENCS538

SEQ ID NO: 44413 - protein, 5 aa, Artificial Sequence
  Description of Artificial Sequence: Synthetic peptide
  XENCS538 vhCDR1
HYGIN

SEQ ID NO: 44414 - protein, 17 aa, Artificial Sequence
  Description of Artificial Sequence: Synthetic peptide
  XENCS538 vhCDR2
WINTYTGEPYYAPGFQE

SEQ ID NO: 44415 - protein, 8 aa, Artificial Sequence
  Description of Artificial Sequence: Synthetic peptide
  XENCS538 vhCDR3
DYYGSSPY

SEQ ID NO: 44416 - protein, 16 aa, Artificial Sequence
  Description of Artificial Sequence: Synthetic peptide
  XENCS538 vlCDR1
KSSQSIVHSNGNTYLE

SEQ ID NO: 44417 - protein, 7 aa, Artificial Sequence
  Description of Artificial Sequence: Synthetic peptide
  XENCS538 vlCDR2
KVSNRFS

SEQ ID NO: 44418 - protein, 9 aa, Artificial Sequence
  Description of Artificial Sequence: Synthetic peptide
  XENCS538 vlCDR3
FQGSHVPNT

SEQ ID NO: 44419 - protein, 218 aa, Artificial Sequence; identical to SEQ ID NO: 22599
  Description of Artificial Sequence: Synthetic polypeptide
  XenCS538 Chain 3 - 7G8_L1.34

SEQ ID NO: 44420 - protein, 111 aa, Artificial Sequence; identical to SEQ ID NO: 22600
  Description of Artificial Sequence: Synthetic polypeptide
  VL of XENCS538

SEQ ID NO: 44421 - protein, 15 aa, Artificial Sequence
  Description of Artificial Sequence: Synthetic peptide
  XENCS538 vlCDR1
RASQSVDYDGDSYMN

SEQ ID NO: 44422 - protein, 7 aa, Artificial Sequence
  Description of Artificial Sequence: Synthetic peptide
  XENCS538 vlCDR2
AASELES

SEQ ID NO: 44423 - protein, 9 aa, Artificial Sequence
  Description of Artificial Sequence: Synthetic peptide
  XENCS538 vlCDR3
QQSNEDPFT

SEQ ID NO: 44424 - protein, 447 aa, Artificial Sequence; identical to SEQ ID NO: 35647
  Description of Artificial Sequence: Synthetic polypeptide
  XenCS539 Chain 1 - 2A11_H1.144_ IgG1_pI(-)_Isosteric_A_/PVA_ /S267K/L368D/K370S/M428L/N434S

SEQ ID NO: 44425 - protein, 118 aa, Artificial Sequence; identical to SEQ ID NO: 22085
  Description of Artificial Sequence: Synthetic polypeptide
  VH of XENCS539

SEQ ID NO: 44426 - protein, 5 aa, Artificial Sequence
  Description of Artificial Sequence: Synthetic peptide
  XENCS539 vhCDR1
DYFMH

SEQ ID NO: 44427 - protein, 17 aa, Artificial Sequence
  Description of Artificial Sequence: Synthetic peptide
  XENCS539 vhCDR2
WIDPELGDTEYAPKFQG

SEQ ID NO: 44428 - protein, 9 aa, Artificial Sequence
  Description of Artificial Sequence: Synthetic peptide
  XENCS539 vhCDR3
RGVYQALDY

SEQ ID NO: 44429 - protein, 480 aa, Artificial Sequence; identical to SEQ ID NO: 44349
  Description of Artificial Sequence: Synthetic polypeptide
  XenCS539 Chain 2 - 1C11[PD-1]_H3.240_L3.148_scFv(GKPGS)4_Fc(216)_ IgG1_C220S/PVA_/S267K/S364K/E357Q/M428L/N434S

SEQ ID NO: 44430 - protein, 117 aa, Artificial Sequence; identical to SEQ ID NO: 40831
  Description of Artificial Sequence: Synthetic polypeptide
  VH of XENCS539

SEQ ID NO: 44431 - protein, 112 aa, Artificial Sequence; identical to SEQ ID NO: 33009
  Description of Artificial Sequence: Synthetic polypeptide
  VL of XENCS539

SEQ ID NO: 44432 - protein, 231 aa, Artificial Sequence; identical to SEQ ID NO: 21572
  Description of Artificial Sequence: Synthetic polypeptide
  Fc chain of XENCS539

SEQ ID NO: 44433 - protein, 5 aa, Artificial Sequence
  Description of Artificial Sequence: Synthetic peptide
  XENCS539 vhCDR1
HYGIN

SEQ ID NO: 44434 - protein, 17 aa, Artificial Sequence
  Description of Artificial Sequence: Synthetic peptide
  XENCS539 vhCDR2
WINTYTGEPYYAPGFQE

SEQ ID NO: 44435 - protein, 8 aa, Artificial Sequence
  Description of Artificial Sequence: Synthetic peptide
  XENCS539 vhCDR3
DYYGSSPY

SEQ ID NO: 44436 - protein, 16 aa, Artificial Sequence
  Description of Artificial Sequence: Synthetic peptide
  XENCS539 vlCDR1
KSSQSIVHSNGNTYLE

SEQ ID NO: 44437 - protein, 7 aa, Artificial Sequence
  Description of Artificial Sequence: Synthetic peptide
  XENCS539 vlCDR2
KVSNRFS

SEQ ID NO: 44438 - protein, 9 aa, Artificial Sequence
  Description of Artificial Sequence: Synthetic peptide
  XENCS539 vlCDR3
FQGSHVPNT

SEQ ID NO: 44439 - protein, 214 aa, Artificial Sequence; identical to SEQ ID NO: 22279
  Description of Artificial Sequence: Synthetic polypeptide
  XenCS539 Chain 3 - 2A11_L2.142

SEQ ID NO: 44440 - protein, 107 aa, Artificial Sequence; identical to SEQ ID NO: 22280
  Description of Artificial Sequence: Synthetic polypeptide
  VL of XENCS539

SEQ ID NO: 44441 - protein, 11 aa, Artificial Sequence
  Description of Artificial Sequence: Synthetic peptide
  XENCS539 vlCDR1
QASQDIGNYLN

SEQ ID NO: 44442 - protein, 7 aa, Artificial Sequence
  Description of Artificial Sequence: Synthetic peptide
  XENCS539 vlCDR2
FTSYLHS

SEQ ID NO: 44443 - protein, 9 aa, Artificial Sequence
  Description of Artificial Sequence: Synthetic peptide
  XENCS539 vlCDR3
QQGNTLPYT

SEQ ID NO: 44444 - protein, 446 aa, Artificial Sequence; identical to SEQ ID NO: 44304
  Description of Artificial Sequence: Synthetic polypeptide
  XenCS540 Chain 1 - 3H3_H1_ IgG1_pI(-)_Isosteric_A_/PVA_ /S267K/L368D/K370S/M428L/N434S

SEQ ID NO: 44445 - protein, 117 aa, Artificial Sequence; identical to SEQ ID NO: 36368
  Description of Artificial Sequence: Synthetic polypeptide
  VH of XENCS540

SEQ ID NO: 44446 - protein, 5 aa, Artificial Sequence
  Description of Artificial Sequence: Synthetic peptide
  XENCS540 vhCDR1
GYGVN

SEQ ID NO: 44447 - protein, 16 aa, Artificial Sequence
  Description of Artificial Sequence: Synthetic peptide
  XENCS540 vhCDR2
MIWGDGSTDYNSALKS

SEQ ID NO: 44448 - protein, 9 aa, Artificial Sequence
  Description of Artificial Sequence: Synthetic peptide
  XENCS540 vhCDR3
SYYTSDEDY

SEQ ID NO: 44449 - protein, 480 aa, Artificial Sequence; identical to SEQ ID NO: 44349
  Description of Artificial Sequence: Synthetic polypeptide
  XenCS540 Chain 2 - 1C11[PD-1]_H3.240_L3.148_scFv(GKPGS)4_Fc(216)_ IgG1_C220S/PVA_/S267K/S364K/E357Q/M428L/N434S

SEQ ID NO: 44450 - protein, 117 aa, Artificial Sequence; identical to SEQ ID NO: 40831
  Description of Artificial Sequence: Synthetic polypeptide
  VH of XENCS540

SEQ ID NO: 44451 - protein, 112 aa, Artificial Sequence; identical to SEQ ID NO: 33009
  Description of Artificial Sequence: Synthetic polypeptide
  VL of XENCS540

SEQ ID NO: 44452 - protein, 231 aa, Artificial Sequence; identical to SEQ ID NO: 21572
  Description of Artificial Sequence: Synthetic polypeptide
  Fc chain of XENCS540

SEQ ID NO: 44453 - protein, 5 aa, Artificial Sequence
  Description of Artificial Sequence: Synthetic peptide
  XENCS540 vhCDR1
HYGIN

SEQ ID NO: 44454 - protein, 17 aa, Artificial Sequence
  Description of Artificial Sequence: Synthetic peptide
  XENCS540 vhCDR2
WINTYTGEPYYAPGFQE

SEQ ID NO: 44455 - protein, 8 aa, Artificial Sequence
  Description of Artificial Sequence: Synthetic peptide
  XENCS540 vhCDR3
DYYGSSPY

SEQ ID NO: 44456 - protein, 16 aa, Artificial Sequence
  Description of Artificial Sequence: Synthetic peptide
  XENCS540 vlCDR1
KSSQSIVHSNGNTYLE

SEQ ID NO: 44457 - protein, 7 aa, Artificial Sequence
  Description of Artificial Sequence: Synthetic peptide
  XENCS540 vlCDR2
KVSNRFS

SEQ ID NO: 44458 - protein, 9 aa, Artificial Sequence
  Description of Artificial Sequence: Synthetic peptide
  XENCS540 vlCDR3
FQGSHVPNT

SEQ ID NO: 44459 - protein, 219 aa, Artificial Sequence; identical to SEQ ID NO: 36512
  Description of Artificial Sequence: Synthetic polypeptide
  XenCS540 Chain 3 - 3H3_L2.1

SEQ ID NO: 44460 - protein, 112 aa, Artificial Sequence; identical to SEQ ID NO: 36513
  Description of Artificial Sequence: Synthetic polypeptide
  VL of XENCS540

SEQ ID NO: 44461 - protein, 17 aa, Artificial Sequence
  Description of Artificial Sequence: Synthetic peptide
  XENCS540 vlCDR1
KSSQSLLNSRTRKNYLA

SEQ ID NO: 44462 - protein, 7 aa, Artificial Sequence
  Description of Artificial Sequence: Synthetic peptide
  XENCS540 vlCDR2
WASTRES

SEQ ID NO: 44463 - protein, 8 aa, Artificial Sequence
  Description of Artificial Sequence: Synthetic peptide
  XENCS540 vlCDR3
KQSYSLRT

SEQ ID NO: 44464 - protein, 447 aa, Artificial Sequence; identical to SEQ ID NO: 36147
  Description of Artificial Sequence: Synthetic polypeptide
  XenCS541 Chain 1 - 9C6_H1.1_ IgG1_pI(-)_Isosteric_A_/PVA_ /S267K/L368D/K370S/M428L/N434S

SEQ ID NO: 44465 - protein, 118 aa, Artificial Sequence; identical to SEQ ID NO: 21205
  Description of Artificial Sequence: Synthetic polypeptide
  VH of XENCS541

SEQ ID NO: 44466 - protein, 5 aa, Artificial Sequence
  Description of Artificial Sequence: Synthetic peptide
  XENCS541 vhCDR1
GYGVN

SEQ ID NO: 44467 - protein, 16 aa, Artificial Sequence
  Description of Artificial Sequence: Synthetic peptide
  XENCS541 vhCDR2
MIWIDGSTDYNSKFQG

SEQ ID NO: 44468 - protein, 10 aa, Artificial Sequence
  Description of Artificial Sequence: Synthetic peptide
  XENCS541 vhCDR3
DRPDGRAMDY

SEQ ID NO: 44469 - protein, 480 aa, Artificial Sequence; identical to SEQ ID NO: 44349
  Description of Artificial Sequence: Synthetic polypeptide
  XenCS541 Chain 2 - 1C11[PD-1]_H3.240_L3.148_scFv(GKPGS)4_Fc(216)_ IgG1_C220S/PVA_/S267K/S364K/E357Q/M428L/N434S

SEQ ID NO: 44470 - protein, 117 aa, Artificial Sequence; identical to SEQ ID NO: 40831
  Description of Artificial Sequence: Synthetic polypeptide
  VH of XENCS541

SEQ ID NO: 44471 - protein, 112 aa, Artificial Sequence; identical to SEQ ID NO: 33009
  Description of Artificial Sequence: Synthetic polypeptide
  VL of XENCS541

SEQ ID NO: 44472 - protein, 231 aa, Artificial Sequence; identical to SEQ ID NO: 21572
  Description of Artificial Sequence: Synthetic polypeptide
  Fc chain of XENCS541

SEQ ID NO: 44473 - protein, 5 aa, Artificial Sequence
  Description of Artificial Sequence: Synthetic peptide
  XENCS541 vhCDR1
HYGIN

SEQ ID NO: 44474 - protein, 17 aa, Artificial Sequence
  Description of Artificial Sequence: Synthetic peptide
  XENCS541 vhCDR2
WINTYTGEPYYAPGFQE

SEQ ID NO: 44475 - protein, 8 aa, Artificial Sequence
  Description of Artificial Sequence: Synthetic peptide
  XENCS541 vhCDR3
DYYGSSPY

SEQ ID NO: 44476 - protein, 16 aa, Artificial Sequence
  Description of Artificial Sequence: Synthetic peptide
  XENCS541 vlCDR1
KSSQSIVHSNGNTYLE

SEQ ID NO: 44477 - protein, 7 aa, Artificial Sequence
  Description of Artificial Sequence: Synthetic peptide
  XENCS541 vlCDR2
KVSNRFS

SEQ ID NO: 44478 - protein, 9 aa, Artificial Sequence
  Description of Artificial Sequence: Synthetic peptide
  XENCS541 vlCDR3
FQGSHVPNT

SEQ ID NO: 44479 - protein, 213 aa, Artificial Sequence; identical to SEQ ID NO: 21050
  Description of Artificial Sequence: Synthetic polypeptide
  XenCS541 Chain 3 - 9C6_L1

SEQ ID NO: 44480 - protein, 106 aa, Artificial Sequence; identical to SEQ ID NO: 21051
  Description of Artificial Sequence: Synthetic polypeptide
  VL of XENCS541

SEQ ID NO: 44481 - protein, 11 aa, Artificial Sequence
  Description of Artificial Sequence: Synthetic peptide
  XENCS541 vlCDR1
KASQSVSNDVA

SEQ ID NO: 44482 - protein, 7 aa, Artificial Sequence
  Description of Artificial Sequence: Synthetic peptide
  XENCS541 vlCDR2
YASNRYT

SEQ ID NO: 44483 - protein, 8 aa, Artificial Sequence
  Description of Artificial Sequence: Synthetic peptide
  XENCS541 vlCDR3
QQDYSSPT

SEQ ID NO: 44484 - protein, 454 aa, Artificial Sequence; identical to SEQ ID NO: 44204
  Description of Artificial Sequence: Synthetic polypeptide
  XenCS542 Chain 1 - [ICOS]_H0_ IgG1_pI(-)_Isosteric_A_/PVA_ /S267K/L368D/K370S/M428L/N434S

SEQ ID NO: 44485 - protein, 125 aa, Artificial Sequence; identical to SEQ ID NO: 43645
  Description of Artificial Sequence: Synthetic polypeptide
  VH of XENCS542

SEQ ID NO: 44486 - protein, 5 aa, Artificial Sequence
  Description of Artificial Sequence: Synthetic peptide
  XENCS542 vhCDR1
GYYMH

SEQ ID NO: 44487 - protein, 17 aa, Artificial Sequence
  Description of Artificial Sequence: Synthetic peptide
  XENCS542 vhCDR2
WINPHSGGTNYAQKFQG

SEQ ID NO: 44488 - protein, 16 aa, Artificial Sequence
  Description of Artificial Sequence: Synthetic peptide
  XENCS542 vhCDR3
TYYYDSSGYYHDAFDI

SEQ ID NO: 44489 - protein, 480 aa, Artificial Sequence
  Description of Artificial Sequence: Synthetic polypeptide
  XenCS542 Chain 2 - 1C11[PD-1]_H3.241_L3.148_scFv(GKPGS)4_Fc(216)_ IgG1_C220S/PVA_/S267K/S364K/E357Q/M428L/N434S
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 44490 - protein, 117 aa, Artificial Sequence; identical to SEQ ID NO: 40840
  Description of Artificial Sequence: Synthetic polypeptide
  VH of XENCS542

SEQ ID NO: 44491 - protein, 112 aa, Artificial Sequence; identical to SEQ ID NO: 33009
  Description of Artificial Sequence: Synthetic polypeptide
  VL of XENCS542

SEQ ID NO: 44492 - protein, 231 aa, Artificial Sequence; identical to SEQ ID NO: 21572
  Description of Artificial Sequence: Synthetic polypeptide
  Fc chain of XENCS542

SEQ ID NO: 44493 - protein, 5 aa, Artificial Sequence
  Description of Artificial Sequence: Synthetic peptide
  XENCS542 vhCDR1
HYGIN

SEQ ID NO: 44494 - protein, 17 aa, Artificial Sequence
  Description of Artificial Sequence: Synthetic peptide
  XENCS542 vhCDR2
WINTYTGEPYYAPGFQE

SEQ ID NO: 44495 - protein, 8 aa, Artificial Sequence
  Description of Artificial Sequence: Synthetic peptide
  XENCS542 vhCDR3
DYYGSSPY

SEQ ID NO: 44496 - protein, 16 aa, Artificial Sequence
  Description of Artificial Sequence: Synthetic peptide
  XENCS542 vlCDR1
KSSQSIVHSNGNTYLE

SEQ ID NO: 44497 - protein, 7 aa, Artificial Sequence
  Description of Artificial Sequence: Synthetic peptide
  XENCS542 vlCDR2
KVSNRFS

SEQ ID NO: 44498 - protein, 9 aa, Artificial Sequence
  Description of Artificial Sequence: Synthetic peptide
  XENCS542 vlCDR3
FQGSHVPNT

SEQ ID NO: 44499 - protein, 214 aa, Artificial Sequence; identical to SEQ ID NO: 43659
  Description of Artificial Sequence: Synthetic polypeptide
  XenCS542 Chain 3 - [ICOS]_L0

SEQ ID NO: 44500 - protein, 107 aa, Artificial Sequence; identical to SEQ ID NO: 43660
  Description of Artificial Sequence: Synthetic polypeptide
  VL of XENCS542

SEQ ID NO: 44501 - protein, 11 aa, Artificial Sequence
  Description of Artificial Sequence: Synthetic peptide
  XENCS542 vlCDR1
RASQGISRLLA

SEQ ID NO: 44502 - protein, 7 aa, Artificial Sequence
  Description of Artificial Sequence: Synthetic peptide
  XENCS542 vlCDR2
VASSLQS

SEQ ID NO: 44503 - protein, 9 aa, Artificial Sequence
  Description of Artificial Sequence: Synthetic peptide
  XENCS542 vlCDR3
QQANSFPWT

SEQ ID NO: 44504 - protein, 454 aa, Artificial Sequence; identical to SEQ ID NO: 44224
  Description of Artificial Sequence: Synthetic polypeptide
  XenCS543 Chain 1 - [ICOS]_H0.66_ IgG1_pI(-)_Isosteric_A_/PVA_ /S267K/L368D/K370S/M428L/N434S

SEQ ID NO: 44505 - protein, 125 aa, Artificial Sequence; identical to SEQ ID NO: 43665
  Description of Artificial Sequence: Synthetic polypeptide
  VH of XENCS543

SEQ ID NO: 44506 - protein, 5 aa, Artificial Sequence
  Description of Artificial Sequence: Synthetic peptide
  XENCS543 vhCDR1
GYYMH

SEQ ID NO: 44507 - protein, 17 aa, Artificial Sequence
  Description of Artificial Sequence: Synthetic peptide
  XENCS543 vhCDR2
WINPHSGETIYAQKFQG

SEQ ID NO: 44508 - protein, 16 aa, Artificial Sequence
  Description of Artificial Sequence: Synthetic peptide
  XENCS543 vhCDR3
TYYYDTSGYYHDAFDV

SEQ ID NO: 44509 - protein, 480 aa, Artificial Sequence; identical to SEQ ID NO: 44489
  Description of Artificial Sequence: Synthetic polypeptide
  XenCS543 Chain 2 - 1C11[PD-1]_H3.241_L3.148_scFv(GKPGS)4_Fc(216)_ IgG1_C220S/PVA_/S267K/S364K/E357Q/M428L/N434S

SEQ ID NO: 44510 - protein, 117 aa, Artificial Sequence; identical to SEQ ID NO: 40840
  Description of Artificial Sequence: Synthetic polypeptide
  VH of XENCS543

SEQ ID NO: 44511 - protein, 112 aa, Artificial Sequence; identical to SEQ ID NO: 33009
  Description of Artificial Sequence: Synthetic polypeptide
  VL of XENCS543

SEQ ID NO: 44512 - protein, 231 aa, Artificial Sequence; identical to SEQ ID NO: 21572
  Description of Artificial Sequence: Synthetic polypeptide
  Fc chain of XENCS543

SEQ ID NO: 44513 - protein, 5 aa, Artificial Sequence
  Description of Artificial Sequence: Synthetic peptide
  XENCS543 vhCDR1
HYGIN

SEQ ID NO: 44514 - protein, 17 aa, Artificial Sequence
  Description of Artificial Sequence: Synthetic peptide
  XENCS543 vhCDR2
WINTYTGEPYYAPGFQE

SEQ ID NO: 44515 - protein, 8 aa, Artificial Sequence
  Description of Artificial Sequence: Synthetic peptide
  XENCS543 vhCDR3
DYYGSSPY

SEQ ID NO: 44516 - protein, 16 aa, Artificial Sequence
  Description of Artificial Sequence: Synthetic peptide
  XENCS543 vlCDR1
KSSQSIVHSNGNTYLE

SEQ ID NO: 44517 - protein, 7 aa, Artificial Sequence
  Description of Artificial Sequence: Synthetic peptide
  XENCS543 vlCDR2
KVSNRFS

SEQ ID NO: 44518 - protein, 9 aa, Artificial Sequence
  Description of Artificial Sequence: Synthetic peptide
  XENCS543 vlCDR3
FQGSHVPNT

SEQ ID NO: 44519 - protein, 214 aa, Artificial Sequence; identical to SEQ ID NO: 43659
  Description of Artificial Sequence: Synthetic polypeptide
  XenCS543 Chain 3 - [ICOS]_L0

SEQ ID NO: 44520 - protein, 107 aa, Artificial Sequence; identical to SEQ ID NO: 43660
  Description of Artificial Sequence: Synthetic polypeptide
  VL of XENCS543

SEQ ID NO: 44521 - protein, 11 aa, Artificial Sequence
  Description of Artificial Sequence: Synthetic peptide
  XENCS543 vlCDR1
RASQGISRLLA

SEQ ID NO: 44522 - protein, 7 aa, Artificial Sequence
  Description of Artificial Sequence: Synthetic peptide
  XENCS543 vlCDR2
VASSLQS

SEQ ID NO: 44523 - protein, 9 aa, Artificial Sequence
  Description of Artificial Sequence: Synthetic peptide
  XENCS543 vlCDR3
QQANSFPWT

SEQ ID NO: 44524 - protein, 447 aa, Artificial Sequence; identical to SEQ ID NO: 23556
  Description of Artificial Sequence: Synthetic polypeptide
  XenCS544 Chain 1 - [CTLA-4]_H3_ IgG1_pI(-)_Isosteric_A_/PVA_ /S267K/L368D/K370S/M428L/N434S

SEQ ID NO: 44525 - protein, 118 aa, Artificial Sequence; identical to SEQ ID NO: 139
  Description of Artificial Sequence: Synthetic polypeptide
  VH of XENCS544

SEQ ID NO: 44526 - protein, 5 aa, Artificial Sequence
  Description of Artificial Sequence: Synthetic peptide
  XENCS544 vhCDR1
SYTMH

SEQ ID NO: 44527 - protein, 17 aa, Artificial Sequence
  Description of Artificial Sequence: Synthetic peptide
  XENCS544 vhCDR2
FISYDGNNKYYADSVKG

SEQ ID NO: 44528 - protein, 9 aa, Artificial Sequence
  Description of Artificial Sequence: Synthetic peptide
  XENCS544 vhCDR3
TGWLGPFDY

SEQ ID NO: 44529 - protein, 480 aa, Artificial Sequence; identical to SEQ ID NO: 44489
  Description of Artificial Sequence: Synthetic polypeptide
  XenCS544 Chain 2 - 1C11[PD-1]_H3.241_L3.148_scFv(GKPGS)4_Fc(216)_ IgG1_C220S/PVA_/S267K/S364K/E357Q/M428L/N434S

SEQ ID NO: 44530 - protein, 117 aa, Artificial Sequence; identical to SEQ ID NO: 40840
  Description of Artificial Sequence: Synthetic polypeptide
  VH of XENCS544

SEQ ID NO: 44531 - protein, 112 aa, Artificial Sequence; identical to SEQ ID NO: 33009
  Description of Artificial Sequence: Synthetic polypeptide
  VL of XENCS544

SEQ ID NO: 44532 - protein, 231 aa, Artificial Sequence; identical to SEQ ID NO: 21572
  Description of Artificial Sequence: Synthetic polypeptide
  Fc chain of XENCS544

SEQ ID NO: 44533 - protein, 5 aa, Artificial Sequence
  Description of Artificial Sequence: Synthetic peptide
  XENCS544 vhCDR1
HYGIN

SEQ ID NO: 44534 - protein, 17 aa, Artificial Sequence
  Description of Artificial Sequence: Synthetic peptide
  XENCS544 vhCDR2
WINTYTGEPYYAPGFQE

SEQ ID NO: 44535 - protein, 8 aa, Artificial Sequence
  Description of Artificial Sequence: Synthetic peptide
  XENCS544 vhCDR3
DYYGSSPY

SEQ ID NO: 44536 - protein, 16 aa, Artificial Sequence
  Description of Artificial Sequence: Synthetic peptide
  XENCS544 vlCDR1
KSSQSIVHSNGNTYLE

SEQ ID NO: 44537 - protein, 7 aa, Artificial Sequence
  Description of Artificial Sequence: Synthetic peptide
  XENCS544 vlCDR2
KVSNRFS

SEQ ID NO: 44538 - protein, 9 aa, Artificial Sequence
  Description of Artificial Sequence: Synthetic peptide
  XENCS544 vlCDR3
FQGSHVPNT

SEQ ID NO: 44539 - protein, 215 aa, Artificial Sequence; identical to SEQ ID NO: 4504
  Description of Artificial Sequence: Synthetic polypeptide
  XenCS544 Chain 3 - [CTLA-4]_L0.22

SEQ ID NO: 44540 - protein, 108 aa, Artificial Sequence; identical to SEQ ID NO: 1607
  Description of Artificial Sequence: Synthetic polypeptide
  VL of XENCS544

SEQ ID NO: 44541 - protein, 12 aa, Artificial Sequence
  Description of Artificial Sequence: Synthetic peptide
  XENCS544 vlCDR1
RASQSVSSSYLA

SEQ ID NO: 44542 - protein, 7 aa, Artificial Sequence
  Description of Artificial Sequence: Synthetic peptide
  XENCS544 vlCDR2
GAFSRAT

SEQ ID NO: 44543 - protein, 9 aa, Artificial Sequence
  Description of Artificial Sequence: Synthetic peptide
  XENCS544 vlCDR3
QQYGSSPWT

SEQ ID NO: 44544 - protein, 450 aa, Artificial Sequence; identical to SEQ ID NO: 35607
  Description of Artificial Sequence: Synthetic polypeptide
  XenCS545 Chain 1 - 7G8_H3.30_ IgG1_pI(-)_Isosteric_A_/PVA_ /S267K/L368D/K370S/M428L/N434S

SEQ ID NO: 44545 - protein, 121 aa, Artificial Sequence; identical to SEQ ID NO: 22485
  Description of Artificial Sequence: Synthetic polypeptide
  VH of XENCS545

SEQ ID NO: 44546 - protein, 5 aa, Artificial Sequence
  Description of Artificial Sequence: Synthetic peptide
  XENCS545 vhCDR1
DAWMS

SEQ ID NO: 44547 - protein, 19 aa, Artificial Sequence
  Description of Artificial Sequence: Synthetic peptide
  XENCS545 vhCDR2
EISTKANNHATYYAESVKG

SEQ ID NO: 44548 - protein, 10 aa, Artificial Sequence
  Description of Artificial Sequence: Synthetic peptide
  XENCS545 vhCDR3
LATWDWYFDV

SEQ ID NO: 44549 - protein, 480 aa, Artificial Sequence; identical to SEQ ID NO: 44489
  Description of Artificial Sequence: Synthetic polypeptide
  XenCS545 Chain 2 -1C11[PD-1]_H3.241_L3.148_scFv(GKPGS)4_Fc(216)_ IgG1_C220S/PVA_/S267K/S364K/E357Q/M428L/N434S

SEQ ID NO: 44550 - protein, 117 aa, Artificial Sequence; identical to SEQ ID NO: 40840
  Description of Artificial Sequence: Synthetic polypeptide
  VH of XENCS545

SEQ ID NO: 44551 - protein, 112 aa, Artificial Sequence; identical to SEQ ID NO: 33009
  Description of Artificial Sequence: Synthetic polypeptide
  VL of XENCS545

SEQ ID NO: 44552 - protein, 231 aa, Artificial Sequence; identical to SEQ ID NO: 21572
  Description of Artificial Sequence: Synthetic polypeptide
  Fc chain of XENCS545

SEQ ID NO: 44553 - protein, 5 aa, Artificial Sequence
  Description of Artificial Sequence: Synthetic peptide
  XENCS545 vhCDR1
HYGIN

SEQ ID NO: 44554 - protein, 17 aa, Artificial Sequence
  Description of Artificial Sequence: Synthetic peptide
  XENCS545 vhCDR2
WINTYTGEPYYAPGFQE

SEQ ID NO: 44555 - protein, 8 aa, Artificial Sequence
  Description of Artificial Sequence: Synthetic peptide
  XENCS545 vhCDR3
DYYGSSPY

SEQ ID NO: 44556 - protein, 16 aa, Artificial Sequence
  Description of Artificial Sequence: Synthetic peptide
  XENCS545 vlCDR1
KSSQSIVHSNGNTYLE

SEQ ID NO: 44557 - protein, 7 aa, Artificial Sequence
  Description of Artificial Sequence: Synthetic peptide
  XENCS545 vlCDR2
KVSNRFS

SEQ ID NO: 44558 - protein, 9 aa, Artificial Sequence
  Description of Artificial Sequence: Synthetic peptide
  XENCS545 vlCDR3
FQGSHVPNT

SEQ ID NO: 44559 - protein, 218 aa, Artificial Sequence; identical to SEQ ID NO: 22599
  Description of Artificial Sequence: Synthetic polypeptide
  XenCS545 Chain 3 - 7G8_L1.34

SEQ ID NO: 44560 - protein, 111 aa, Artificial Sequence; identical to SEQ ID NO: 22600
  Description of Artificial Sequence: Synthetic polypeptide
  VL of XENCS545

SEQ ID NO: 44561 - protein, 15 aa, Artificial Sequence
  Description of Artificial Sequence: Synthetic peptide
  XENCS545 vlCDR1
RASQSVDYDGDSYMN

SEQ ID NO: 44562 - protein, 7 aa, Artificial Sequence
  Description of Artificial Sequence: Synthetic peptide
  XENCS545 vlCDR2
AASELES

SEQ ID NO: 44563 - protein, 9 aa, Artificial Sequence
  Description of Artificial Sequence: Synthetic peptide
  XENCS545 vlCDR3
QQSNEDPFT

SEQ ID NO: 44564 - protein, 447 aa, Artificial Sequence; identical to SEQ ID NO: 35647
  Description of Artificial Sequence: Synthetic polypeptide
  XenCS546 Chain 1 - 2A11_H1.144_ IgG1_pI(-)_Isosteric_A_/PVA_ /S267K/L368D/K370S/M428L/N434S

SEQ ID NO: 44565 - protein, 118 aa, Artificial Sequence; identical to SEQ ID NO: 22085
  Description of Artificial Sequence: Synthetic polypeptide
  VH of XENCS546

SEQ ID NO: 44566 - protein, 5 aa, Artificial Sequence
  Description of Artificial Sequence: Synthetic peptide
  XENCS546 vhCDR1
DYFMH

SEQ ID NO: 44567 - protein, 17 aa, Artificial Sequence
  Description of Artificial Sequence: Synthetic peptide
  XENCS546 vhCDR2
WIDPELGDTEYAPKFQG

SEQ ID NO: 44568 - protein, 9 aa, Artificial Sequence
  Description of Artificial Sequence: Synthetic peptide
  XENCS546 vhCDR3
RGVYQALDY

SEQ ID NO: 44569 - protein, 480 aa, Artificial Sequence; identical to SEQ ID NO: 44489
  Description of Artificial Sequence: Synthetic polypeptide
  XenCS546 Chain 2 - 1C11[PD-1]_H3.241_L3.148_scFv(GKPGS)4_Fc(216)_ IgG1_C220S/PVA_/S267K/S364K/E357Q/M428L/N434S

SEQ ID NO: 44570 - protein, 117 aa, Artificial Sequence; identical to SEQ ID NO: 40840
  Description of Artificial Sequence: Synthetic polypeptide
  VH of XENCS546

SEQ ID NO: 44571 - protein, 112 aa, Artificial Sequence; identical to SEQ ID NO: 33009
  Description of Artificial Sequence: Synthetic polypeptide
  VL of XENCS546

SEQ ID NO: 44572 - protein, 231 aa, Artificial Sequence; identical to SEQ ID NO: 21572
  Description of Artificial Sequence: Synthetic polypeptide
  Fc chain of XENCS546

SEQ ID NO: 44573 - protein, 5 aa, Artificial Sequence
  Description of Artificial Sequence: Synthetic peptide
  XENCS546 vhCDR1
HYGIN

SEQ ID NO: 44574 - protein, 17 aa, Artificial Sequence
  Description of Artificial Sequence: Synthetic peptide
  XENCS546 vhCDR2
WINTYTGEPYYAPGFQE

SEQ ID NO: 44575 - protein, 8 aa, Artificial Sequence
  Description of Artificial Sequence: Synthetic peptide
  XENCS546 vhCDR3
DYYGSSPY

SEQ ID NO: 44576 - protein, 16 aa, Artificial Sequence
  Description of Artificial Sequence: Synthetic peptide
  XENCS546 vlCDR1
KSSQSIVHSNGNTYLE

SEQ ID NO: 44577 - protein, 7 aa, Artificial Sequence
  Description of Artificial Sequence: Synthetic peptide
  XENCS546 vlCDR2
KVSNRFS

SEQ ID NO: 44578 - protein, 9 aa, Artificial Sequence
  Description of Artificial Sequence: Synthetic peptide
  XENCS546 vlCDR3
FQGSHVPNT

SEQ ID NO: 44579 - protein, 214 aa, Artificial Sequence; identical to SEQ ID NO: 22279
  Description of Artificial Sequence: Synthetic polypeptide
  XenCS546 Chain 3 - 2A11_L2.142

SEQ ID NO: 44580 - protein, 107 aa, Artificial Sequence; identical to SEQ ID NO: 22280
  Description of Artificial Sequence: Synthetic polypeptide
  VL of XENCS546

SEQ ID NO: 44581 - protein, 11 aa, Artificial Sequence
  Description of Artificial Sequence: Synthetic peptide
  XENCS546 vlCDR1
QASQDIGNYLN

SEQ ID NO: 44582 - protein, 7 aa, Artificial Sequence
  Description of Artificial Sequence: Synthetic peptide
  XENCS546 vlCDR2
FTSYLHS

SEQ ID NO: 44583 - protein, 9 aa, Artificial Sequence
  Description of Artificial Sequence: Synthetic peptide
  XENCS546 vlCDR3
QQGNTLPYT

SEQ ID NO: 44584 - protein, 446 aa, Artificial Sequence; identical to SEQ ID NO: 44304
  Description of Artificial Sequence: Synthetic polypeptide
  XenCS547 Chain 1 - 3H3_H1_ IgG1_pI(-)_Isosteric_A_/PVA_ /S267K/L368D/K370S/M428L/N434S

SEQ ID NO: 44585 - protein, 117 aa, Artificial Sequence; identical to SEQ ID NO: 36368
  Description of Artificial Sequence: Synthetic polypeptide
  VH of XENCS547

SEQ ID NO: 44586 - protein, 5 aa, Artificial Sequence
  Description of Artificial Sequence: Synthetic peptide
  XENCS547 vhCDR1
GYGVN

SEQ ID NO: 44587 - protein, 16 aa, Artificial Sequence
  Description of Artificial Sequence: Synthetic peptide
  XENCS547 vhCDR2
MIWGDGSTDYNSALKS

SEQ ID NO: 44588 - protein, 9 aa, Artificial Sequence
  Description of Artificial Sequence: Synthetic peptide
  XENCS547 vhCDR3
SYYTSDEDY

SEQ ID NO: 44589 - protein, 480 aa, Artificial Sequence; identical to SEQ ID NO: 44489
  Description of Artificial Sequence: Synthetic polypeptide
  XenCS547 Chain 2 - 1C11[PD-1]_H3.241_L3.148_scFv(GKPGS)4_Fc(216)_ IgG1_C220S/PVA_/S267K/S364K/E357Q/M428L/N434S

SEQ ID NO: 44590 - protein, 117 aa, Artificial Sequence; identical to SEQ ID NO: 40840
  Description of Artificial Sequence: Synthetic polypeptide
  VH of XENCS547

SEQ ID NO: 44591 - protein, 112 aa, Artificial Sequence; identical to SEQ ID NO: 33009
  Description of Artificial Sequence: Synthetic polypeptide
  VL of XENCS547

SEQ ID NO: 44592 - protein, 231 aa, Artificial Sequence; identical to SEQ ID NO: 21572
  Description of Artificial Sequence: Synthetic polypeptide
  Fc chain of XENCS547

SEQ ID NO: 44593 - protein, 5 aa, Artificial Sequence
  Description of Artificial Sequence: Synthetic peptide
  XENCS547 vhCDR1
HYGIN

SEQ ID NO: 44594 - protein, 17 aa, Artificial Sequence
  Description of Artificial Sequence: Synthetic peptide
  XENCS547 vhCDR2
WINTYTGEPYYAPGFQE

SEQ ID NO: 44595 - protein, 8 aa, Artificial Sequence
  Description of Artificial Sequence: Synthetic peptide
  XENCS547 vhCDR3
DYYGSSPY

SEQ ID NO: 44596 - protein, 16 aa, Artificial Sequence
  Description of Artificial Sequence: Synthetic peptide
  XENCS547 vlCDR1
KSSQSIVHSNGNTYLE

SEQ ID NO: 44597 - protein, 7 aa, Artificial Sequence
  Description of Artificial Sequence: Synthetic peptide
  XENCS547 vlCDR2
KVSNRFS

SEQ ID NO: 44598 - protein, 9 aa, Artificial Sequence
  Description of Artificial Sequence: Synthetic peptide
  XENCS547 vlCDR3
FQGSHVPNT

SEQ ID NO: 44599 - protein, 219 aa, Artificial Sequence; identical to SEQ ID NO: 36512
  Description of Artificial Sequence: Synthetic polypeptide
  XenCS547 Chain 3 - 3H3_L2.1

SEQ ID NO: 44600 - protein, 112 aa, Artificial Sequence; identical to SEQ ID NO: 36513
  Description of Artificial Sequence: Synthetic polypeptide
  VL of XENCS547

SEQ ID NO: 44601 - protein, 17 aa, Artificial Sequence
  Description of Artificial Sequence: Synthetic peptide
  XENCS547 vlCDR1
KSSQSLLNSRTRKNYLA

SEQ ID NO: 44602 - protein, 7 aa, Artificial Sequence
  Description of Artificial Sequence: Synthetic peptide
  XENCS547 vlCDR2
WASTRES

SEQ ID NO: 44603 - protein, 8 aa, Artificial Sequence
  Description of Artificial Sequence: Synthetic peptide
  XENCS547 vlCDR3
KQSYSLRT

SEQ ID NO: 44604 - protein, 447 aa, Artificial Sequence; identical to SEQ ID NO: 36147
  Description of Artificial Sequence: Synthetic polypeptide
  XenCS548 Chain 1 - 9C6_H1.1_ IgG1_pI(-)_Isosteric_A_/PVA_ /S267K/L368D/K370S/M428L/N434S

SEQ ID NO: 44605 - protein, 118 aa, Artificial Sequence; identical to SEQ ID NO: 21205
  Description of Artificial Sequence: Synthetic polypeptide
  VH of XENCS548

SEQ ID NO: 44606 - protein, 5 aa, Artificial Sequence
  Description of Artificial Sequence: Synthetic peptide
  XENCS548 vhCDR1
GYGVN

SEQ ID NO: 44607 - protein, 16 aa, Artificial Sequence
  Description of Artificial Sequence: Synthetic peptide
  XENCS548 vhCDR2
MIWIDGSTDYNSKFQG

SEQ ID NO: 44608 - protein, 10 aa, Artificial Sequence
  Description of Artificial Sequence: Synthetic peptide
  XENCS548 vhCDR3
DRPDGRAMDY

SEQ ID NO: 44609 - protein, 480 aa, Artificial Sequence; identical to SEQ ID NO: 44489
  Description of Artificial Sequence: Synthetic polypeptide
  XenCS548 Chain 2 - 1C11[PD-1]_H3.241_L3.148_scFv(GKPGS)4_Fc(216)_ IgG1_C220S/PVA_/S267K/S364K/E357Q/M428L/N434S

SEQ ID NO: 44610 - protein, 117 aa, Artificial Sequence; identical to SEQ ID NO: 40840
  Description of Artificial Sequence: Synthetic polypeptide
  VH of XENCS548

SEQ ID NO: 44611 - protein, 112 aa, Artificial Sequence; identical to SEQ ID NO: 33009
  Description of Artificial Sequence: Synthetic polypeptide
  VL of XENCS548

SEQ ID NO: 44612 - protein, 231 aa, Artificial Sequence; identical to SEQ ID NO: 21572
  Description of Artificial Sequence: Synthetic polypeptide
  Fc chain of XENCS548

SEQ ID NO: 44613 - protein, 5 aa, Artificial Sequence
  Description of Artificial Sequence: Synthetic peptide
  XENCS548 vhCDR1
HYGIN

SEQ ID NO: 44614 - protein, 17 aa, Artificial Sequence
  Description of Artificial Sequence: Synthetic peptide
  XENCS548 vhCDR2
WINTYTGEPYYAPGFQE

SEQ ID NO: 44615 - protein, 8 aa, Artificial Sequence
  Description of Artificial Sequence: Synthetic peptide
  XENCS548 vhCDR3
DYYGSSPY

SEQ ID NO: 44616 - protein, 16 aa, Artificial Sequence
  Description of Artificial Sequence: Synthetic peptide
  XENCS548 vlCDR1
KSSQSIVHSNGNTYLE

SEQ ID NO: 44617 - protein, 7 aa, Artificial Sequence
  Description of Artificial Sequence: Synthetic peptide
  XENCS548 vlCDR2
KVSNRFS

SEQ ID NO: 44618 - protein, 9 aa, Artificial Sequence
  Description of Artificial Sequence: Synthetic peptide
  XENCS548 vlCDR3
FQGSHVPNT

SEQ ID NO: 44619 - protein, 213 aa, Artificial Sequence; identical to SEQ ID NO: 21050
  Description of Artificial Sequence: Synthetic polypeptide
  XenCS548 Chain 3 - 9C6_L1

SEQ ID NO: 44620 - protein, 106 aa, Artificial Sequence; identical to SEQ ID NO: 21051
  Description of Artificial Sequence: Synthetic polypeptide
  VL of XENCS548

SEQ ID NO: 44621 - protein, 11 aa, Artificial Sequence
  Description of Artificial Sequence: Synthetic peptide
  XENCS548 vlCDR1
KASQSVSNDVA

SEQ ID NO: 44622 - protein, 7 aa, Artificial Sequence
  Description of Artificial Sequence: Synthetic peptide
  XENCS548 vlCDR2
YASNRYT

SEQ ID NO: 44623 - protein, 8 aa, Artificial Sequence
  Description of Artificial Sequence: Synthetic peptide
  XENCS548 vlCDR3
QQDYSSPT

SEQ ID NO: 44624 - protein, 454 aa, Artificial Sequence; identical to SEQ ID NO: 44204
  Description of Artificial Sequence: Synthetic polypeptide
  XenCS549 Chain 1 - [ICOS]_H0_ IgG1_pI(-)_Isosteric_A_/PVA_ /S267K/L368D/K370S/M428L/N434S

SEQ ID NO: 44625 - protein, 125 aa, Artificial Sequence; identical to SEQ ID NO: 43645
  Description of Artificial Sequence: Synthetic polypeptide
  VH of XENCS549

SEQ ID NO: 44626 - protein, 5 aa, Artificial Sequence
  Description of Artificial Sequence: Synthetic peptide
  XENCS549 vhCDR1
GYYMH

SEQ ID NO: 44627 - protein, 17 aa, Artificial Sequence
  Description of Artificial Sequence: Synthetic peptide
  XENCS549 vhCDR2
WINPHSGGTNYAQKFQG

SEQ ID NO: 44628 - protein, 16 aa, Artificial Sequence
  Description of Artificial Sequence: Synthetic peptide
  XENCS549 vhCDR3
TYYYDSSGYYHDAFDI

SEQ ID NO: 44629 - protein, 480 aa, Artificial Sequence
  Description of Artificial Sequence: Synthetic polypeptide
  XenCS549 Chain 2 - 1C11[PD-1]_H3.241_L3.92_scFv(GKPGS)4_Fc(216)_ IgG1_C220S/PVA_/S267K/S364K/E357Q/M428L/N434S
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 44630 - protein, 117 aa, Artificial Sequence; identical to SEQ ID NO: 40840
  Description of Artificial Sequence: Synthetic polypeptide
  VH of XENCS549

SEQ ID NO: 44631 - protein, 112 aa, Artificial Sequence; identical to SEQ ID NO: 39932
  Description of Artificial Sequence: Synthetic polypeptide
  VL of XENCS549

SEQ ID NO: 44632 - protein, 231 aa, Artificial Sequence; identical to SEQ ID NO: 21572
  Description of Artificial Sequence: Synthetic polypeptide
  Fc chain of XENCS549

SEQ ID NO: 44633 - protein, 5 aa, Artificial Sequence
  Description of Artificial Sequence: Synthetic peptide
  XENCS549 vhCDR1
HYGIN

SEQ ID NO: 44634 - protein, 17 aa, Artificial Sequence
  Description of Artificial Sequence: Synthetic peptide
  XENCS549 vhCDR2
WINTYTGEPYYAPGFQE

SEQ ID NO: 44635 - protein, 8 aa, Artificial Sequence
  Description of Artificial Sequence: Synthetic peptide
  XENCS549 vhCDR3
DYYGSSPY

SEQ ID NO: 44636 - protein, 16 aa, Artificial Sequence
  Description of Artificial Sequence: Synthetic peptide
  XENCS549 vlCDR1
KASQSIVHSNGNTYLE

SEQ ID NO: 44637 - protein, 7 aa, Artificial Sequence
  Description of Artificial Sequence: Synthetic peptide
  XENCS549 vlCDR2
KVSNRFT

SEQ ID NO: 44638 - protein, 9 aa, Artificial Sequence
  Description of Artificial Sequence: Synthetic peptide
  XENCS549 vlCDR3
FQGSHVPNT

SEQ ID NO: 44639 - protein, 214 aa, Artificial Sequence; identical to SEQ ID NO: 43659
  Description of Artificial Sequence: Synthetic polypeptide
  XenCS549 Chain 3 - [ICOS]_L0

SEQ ID NO: 44640 - protein, 107 aa, Artificial Sequence; identical to SEQ ID NO: 43660
  Description of Artificial Sequence: Synthetic polypeptide
  VL of XENCS549

SEQ ID NO: 44641 - protein, 11 aa, Artificial Sequence
  Description of Artificial Sequence: Synthetic peptide
  XENCS549 vlCDR1
RASQGISRLLA

SEQ ID NO: 44642 - protein, 7 aa, Artificial Sequence
  Description of Artificial Sequence: Synthetic peptide
  XENCS549 vlCDR2
VASSLQS

SEQ ID NO: 44643 - protein, 9 aa, Artificial Sequence
  Description of Artificial Sequence: Synthetic peptide
  XENCS549 vlCDR3
QQANSFPWT

SEQ ID NO: 44644 - protein, 454 aa, Artificial Sequence; identical to SEQ ID NO: 44224
  Description of Artificial Sequence: Synthetic polypeptide
  XenCS550 Chain 1 - [ICOS]_H0.66_ IgG1_pI(-)_Isosteric_A_/PVA_ /S267K/L368D/K370S/M428L/N434S

SEQ ID NO: 44645 - protein, 125 aa, Artificial Sequence; identical to SEQ ID NO: 43665
  Description of Artificial Sequence: Synthetic polypeptide
  VH of XENCS550

SEQ ID NO: 44646 - protein, 5 aa, Artificial Sequence
  Description of Artificial Sequence: Synthetic peptide
  XENCS550 vhCDR1
GYYMH

SEQ ID NO: 44647 - protein, 17 aa, Artificial Sequence
  Description of Artificial Sequence: Synthetic peptide
  XENCS550 vhCDR2
WINPHSGETIYAQKFQG

SEQ ID NO: 44648 - protein, 16 aa, Artificial Sequence
  Description of Artificial Sequence: Synthetic peptide
  XENCS550 vhCDR3
TYYYDTSGYYHDAFDV

SEQ ID NO: 44649 - protein, 480 aa, Artificial Sequence; identical to SEQ ID NO: 44629
  Description of Artificial Sequence: Synthetic polypeptide
  XenCS550 Chain 2 - 1C11[PD-1]_H3.241_L3.92_scFv(GKPGS)4_Fc(216)_ IgG1_C220S/PVA_/S267K/S364K/E357Q/M428L/N434S

SEQ ID NO: 44650 - protein, 117 aa, Artificial Sequence; identical to SEQ ID NO: 40840
  Description of Artificial Sequence: Synthetic polypeptide
  VH of XENCS550

SEQ ID NO: 44651 - protein, 112 aa, Artificial Sequence; identical to SEQ ID NO: 39932
  Description of Artificial Sequence: Synthetic polypeptide
  VL of XENCS550

SEQ ID NO: 44652 - protein, 231 aa, Artificial Sequence; identical to SEQ ID NO: 21572
  Description of Artificial Sequence: Synthetic polypeptide
  Fc chain of XENCS550

SEQ ID NO: 44653 - protein, 5 aa, Artificial Sequence
  Description of Artificial Sequence: Synthetic peptide
  XENCS550 vhCDR1
HYGIN

SEQ ID NO: 44654 - protein, 17 aa, Artificial Sequence
  Description of Artificial Sequence: Synthetic peptide
  XENCS550 vhCDR2
WINTYTGEPYYAPGFQE

SEQ ID NO: 44655 - protein, 8 aa, Artificial Sequence
  Description of Artificial Sequence: Synthetic peptide
  XENCS550 vhCDR3
DYYGSSPY

SEQ ID NO: 44656 - protein, 16 aa, Artificial Sequence
  Description of Artificial Sequence: Synthetic peptide
  XENCS550 vlCDR1
KASQSIVHSNGNTYLE

SEQ ID NO: 44657 - protein, 7 aa, Artificial Sequence
  Description of Artificial Sequence: Synthetic peptide
  XENCS550 vlCDR2
KVSNRFT

SEQ ID NO: 44658 - protein, 9 aa, Artificial Sequence
  Description of Artificial Sequence: Synthetic peptide
  XENCS550 vlCDR3
FQGSHVPNT

SEQ ID NO: 44659 - protein, 214 aa, Artificial Sequence; identical to SEQ ID NO: 43659
  Description of Artificial Sequence: Synthetic polypeptide
  XenCS550 Chain 3 - [ICOS]_L0

SEQ ID NO: 44660 - protein, 107 aa, Artificial Sequence; identical to SEQ ID NO: 43660
  Description of Artificial Sequence: Synthetic polypeptide
  VL of XENCS550

SEQ ID NO: 44661 - protein, 11 aa, Artificial Sequence
  Description of Artificial Sequence: Synthetic peptide
  XENCS550 vlCDR1
RASQGISRLLA

SEQ ID NO: 44662 - protein, 7 aa, Artificial Sequence
  Description of Artificial Sequence: Synthetic peptide
  XENCS550 vlCDR2
VASSLQS

SEQ ID NO: 44663 - protein, 9 aa, Artificial Sequence
  Description of Artificial Sequence: Synthetic peptide
  XENCS550 vlCDR3
QQANSFPWT

SEQ ID NO: 44664 - protein, 447 aa, Artificial Sequence; identical to SEQ ID NO: 23556
  Description of Artificial Sequence: Synthetic polypeptide
  XenCS551 Fab Chain 1 - [CTLA-4]_H3_ IgG1_pI(-)_Isosteric_A_/PVA_ /S267K/L368D/K370S/M428L/N434S

SEQ ID NO: 44665 - protein, 118 aa, Artificial Sequence; identical to SEQ ID NO: 139
  Description of Artificial Sequence: Synthetic polypeptide
  VH of XENCS551

SEQ ID NO: 44666 - protein, 5 aa, Artificial Sequence
  Description of Artificial Sequence: Synthetic peptide
  XENCS551 vhCDR1
SYTMH

SEQ ID NO: 44667 - protein, 17 aa, Artificial Sequence
  Description of Artificial Sequence: Synthetic peptide
  XENCS551 vhCDR2
FISYDGNNKYYADSVKG

SEQ ID NO: 44668 - protein, 9 aa, Artificial Sequence
  Description of Artificial Sequence: Synthetic peptide
  XENCS551 vhCDR3
TGWLGPFDY

SEQ ID NO: 44669 - protein, 480 aa, Artificial Sequence; identical to SEQ ID NO: 44629
  Description of Artificial Sequence: Synthetic polypeptide
  XenCS551 scFv Chain 2 - 1C11[PD-1]_H3.241_L3.92_scFv(GKPGS)4_ Fc(216)_IgG1_C220S/PVA_/S267K/S364K/E357Q/M428L/N434S

SEQ ID NO: 44670 - protein, 117 aa, Artificial Sequence; identical to SEQ ID NO: 40840
  Description of Artificial Sequence: Synthetic polypeptide
  VH of XENCS551

SEQ ID NO: 44671 - protein, 112 aa, Artificial Sequence; identical to SEQ ID NO: 39932
  Description of Artificial Sequence: Synthetic polypeptide
  VL of XENCS551

SEQ ID NO: 44672 - protein, 231 aa, Artificial Sequence; identical to SEQ ID NO: 21572
  Description of Artificial Sequence: Synthetic polypeptide
  Fc chain of XENCS551

SEQ ID NO: 44673 - protein, 5 aa, Artificial Sequence
  Description of Artificial Sequence: Synthetic peptide
  XENCS551 vhCDR1
HYGIN

SEQ ID NO: 44674 - protein, 17 aa, Artificial Sequence
  Description of Artificial Sequence: Synthetic peptide
  XENCS551 vhCDR2
WINTYTGEPYYAPGFQE

SEQ ID NO: 44675 - protein, 8 aa, Artificial Sequence
  Description of Artificial Sequence: Synthetic peptide
  XENCS551 vhCDR3
DYYGSSPY

SEQ ID NO: 44676 - protein, 16 aa, Artificial Sequence
  Description of Artificial Sequence: Synthetic peptide
  XENCS551 vlCDR1
KASQSIVHSNGNTYLE

SEQ ID NO: 44677 - protein, 7 aa, Artificial Sequence
  Description of Artificial Sequence: Synthetic peptide
  XENCS551 vlCDR2
KVSNRFT

SEQ ID NO: 44678 - protein, 9 aa, Artificial Sequence
  Description of Artificial Sequence: Synthetic peptide
  XENCS551 vlCDR3
FQGSHVPNT

SEQ ID NO: 44679 - protein, 215 aa, Artificial Sequence; identical to SEQ ID NO: 4504
  Description of Artificial Sequence: Synthetic polypeptide
  XenCS551 Light Chain 3 - [CTLA-4]_L0.22

SEQ ID NO: 44680 - protein, 108 aa, Artificial Sequence; identical to SEQ ID NO: 1607
  Description of Artificial Sequence: Synthetic polypeptide
  VL of XENCS551

SEQ ID NO: 44681 - protein, 12 aa, Artificial Sequence
  Description of Artificial Sequence: Synthetic peptide
  XENCS551 vlCDR1
RASQSVSSSYLA

SEQ ID NO: 44682 - protein, 7 aa, Artificial Sequence
  Description of Artificial Sequence: Synthetic peptide
  XENCS551 vlCDR2
GAFSRAT

SEQ ID NO: 44683 - protein, 9 aa, Artificial Sequence
  Description of Artificial Sequence: Synthetic peptide
  XENCS551 vlCDR3
QQYGSSPWT

SEQ ID NO: 44684 - protein, 450 aa, Artificial Sequence; identical to SEQ ID NO: 35607
  Description of Artificial Sequence: Synthetic polypeptide
  XenCS552 Chain 1 - 7G8_H3.30_ IgG1_pI(-)_Isosteric_A_/PVA_ /S267K/L368D/K370S/M428L/N434S

SEQ ID NO: 44685 - protein, 121 aa, Artificial Sequence; identical to SEQ ID NO: 22485
  Description of Artificial Sequence: Synthetic polypeptide
  VH of XENCS552

SEQ ID NO: 44686 - protein, 5 aa, Artificial Sequence
  Description of Artificial Sequence: Synthetic peptide
  XENCS552 vhCDR1
DAWMS

SEQ ID NO: 44687 - protein, 19 aa, Artificial Sequence
  Description of Artificial Sequence: Synthetic peptide
  XENCS552 vhCDR2
EISTKANNHATYYAESVKG

SEQ ID NO: 44688 - protein, 10 aa, Artificial Sequence
  Description of Artificial Sequence: Synthetic peptide
  XENCS552 vhCDR3
LATWDWYFDV

SEQ ID NO: 44689 - protein, 480 aa, Artificial Sequence; identical to SEQ ID NO: 44629
  Description of Artificial Sequence: Synthetic polypeptide
  XenCS552 Chain 2 -1C11[PD-1]_H3.241_L3.92_scFv(GKPGS)4_Fc(216)_ IgG1_C220S/PVA_/S267K/S364K/E357Q/M428L/N434S

SEQ ID NO: 44690 - protein, 117 aa, Artificial Sequence; identical to SEQ ID NO: 40840
  Description of Artificial Sequence: Synthetic polypeptide
  VH of XENCS552

SEQ ID NO: 44691 - protein, 112 aa, Artificial Sequence; identical to SEQ ID NO: 39932
  Description of Artificial Sequence: Synthetic polypeptide
  VL of XENCS552

SEQ ID NO: 44692 - protein, 231 aa, Artificial Sequence; identical to SEQ ID NO: 21572
  Description of Artificial Sequence: Synthetic polypeptide
  Fc chain of XENCS552

SEQ ID NO: 44693 - protein, 5 aa, Artificial Sequence
  Description of Artificial Sequence: Synthetic peptide
  XENCS552 vhCDR1
HYGIN

SEQ ID NO: 44694 - protein, 17 aa, Artificial Sequence
  Description of Artificial Sequence: Synthetic peptide
  XENCS552 vhCDR2
WINTYTGEPYYAPGFQE

SEQ ID NO: 44695 - protein, 8 aa, Artificial Sequence
  Description of Artificial Sequence: Synthetic peptide
  XENCS552 vhCDR3
DYYGSSPY

SEQ ID NO: 44696 - protein, 16 aa, Artificial Sequence
  Description of Artificial Sequence: Synthetic peptide
  XENCS552 vlCDR1
KASQSIVHSNGNTYLE

SEQ ID NO: 44697 - protein, 7 aa, Artificial Sequence
  Description of Artificial Sequence: Synthetic peptide
  XENCS552 vlCDR2
KVSNRFT

SEQ ID NO: 44698 - protein, 9 aa, Artificial Sequence
  Description of Artificial Sequence: Synthetic peptide
  XENCS552 vlCDR3
FQGSHVPNT

SEQ ID NO: 44699 - protein, 218 aa, Artificial Sequence; identical to SEQ ID NO: 22599
  Description of Artificial Sequence: Synthetic polypeptide
  XenCS552 Chain 3 - 7G8_L1.34

SEQ ID NO: 44700 - protein, 111 aa, Artificial Sequence; identical to SEQ ID NO: 22600
  Description of Artificial Sequence: Synthetic polypeptide
  VL of XENCS552

SEQ ID NO: 44701 - protein, 15 aa, Artificial Sequence
  Description of Artificial Sequence: Synthetic peptide
  XENCS552 vlCDR1
RASQSVDYDGDSYMN

SEQ ID NO: 44702 - protein, 7 aa, Artificial Sequence
  Description of Artificial Sequence: Synthetic peptide
  XENCS552 vlCDR2
AASELES

SEQ ID NO: 44703 - protein, 9 aa, Artificial Sequence
  Description of Artificial Sequence: Synthetic peptide
  XENCS552 vlCDR3
QQSNEDPFT

SEQ ID NO: 44704 - protein, 447 aa, Artificial Sequence; identical to SEQ ID NO: 35647
  Description of Artificial Sequence: Synthetic polypeptide
  XenCS553 Chain 1 - 2A11_H1.144_ IgG1_pI(-)_Isosteric_A_/PVA_ /S267K/L368D/K370S/M428L/N434S

SEQ ID NO: 44705 - protein, 118 aa, Artificial Sequence; identical to SEQ ID NO: 22085
  Description of Artificial Sequence: Synthetic polypeptide
  VH of XENCS553

SEQ ID NO: 44706 - protein, 5 aa, Artificial Sequence
  Description of Artificial Sequence: Synthetic peptide
  XENCS553 vhCDR1
DYFMH

SEQ ID NO: 44707 - protein, 17 aa, Artificial Sequence
  Description of Artificial Sequence: Synthetic peptide
  XENCS553 vhCDR2
WIDPELGDTEYAPKFQG

SEQ ID NO: 44708 - protein, 9 aa, Artificial Sequence
  Description of Artificial Sequence: Synthetic peptide
  XENCS553 vhCDR3
RGVYQALDY

SEQ ID NO: 44709 - protein, 480 aa, Artificial Sequence; identical to SEQ ID NO: 44629
  Description of Artificial Sequence: Synthetic polypeptide
  XenCS553 Chain 2 - 1C11[PD-1]_H3.241_L3.92_scFv(GKPGS)4_Fc(216)_ IgG1_C220S/PVA_/S267K/S364K/E357Q/M428L/N434S

SEQ ID NO: 44710 - protein, 117 aa, Artificial Sequence; identical to SEQ ID NO: 40840
  Description of Artificial Sequence: Synthetic polypeptide
  VH of XENCS553

SEQ ID NO: 44711 - protein, 112 aa, Artificial Sequence; identical to SEQ ID NO: 39932
  Description of Artificial Sequence: Synthetic polypeptide
  VL of XENCS553

SEQ ID NO: 44712 - protein, 231 aa, Artificial Sequence; identical to SEQ ID NO: 21572
  Description of Artificial Sequence: Synthetic polypeptide
  Fc chain of XENCS553

SEQ ID NO: 44713 - protein, 5 aa, Artificial Sequence
  Description of Artificial Sequence: Synthetic peptide
  XENCS553 vhCDR1
HYGIN

SEQ ID NO: 44714 - protein, 17 aa, Artificial Sequence
  Description of Artificial Sequence: Synthetic peptide
  XENCS553 vhCDR2
WINTYTGEPYYAPGFQE

SEQ ID NO: 44715 - protein, 8 aa, Artificial Sequence
  Description of Artificial Sequence: Synthetic peptide
  XENCS553 vhCDR3
DYYGSSPY

SEQ ID NO: 44716 - protein, 16 aa, Artificial Sequence
  Description of Artificial Sequence: Synthetic peptide
  XENCS553 vlCDR1
KASQSIVHSNGNTYLE

SEQ ID NO: 44717 - protein, 7 aa, Artificial Sequence
  Description of Artificial Sequence: Synthetic peptide
  XENCS553 vlCDR2
KVSNRFT

SEQ ID NO: 44718 - protein, 9 aa, Artificial Sequence
  Description of Artificial Sequence: Synthetic peptide
  XENCS553 vlCDR3
FQGSHVPNT

SEQ ID NO: 44719 - protein, 214 aa, Artificial Sequence; identical to SEQ ID NO: 22279
  Description of Artificial Sequence: Synthetic polypeptide
  XenCS553 Chain 3 - 2A11_L2.142

SEQ ID NO: 44720 - protein, 107 aa, Artificial Sequence; identical to SEQ ID NO: 22280
  Description of Artificial Sequence: Synthetic polypeptide
  VL of XENCS553

SEQ ID NO: 44721 - protein, 11 aa, Artificial Sequence
  Description of Artificial Sequence: Synthetic peptide
  XENCS553 vlCDR1
QASQDIGNYLN

SEQ ID NO: 44722 - protein, 7 aa, Artificial Sequence
  Description of Artificial Sequence: Synthetic peptide
  XENCS553 vlCDR2
FTSYLHS

SEQ ID NO: 44723 - protein, 9 aa, Artificial Sequence
  Description of Artificial Sequence: Synthetic peptide
  XENCS553 vlCDR3
QQGNTLPYT

SEQ ID NO: 44724 - protein, 446 aa, Artificial Sequence; identical to SEQ ID NO: 44304
  Description of Artificial Sequence: Synthetic polypeptide
  XenCS554 Chain 1 - 3H3_H1_ IgG1_pI(-)_Isosteric_A_/PVA_ /S267K/L368D/K370S/M428L/N434S

SEQ ID NO: 44725 - protein, 117 aa, Artificial Sequence; identical to SEQ ID NO: 36368
  Description of Artificial Sequence: Synthetic polypeptide
  VH of XENCS554

SEQ ID NO: 44726 - protein, 5 aa, Artificial Sequence
  Description of Artificial Sequence: Synthetic peptide
  XENCS554 vhCDR1
GYGVN

SEQ ID NO: 44727 - protein, 16 aa, Artificial Sequence
  Description of Artificial Sequence: Synthetic peptide
  XENCS554 vhCDR2
MIWGDGSTDYNSALKS

SEQ ID NO: 44728 - protein, 9 aa, Artificial Sequence
  Description of Artificial Sequence: Synthetic peptide
  XENCS554 vhCDR3
SYYTSDEDY

SEQ ID NO: 44729 - protein, 480 aa, Artificial Sequence; identical to SEQ ID NO: 44629
  Description of Artificial Sequence: Synthetic polypeptide
  XenCS554 Chain 2 - 1C11[PD-1]_H3.241_L3.92_scFv(GKPGS)4_Fc(216)_ IgG1_C220S/PVA_/S267K/S364K/E357Q/M428L/N434S

SEQ ID NO: 44730 - protein, 117 aa, Artificial Sequence; identical to SEQ ID NO: 40840
  Description of Artificial Sequence: Synthetic polypeptide
  VH of XENCS554

SEQ ID NO: 44731 - protein, 112 aa, Artificial Sequence; identical to SEQ ID NO: 39932
  Description of Artificial Sequence: Synthetic polypeptide
  VL of XENCS554

SEQ ID NO: 44732 - protein, 231 aa, Artificial Sequence; identical to SEQ ID NO: 21572
  Description of Artificial Sequence: Synthetic polypeptide
  Fc chain of XENCS554

SEQ ID NO: 44733 - protein, 5 aa, Artificial Sequence
  Description of Artificial Sequence: Synthetic peptide
  XENCS554 vhCDR1
HYGIN

SEQ ID NO: 44734 - protein, 17 aa, Artificial Sequence
  Description of Artificial Sequence: Synthetic peptide
  XENCS554 vhCDR2
WINTYTGEPYYAPGFQE

SEQ ID NO: 44735 - protein, 8 aa, Artificial Sequence
  Description of Artificial Sequence: Synthetic peptide
  XENCS554 vhCDR3
DYYGSSPY

SEQ ID NO: 44736 - protein, 16 aa, Artificial Sequence
  Description of Artificial Sequence: Synthetic peptide
  XENCS554 vlCDR1
KASQSIVHSNGNTYLE

SEQ ID NO: 44737 - protein, 7 aa, Artificial Sequence
  Description of Artificial Sequence: Synthetic peptide
  XENCS554 vlCDR2
KVSNRFT

SEQ ID NO: 44738 - protein, 9 aa, Artificial Sequence
  Description of Artificial Sequence: Synthetic peptide
  XENCS554 vlCDR3
FQGSHVPNT

SEQ ID NO: 44739 - protein, 219 aa, Artificial Sequence; identical to SEQ ID NO: 36512
  Description of Artificial Sequence: Synthetic polypeptide
  XenCS554 Chain 3 - 3H3_L2.1

SEQ ID NO: 44740 - protein, 112 aa, Artificial Sequence; identical to SEQ ID NO: 36513
  Description of Artificial Sequence: Synthetic polypeptide
  VL of XENCS554

SEQ ID NO: 44741 - protein, 17 aa, Artificial Sequence
  Description of Artificial Sequence: Synthetic peptide
  XENCS554 vlCDR1
KSSQSLLNSRTRKNYLA

SEQ ID NO: 44742 - protein, 7 aa, Artificial Sequence
  Description of Artificial Sequence: Synthetic peptide
  XENCS554 vlCDR2
WASTRES

SEQ ID NO: 44743 - protein, 8 aa, Artificial Sequence
  Description of Artificial Sequence: Synthetic peptide
  XENCS554 vlCDR3
KQSYSLRT

SEQ ID NO: 44744 - protein, 447 aa, Artificial Sequence; identical to SEQ ID NO: 36147
  Description of Artificial Sequence: Synthetic polypeptide
  XenCS555 Chain 1 - 9C6_H1.1_ IgG1_pI(-)_Isosteric_A_/PVA_ /S267K/L368D/K370S/M428L/N434S

SEQ ID NO: 44745 - protein, 118 aa, Artificial Sequence; identical to SEQ ID NO: 21205
  Description of Artificial Sequence: Synthetic polypeptide
  VH of XENCS555

SEQ ID NO: 44746 - protein, 5 aa, Artificial Sequence
  Description of Artificial Sequence: Synthetic peptide
  XENCS555 vhCDR1
GYGVN

SEQ ID NO: 44747 - protein, 16 aa, Artificial Sequence
  Description of Artificial Sequence: Synthetic peptide
  XENCS555 vhCDR2
MIWIDGSTDYNSKFQG

SEQ ID NO: 44748 - protein, 10 aa, Artificial Sequence
  Description of Artificial Sequence: Synthetic peptide
  XENCS555 vhCDR3
DRPDGRAMDY

SEQ ID NO: 44749 - protein, 480 aa, Artificial Sequence; identical to SEQ ID NO: 44629
  Description of Artificial Sequence: Synthetic polypeptide
  XenCS555 Chain 2 - 1C11[PD-1]_H3.241_L3.92_scFv(GKPGS)4_Fc(216)_ IgG1_C220S/PVA_/S267K/S364K/E357Q/M428L/N434S

SEQ ID NO: 44750 - protein, 117 aa, Artificial Sequence; identical to SEQ ID NO: 40840
  Description of Artificial Sequence: Synthetic polypeptide
  VH of XENCS555

SEQ ID NO: 44751 - protein, 112 aa, Artificial Sequence; identical to SEQ ID NO: 39932
  Description of Artificial Sequence: Synthetic polypeptide
  VL of XENCS555

SEQ ID NO: 44752 - protein, 231 aa, Artificial Sequence; identical to SEQ ID NO: 21572
  Description of Artificial Sequence: Synthetic polypeptide
  Fc chain of XENCS555

SEQ ID NO: 44753 - protein, 5 aa, Artificial Sequence
  Description of Artificial Sequence: Synthetic peptide
  XENCS555 vhCDR1
HYGIN

SEQ ID NO: 44754 - protein, 17 aa, Artificial Sequence
  Description of Artificial Sequence: Synthetic peptide
  XENCS555 vhCDR2
WINTYTGEPYYAPGFQE

SEQ ID NO: 44755 - protein, 8 aa, Artificial Sequence
  Description of Artificial Sequence: Synthetic peptide
  XENCS555 vhCDR3
DYYGSSPY

SEQ ID NO: 44756 - protein, 16 aa, Artificial Sequence
  Description of Artificial Sequence: Synthetic peptide
  XENCS555 vlCDR1
KASQSIVHSNGNTYLE

SEQ ID NO: 44757 - protein, 7 aa, Artificial Sequence
  Description of Artificial Sequence: Synthetic peptide
  XENCS555 vlCDR2
KVSNRFT

SEQ ID NO: 44758 - protein, 9 aa, Artificial Sequence
  Description of Artificial Sequence: Synthetic peptide
  XENCS555 vlCDR3
FQGSHVPNT

SEQ ID NO: 44759 - protein, 213 aa, Artificial Sequence; identical to SEQ ID NO: 21050
  Description of Artificial Sequence: Synthetic polypeptide
  XenCS555 Chain 3 - 9C6_L1

SEQ ID NO: 44760 - protein, 106 aa, Artificial Sequence; identical to SEQ ID NO: 21051
  Description of Artificial Sequence: Synthetic polypeptide
  VL of XENCS555

SEQ ID NO: 44761 - protein, 11 aa, Artificial Sequence
  Description of Artificial Sequence: Synthetic peptide
  XENCS555 vlCDR1
KASQSVSNDVA

SEQ ID NO: 44762 - protein, 7 aa, Artificial Sequence
  Description of Artificial Sequence: Synthetic peptide
  XENCS555 vlCDR2
YASNRYT

SEQ ID NO: 44763 - protein, 8 aa, Artificial Sequence
  Description of Artificial Sequence: Synthetic peptide
  XENCS555 vlCDR3
QQDYSSPT

SEQ ID NO: 44764 - protein, 329 aa, Artificial Sequence; identical to SEQ ID NO: 37725
  Description of Artificial Sequence: Synthetic polypeptide
  XENCS:556 Fab Chain 1 - [alphaXXX]_HX_IgG1_pI(-)_Isosteric_A_/PVA_ /S267K/L368D/K370S

SEQ ID NO: 44765 - protein, 480 aa, Artificial Sequence; identical to SEQ ID NO: 43649
  Description of Artificial Sequence: Synthetic polypeptide
  XENCS:556 scFv Chain 2 - 1C11[PD-1]_H3.234_L3.144_scFv(GKPGS)4_ Fc(216)_IgG1_C220S/PVA_/S267K/S364K/E357Q

SEQ ID NO: 44766 - protein, 117 aa, Artificial Sequence; identical to SEQ ID NO: 40669
  Description of Artificial Sequence: Synthetic polypeptide
  VH of XENCS:556

SEQ ID NO: 44767 - protein, 112 aa, Artificial Sequence; identical to SEQ ID NO: 40517
  Description of Artificial Sequence: Synthetic polypeptide
  VL of XENCS:556

SEQ ID NO: 44768 - protein, 231 aa, Artificial Sequence; identical to SEQ ID NO: 21532
  Description of Artificial Sequence: Synthetic polypeptide
  Fc chain of XENCS:556

SEQ ID NO: 44769 - protein, 5 aa, Artificial Sequence
  Description of Artificial Sequence: Synthetic peptide
  XENCS:556 vhCDR1
HYGIN

SEQ ID NO: 44770 - protein, 17 aa, Artificial Sequence
  Description of Artificial Sequence: Synthetic peptide
  XENCS:556 vhCDR2
WINTYTGEPYYAPGFQE

SEQ ID NO: 44771 - protein, 8 aa, Artificial Sequence
  Description of Artificial Sequence: Synthetic peptide
  XENCS:556 vhCDR3
DYYGSSPY

SEQ ID NO: 44772 - protein, 16 aa, Artificial Sequence
  Description of Artificial Sequence: Synthetic peptide
  XENCS:556 vlCDR1
KASQSIVHSNGNTYLE

SEQ ID NO: 44773 - protein, 7 aa, Artificial Sequence
  Description of Artificial Sequence: Synthetic peptide
  XENCS:556 vlCDR2
KVSNRFS

SEQ ID NO: 44774 - protein, 9 aa, Artificial Sequence
  Description of Artificial Sequence: Synthetic peptide
  XENCS:556 vlCDR3
FQGSHVPNT

SEQ ID NO: 44775 - protein, 107 aa, Artificial Sequence [sequence omitted]

SEQ ID NO: 44776 - protein, 329 aa, Artificial Sequence; identical to SEQ ID NO: 37725
  Description of Artificial Sequence: Synthetic polypeptide
  XenCS557 Fab Chain 1 - [alphaXXX]_HX_ IgG1_pI(-)_Isosteric_A_/PVA_ /S267K/L368D/K370S

SEQ ID NO: 44777 - protein, 480 aa, Artificial Sequence; identical to SEQ ID NO: 43789
  Description of Artificial Sequence: Synthetic polypeptide
  XenCS557 scFv Chain 2 - 1C11[PD-1]_H3.240_L3.148_scFv(GKPGS)4_ Fc(216)_IgG1_C220S/PVA_/S267K/S364K/E357Q

SEQ ID NO: 44778 - protein, 117 aa, Artificial Sequence; identical to SEQ ID NO: 40831
  Description of Artificial Sequence: Synthetic polypeptide
  VH of XENCS557

SEQ ID NO: 44779 - protein, 112 aa, Artificial Sequence; identical to SEQ ID NO: 33009
  Description of Artificial Sequence: Synthetic polypeptide
  VL of XENCS557

SEQ ID NO: 44780 - protein, 231 aa, Artificial Sequence; identical to SEQ ID NO: 21532
  Description of Artificial Sequence: Synthetic polypeptide
  Fc chain of XENCS557

SEQ ID NO: 44781 - protein, 5 aa, Artificial Sequence
  Description of Artificial Sequence: Synthetic peptide
  XENCS557 vhCDR1
HYGIN

SEQ ID NO: 44782 - protein, 17 aa, Artificial Sequence
  Description of Artificial Sequence: Synthetic peptide
  XENCS557 vhCDR2
WINTYTGEPYYAPGFQE

SEQ ID NO: 44783 - protein, 8 aa, Artificial Sequence
  Description of Artificial Sequence: Synthetic peptide
  XENCS557 vhCDR3
DYYGSSPY

SEQ ID NO: 44784 - protein, 16 aa, Artificial Sequence
  Description of Artificial Sequence: Synthetic peptide
  XENCS557 vlCDR1
KSSQSIVHSNGNTYLE

SEQ ID NO: 44785 - protein, 7 aa, Artificial Sequence
  Description of Artificial Sequence: Synthetic peptide
  XENCS557 vlCDR2
KVSNRFS

SEQ ID NO: 44786 - protein, 9 aa, Artificial Sequence
  Description of Artificial Sequence: Synthetic peptide
  XENCS557 vlCDR3
FQGSHVPNT

SEQ ID NO: 44787 - protein, 107 aa, Artificial Sequence [sequence omitted]

SEQ ID NO: 44788 - protein, 329 aa, Artificial Sequence; identical to SEQ ID NO: 37725
  Description of Artificial Sequence: Synthetic polypeptide
  XenCS558 Fab Chain 1 - [alphaXXX]_HX_ IgG1_pI(-)_Isosteric_A_/PVA_ /S267K/L368D/K370S

SEQ ID NO: 44789 - protein, 480 aa, Artificial Sequence; identical to SEQ ID NO: 43929
  Description of Artificial Sequence: Synthetic polypeptide
  XenCS558 scFv Chain 2 - 1C11[PD-1]_H3.241_L3.148_scFv(GKPGS)4_ Fc(216)_IgG1_C220S/PVA_/S267K/S364K/E357Q

SEQ ID NO: 44790 - protein, 117 aa, Artificial Sequence; identical to SEQ ID NO: 40840
  Description of Artificial Sequence: Synthetic polypeptide
  VH of XENCS558

SEQ ID NO: 44791 - protein, 112 aa, Artificial Sequence; identical to SEQ ID NO: 33009
  Description of Artificial Sequence: Synthetic polypeptide
  VL of XENCS558

SEQ ID NO: 44792 - protein, 231 aa, Artificial Sequence; identical to SEQ ID NO: 21532
  Description of Artificial Sequence: Synthetic polypeptide
  Fc chain of XENCS558

SEQ ID NO: 44793 - protein, 5 aa, Artificial Sequence
  Description of Artificial Sequence: Synthetic peptide
  XENCS558 vhCDR1
HYGIN

SEQ ID NO: 44794 - protein, 17 aa, Artificial Sequence
  Description of Artificial Sequence: Synthetic peptide
  XENCS558 vhCDR2
WINTYTGEPYYAPGFQE

SEQ ID NO: 44795 - protein, 8 aa, Artificial Sequence
  Description of Artificial Sequence: Synthetic peptide
  XENCS558 vhCDR3
DYYGSSPY

SEQ ID NO: 44796 - protein, 16 aa, Artificial Sequence
  Description of Artificial Sequence: Synthetic peptide
  XENCS558 vlCDR1
KSSQSIVHSNGNTYLE

SEQ ID NO: 44797 - protein, 7 aa, Artificial Sequence
  Description of Artificial Sequence: Synthetic peptide
  XENCS558 vlCDR2
KVSNRFS

SEQ ID NO: 44798 - protein, 9 aa, Artificial Sequence
  Description of Artificial Sequence: Synthetic peptide
  XENCS558 vlCDR3
FQGSHVPNT

SEQ ID NO: 44799 - protein, 107 aa, Artificial Sequence [sequence omitted]

SEQ ID NO: 44800 - protein, 329 aa, Artificial Sequence; identical to SEQ ID NO: 37725
  Description of Artificial Sequence: Synthetic polypeptide
  XenCS559 Fab Chain 1 - [alphaXXX]_HX_ IgG1_pI(-)_Isosteric_A_/PVA_ /S267K/L368D/K370S

SEQ ID NO: 44801 - protein, 480 aa, Artificial Sequence; identical to SEQ ID NO: 44069
  Description of Artificial Sequence: Synthetic polypeptide
  XenCS559 scFv Chain 2 - 1C11[PD-1]_H3.241_L3.92_scFv(GKPGS)4_ Fc(216)_IgG1_C220S/PVA_/S267K/S364K/E357Q

SEQ ID NO: 44802 - protein, 117 aa, Artificial Sequence; identical to SEQ ID NO: 40840
  Description of Artificial Sequence: Synthetic polypeptide
  VH of XENCS559

SEQ ID NO: 44803 - protein, 112 aa, Artificial Sequence; identical to SEQ ID NO: 39932
  Description of Artificial Sequence: Synthetic polypeptide
  VL of XENCS559

SEQ ID NO: 44804 - protein, 231 aa, Artificial Sequence; identical to SEQ ID NO: 21532
  Description of Artificial Sequence: Synthetic polypeptide
  Fc chain of XENCS559

SEQ ID NO: 44805 - protein, 5 aa, Artificial Sequence
  Description of Artificial Sequence: Synthetic peptide
  XENCS559 vhCDR1
HYGIN

SEQ ID NO: 44806 - protein, 17 aa, Artificial Sequence
  Description of Artificial Sequence: Synthetic peptide
  XENCS559 vhCDR2
WINTYTGEPYYAPGFQE

SEQ ID NO: 44807 - protein, 8 aa, Artificial Sequence
  Description of Artificial Sequence: Synthetic peptide
  XENCS559 vhCDR3
DYYGSSPY

SEQ ID NO: 44808 - protein, 16 aa, Artificial Sequence
  Description of Artificial Sequence: Synthetic peptide
  XENCS559 vlCDR1
KASQSIVHSNGNTYLE

SEQ ID NO: 44809 - protein, 7 aa, Artificial Sequence
  Description of Artificial Sequence: Synthetic peptide
  XENCS559 vlCDR2
KVSNRFT

SEQ ID NO: 44810 - protein, 9 aa, Artificial Sequence
  Description of Artificial Sequence: Synthetic peptide
  XENCS559 vlCDR3
FQGSHVPNT

SEQ ID NO: 44811 - protein, 107 aa, Artificial Sequence [sequence omitted]

SEQ ID NO: 44812 - protein, 329 aa, Artificial Sequence
  Description of Artificial Sequence: Synthetic polypeptide
  XenCS560 Fab Chain 1 - [alphaXXX]_HX_IgG1_pI(-)_Isosteric_A_/PVA_ /S267K/L368D/K370S/M428L/N434S
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 44813 - protein, 480 aa, Artificial Sequence; identical to SEQ ID NO: 44209
  Description of Artificial Sequence: Synthetic polypeptide
  XenCS560 scFv Chain 2 - 1C11[PD-1]_H3.234_L3.144_scFv(GKPGS)4_ Fc(216)_IgG1_C220S/PVA_/S267K/S364K/E357Q/M428L/N434S

SEQ ID NO: 44814 - protein, 117 aa, Artificial Sequence; identical to SEQ ID NO: 40669
  Description of Artificial Sequence: Synthetic polypeptide
  VH of XENCS560

SEQ ID NO: 44815 - protein, 112 aa, Artificial Sequence; identical to SEQ ID NO: 40517
  Description of Artificial Sequence: Synthetic polypeptide
  VL of XENCS560

SEQ ID NO: 44816 - protein, 231 aa, Artificial Sequence; identical to SEQ ID NO: 21572
  Description of Artificial Sequence: Synthetic polypeptide
  Fc chain of XENCS560

SEQ ID NO: 44817 - protein, 5 aa, Artificial Sequence
  Description of Artificial Sequence: Synthetic peptide
  XENCS560 vhCDR1
HYGIN

SEQ ID NO: 44818 - protein, 17 aa, Artificial Sequence
  Description of Artificial Sequence: Synthetic peptide
  XENCS560 vhCDR2
WINTYTGEPYYAPGFQE

SEQ ID NO: 44819 - protein, 8 aa, Artificial Sequence
  Description of Artificial Sequence: Synthetic peptide
  XENCS560 vhCDR3
DYYGSSPY

SEQ ID NO: 44820 - protein, 16 aa, Artificial Sequence
  Description of Artificial Sequence: Synthetic peptide
  XENCS560 vlCDR1
KASQSIVHSNGNTYLE

SEQ ID NO: 44821 - protein, 7 aa, Artificial Sequence
  Description of Artificial Sequence: Synthetic peptide
  XENCS560 vlCDR2
KVSNRFS

SEQ ID NO: 44822 - protein, 9 aa, Artificial Sequence
  Description of Artificial Sequence: Synthetic peptide
  XENCS560 vlCDR3
FQGSHVPNT

SEQ ID NO: 44823 - protein, 107 aa, Artificial Sequence [sequence omitted]

SEQ ID NO: 44824 - protein, 329 aa, Artificial Sequence; identical to SEQ ID NO: 44812
  Description of Artificial Sequence: Synthetic polypeptide
  XenCS561 Fab Chain 1 - [alphaXXX]_HX_ IgG1_pI(-)_Isosteric_A_/PVA_ /S267K/L368D/K370S/M428L/N434S

SEQ ID NO: 44825 - protein, 480 aa, Artificial Sequence; identical to SEQ ID NO: 44349
  Description of Artificial Sequence: Synthetic polypeptide
  XenCS561 scFv Chain 2 - 1C11[PD-1]_H3.240_L3.148_scFv(GKPGS)4_ Fc(216)_IgG1_C220S/PVA_/S267K/S364K/E357Q/M428L/N434S

SEQ ID NO: 44826 - protein, 117 aa, Artificial Sequence; identical to SEQ ID NO: 40831
  Description of Artificial Sequence: Synthetic polypeptide
  VH of XENCS561

SEQ ID NO: 44827 - protein, 112 aa, Artificial Sequence; identical to SEQ ID NO: 33009
  Description of Artificial Sequence: Synthetic polypeptide
  VL of XENCS561

SEQ ID NO: 44828 - protein, 231 aa, Artificial Sequence; identical to SEQ ID NO: 21572
  Description of Artificial Sequence: Synthetic polypeptide
  Fc chain of XENCS561

SEQ ID NO: 44829 - protein, 5 aa, Artificial Sequence
  Description of Artificial Sequence: Synthetic peptide
  XENCS561 vhCDR1
HYGIN

SEQ ID NO: 44830 - protein, 17 aa, Artificial Sequence
  Description of Artificial Sequence: Synthetic peptide
  XENCS561 vhCDR2
WINTYTGEPYYAPGFQE

SEQ ID NO: 44831 - protein, 8 aa, Artificial Sequence
  Description of Artificial Sequence: Synthetic peptide
  XENCS561 vhCDR3
DYYGSSPY

SEQ ID NO: 44832 - protein, 16 aa, Artificial Sequence
  Description of Artificial Sequence: Synthetic peptide
  XENCS561 vlCDR1
KSSQSIVHSNGNTYLE

SEQ ID NO: 44833 - protein, 7 aa, Artificial Sequence
  Description of Artificial Sequence: Synthetic peptide
  XENCS561 vlCDR2
KVSNRFS

SEQ ID NO: 44834 - protein, 9 aa, Artificial Sequence
  Description of Artificial Sequence: Synthetic peptide
  XENCS561 vlCDR3
FQGSHVPNT

SEQ ID NO: 44835 - protein, 107 aa, Artificial Sequence [sequence omitted]

SEQ ID NO: 44836 - protein, 329 aa, Artificial Sequence; identical to SEQ ID NO: 44812
  Description of Artificial Sequence: Synthetic polypeptide
  XenCS562 Fab Chain 1 - [alphaXXX]_HX_ IgG1_pI(-)_Isosteric_A_/PVA_ /S267K/L368D/K370S/M428L/N434S

SEQ ID NO: 44837 - protein, 480 aa, Artificial Sequence; identical to SEQ ID NO: 44489
  Description of Artificial Sequence: Synthetic polypeptide
  XenCS562 scFv Chain 2 - 1C11[PD-1]_H3.241_L3.148_scFv(GKPGS)4_ Fc(216)_IgG1_C220S/PVA_/S267K/S364K/E357Q/M428L/N434S

SEQ ID NO: 44838 - protein, 117 aa, Artificial Sequence; identical to SEQ ID NO: 40840
  Description of Artificial Sequence: Synthetic polypeptide
  VH of XENCS562

SEQ ID NO: 44839 - protein, 112 aa, Artificial Sequence; identical to SEQ ID NO: 33009
  Description of Artificial Sequence: Synthetic polypeptide
  VL of XENCS562

SEQ ID NO: 44840 - protein, 231 aa, Artificial Sequence; identical to SEQ ID NO: 21572
  Description of Artificial Sequence: Synthetic polypeptide
  Fc chain of XENCS562

SEQ ID NO: 44841 - protein, 5 aa, Artificial Sequence
  Description of Artificial Sequence: Synthetic peptide
  XENCS562 vhCDR1
HYGIN

SEQ ID NO: 44842 - protein, 17 aa, Artificial Sequence
  Description of Artificial Sequence: Synthetic peptide
  XENCS562 vhCDR2
WINTYTGEPYYAPGFQE

SEQ ID NO: 44843 - protein, 8 aa, Artificial Sequence
  Description of Artificial Sequence: Synthetic peptide
  XENCS562 vhCDR3
DYYGSSPY

SEQ ID NO: 44844 - protein, 16 aa, Artificial Sequence
  Description of Artificial Sequence: Synthetic peptide
  XENCS562 vlCDR1
KSSQSIVHSNGNTYLE

SEQ ID NO: 44845 - protein, 7 aa, Artificial Sequence
  Description of Artificial Sequence: Synthetic peptide
  XENCS562 vlCDR2
KVSNRFS

SEQ ID NO: 44846 - protein, 9 aa, Artificial Sequence
  Description of Artificial Sequence: Synthetic peptide
  XENCS562 vlCDR3
FQGSHVPNT

SEQ ID NO: 44847 - protein, 107 aa, Artificial Sequence [sequence omitted]

SEQ ID NO: 44848 - protein, 329 aa, Artificial Sequence; identical to SEQ ID NO: 44812
  Description of Artificial Sequence: Synthetic polypeptide
  XenCS563 Fab Chain 1 - [alphaXXX]_HX_ IgG1_pI(-)_Isosteric_A_/PVA_ /S267K/L368D/K370S/M428L/N434S

SEQ ID NO: 44849 - protein, 480 aa, Artificial Sequence; identical to SEQ ID NO: 44629
  Description of Artificial Sequence: Synthetic polypeptide
  XenCS563 scFv Chain 2 - 1C11[PD-1]_H3.241_L3.92_scFv(GKPGS)4_ Fc(216)_IgG1_C220S/PVA_/S267K/S364K/E357Q/M428L/N434S

SEQ ID NO: 44850 - protein, 117 aa, Artificial Sequence; identical to SEQ ID NO: 40840
  Description of Artificial Sequence: Synthetic polypeptide
  VH of XENCS563

SEQ ID NO: 44851 - protein, 112 aa, Artificial Sequence; identical to SEQ ID NO: 39932
  Description of Artificial Sequence: Synthetic polypeptide
  VL of XENCS563

SEQ ID NO: 44852 - protein, 231 aa, Artificial Sequence; identical to SEQ ID NO: 21572
  Description of Artificial Sequence: Synthetic polypeptide
  Fc chain of XENCS563

SEQ ID NO: 44853 - protein, 5 aa, Artificial Sequence
  Description of Artificial Sequence: Synthetic peptide
  XENCS563 vhCDR1
HYGIN

SEQ ID NO: 44854 - protein, 17 aa, Artificial Sequence
  Description of Artificial Sequence: Synthetic peptide
  XENCS563 vhCDR2
WINTYTGEPYYAPGFQE

SEQ ID NO: 44855 - protein, 8 aa, Artificial Sequence
  Description of Artificial Sequence: Synthetic peptide
  XENCS563 vhCDR3
DYYGSSPY

SEQ ID NO: 44856 - protein, 16 aa, Artificial Sequence
  Description of Artificial Sequence: Synthetic peptide
  XENCS563 vlCDR1
KASQSIVHSNGNTYLE

SEQ ID NO: 44857 - protein, 7 aa, Artificial Sequence
  Description of Artificial Sequence: Synthetic peptide
  XENCS563 vlCDR2
KVSNRFT

SEQ ID NO: 44858 - protein, 9 aa, Artificial Sequence
  Description of Artificial Sequence: Synthetic peptide
  XENCS563 vlCDR3
FQGSHVPNT

SEQ ID NO: 44859 - protein, 107 aa, Artificial Sequence [sequence omitted]

SEQ ID NO: 44860 - protein, 449 aa, Artificial Sequence
  Description of Artificial Sequence: Synthetic polypeptide
  XENP015074 Numax_IgG1_PVA_/S267K Heavy Chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44861 - protein, 120 aa, Artificial Sequence [sequence omitted]

SEQ ID NO: 44862 - protein, 7 aa, Artificial Sequence
  Description of Artificial Sequence: Synthetic peptide
  XENP015074 vhCDR1
TAGMSVG

SEQ ID NO: 44863 - protein, 16 aa, Artificial Sequence
  Description of Artificial Sequence: Synthetic peptide
  XENP015074 vhCDR2
DIWWDDKKHYNPSLKD

SEQ ID NO: 44864 - protein, 10 aa, Artificial Sequence
  Description of Artificial Sequence: Synthetic peptide
  XENP015074 vhCDR3
DMIFNFYFDV

SEQ ID NO: 44865 - protein, 213 aa, Artificial Sequence
  Description of Artificial Sequence: Synthetic polypeptide
  XENP015074 Numax_IgG1_PVA_/S267K Light Chain
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 44866 - protein, 106 aa, Artificial Sequence [sequence omitted]

SEQ ID NO: 44867 - protein, 10 aa, Artificial Sequence
  Description of Artificial Sequence: Synthetic peptide
  XENP015074 vlCDR1
SASSRVGYMH

SEQ ID NO: 44868 - protein, 7 aa, Artificial Sequence
  Description of Artificial Sequence: Synthetic peptide
  XENP015074 vlCDR2
DTSKLAS

SEQ ID NO: 44869 - protein, 9 aa, Artificial Sequence
  Description of Artificial Sequence: Synthetic peptide
  XENP015074 vlCDR3
FQGSGYPFT

SEQ ID NO: 44870 - protein, 442 aa, Artificial Sequence; identical to SEQ ID NO: 11485
  Description of Artificial Sequence: Synthetic polypeptide
  XENP016432 Nivolumab_H0L0_IgG1_PVA_/S267K Heavy Chain

SEQ ID NO: 44871 - protein, 113 aa, Artificial Sequence [sequence omitted]

SEQ ID NO: 44872 - protein, 5 aa, Artificial Sequence
  Description of Artificial Sequence: Synthetic peptide
  XENP016432 vhCDR1
NSGMH

SEQ ID NO: 44873 - protein, 17 aa, Artificial Sequence
  Description of Artificial Sequence: Synthetic peptide
  XENP016432 vhCDR2
VIWYDGSKRYYADSVKG

SEQ ID NO: 44874 - protein, 4 aa, Artificial Sequence
  Description of Artificial Sequence: Synthetic peptide
  XENP016432 vhCDR3
NDDY

SEQ ID NO: 44875 - protein, 214 aa, Artificial Sequence; identical to SEQ ID NO: 11470
  Description of Artificial Sequence: Synthetic polypeptide
  XENP016432 Nivolumab_H0L0_IgG1_PVA_/S267K Light Chain

SEQ ID NO: 44876 - protein, 107 aa, Artificial Sequence [sequence omitted]

SEQ ID NO: 44877 - protein, 11 aa, Artificial Sequence
  Description of Artificial Sequence: Synthetic peptide
  XENP016432 vlCDR1
RASQSVSSYLA

SEQ ID NO: 44878 - protein, 7 aa, Artificial Sequence
  Description of Artificial Sequence: Synthetic peptide
  XENP016432 vlCDR2
DASNRAT

SEQ ID NO: 44879 - protein, 9 aa, Artificial Sequence
  Description of Artificial Sequence: Synthetic peptide
  XENP016432 vlCDR3
QQSSNWPRT

SEQ ID NO: 44880 - protein, 447 aa, Artificial Sequence
  Description of Artificial Sequence: Synthetic polypeptide
  XENP021461 Pembrolizumab_H0L0_IgG4_S228P Heavy Chain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 44881 - protein, 120 aa, Artificial Sequence [sequence omitted]

SEQ ID NO: 44882 - protein, 5 aa, Artificial Sequence
  Description of Artificial Sequence: Synthetic peptide
  XENP021461 vhCDR1
NYYMY

SEQ ID NO: 44883 - protein, 17 aa, Artificial Sequence
  Description of Artificial Sequence: Synthetic peptide
  XENP021461 vhCDR2
GINPSNGGTNFNEKFKN

SEQ ID NO: 44884 - protein, 11 aa, Artificial Sequence
  Description of Artificial Sequence: Synthetic peptide
  XENP021461 vhCDR3
RDYRFDMGFDY

SEQ ID NO: 44885 - protein, 218 aa, Artificial Sequence; identical to SEQ ID NO: 11510
  Description of Artificial Sequence: Synthetic polypeptide
  XENP021461 Pembrolizumab_H0L0_IgG4_S228P Light Chain

SEQ ID NO: 44886 - protein, 111 aa, Artificial Sequence [sequence omitted]

SEQ ID NO: 44887 - protein, 15 aa, Artificial Sequence
  Description of Artificial Sequence: Synthetic peptide
  XENP021461 vlCDR1
RASKGVSTSGYSYLH

SEQ ID NO: 44888 - protein, 7 aa, Artificial Sequence
  Description of Artificial Sequence: Synthetic peptide
  XENP021461 vlCDR2
LASYLES

SEQ ID NO: 44889 - protein, 9 aa, Artificial Sequence
  Description of Artificial Sequence: Synthetic peptide
  XENP021461 vlCDR3
QHSRDLPLT

SEQ ID NO: 44890 - protein, 447 aa, Artificial Sequence
  Description of Artificial Sequence: Synthetic polypeptide
  XENP16434 YW243.55.S70_H0 Heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44891 - protein, 118 aa, Artificial Sequence [sequence omitted]

SEQ ID NO: 44892 - protein, 5 aa, Artificial Sequence
  Description of Artificial Sequence: Synthetic peptide
  XENP16434 vhCDR1
DSWIH

SEQ ID NO: 44893 - protein, 17 aa, Artificial Sequence
  Description of Artificial Sequence: Synthetic peptide
  XENP16434 vhCDR2
WISPYGGSTYYADSVKG

SEQ ID NO: 44894 - protein, 9 aa, Artificial Sequence
  Description of Artificial Sequence: Synthetic peptide
  XENP16434 vhCDR3
RHWPGGFDY

SEQ ID NO: 44895 - protein, 214 aa, Artificial Sequence
  Description of Artificial Sequence: Synthetic polypeptide
  XENP16434 YW243.55.S70_L0 Light Chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 44896 - protein, 107 aa, Artificial Sequence [sequence omitted]

SEQ ID NO: 44897 - protein, 11 aa, Artificial Sequence
  Description of Artificial Sequence: Synthetic peptide
  XENP16434 vlCDR1
RASQDVSTAVA

SEQ ID NO: 44898 - protein, 7 aa, Artificial Sequence
  Description of Artificial Sequence: Synthetic peptide
  XENP16434 vlCDR2
SASFLYS

SEQ ID NO: 44899 - protein, 9 aa, Artificial Sequence
  Description of Artificial Sequence: Synthetic peptide
  XENP16434 vlCDR3
QQYLYHPAT

SEQ ID NO: 44900 - protein, 447 aa, Artificial Sequence; identical to SEQ ID NO: 44890
  Description of Artificial Sequence: Synthetic polypeptide
  XENP29154_TGN1412_hu5.11A1[CD28]_H1_IgG4_K447del Heavy Chain

SEQ ID NO: 44901 - protein, 118 aa, Artificial Sequence [sequence omitted]

SEQ ID NO: 44902 - protein, 5 aa, Artificial Sequence
  Description of Artificial Sequence: Synthetic peptide
  XENP29154 vhCDR1
DSWIH

SEQ ID NO: 44903 - protein, 17 aa, Artificial Sequence
  Description of Artificial Sequence: Synthetic peptide
  XENP29154 vhCDR2
WISPYGGSTYYADSVKG

SEQ ID NO: 44904 - protein, 9 aa, Artificial Sequence
  Description of Artificial Sequence: Synthetic peptide
  XENP29154 vhCDR3
RHWPGGFDY

SEQ ID NO: 44905 - protein, 214 aa, Artificial Sequence; identical to SEQ ID NO: 44895
  Description of Artificial Sequence: Synthetic polypeptide
  XENP29154 TGN1412_hu5.11A1[CD28]_ L1 Light Chain

SEQ ID NO: 44906 - protein, 107 aa, Artificial Sequence [sequence omitted]

SEQ ID NO: 44907 - protein, 11 aa, Artificial Sequence
  Description of Artificial Sequence: Synthetic peptide
  XENP29154 vlCDR1
RASQDVSTAVA

SEQ ID NO: 44908 - protein, 6 aa, Artificial Sequence
  Description of Artificial Sequence: Synthetic peptide
  XENP29154 vlCDR2
SASFLY

SEQ ID NO: 44909 - protein, 9 aa, Artificial Sequence
  Description of Artificial Sequence: Synthetic peptide
  XENP29154 vlCDR3
QQYLYHPAT

SEQ ID NO: 44910 - protein, 4 aa, Artificial Sequence
  Description of Artificial Sequence: Synthetic peptide
EPKS

SEQ ID NO: 44911 - protein, 5 aa, Artificial Sequence
  Description of Artificial Sequence: Synthetic peptide
  MOD_RES (4)..(4): Met or Ile
HYGXN

SEQ ID NO: 44912 - protein, 17 aa, Artificial Sequence
  Description of Artificial Sequence: Synthetic peptide
  MOD_RES (5)..(5): Tyr or His
  MOD_RES (10)..(10): Thr or Tyr
  MOD_RES (13)..(13): Asp or Pro
  MOD_RES (16)..(16): Thr or Gln
  MOD_RES (17)..(17): Gly or Glu
WINTXTGEPXYAXGFXX

SEQ ID NO: 44913 - protein, 8 aa, Artificial Sequence
  Description of Artificial Sequence: Synthetic peptide
  MOD_RES (3)..(3): Phe or Tyr
DYXGSSPY

SEQ ID NO: 44914 - protein, 16 aa, Artificial Sequence
  Description of Artificial Sequence: Synthetic peptide
  MOD_RES (2)..(2): Ser or Ala
  MOD_RES (8)..(8): Phe or His
RXSQSIVXSNGNTYLE

SEQ ID NO: 44915 - protein, 7 aa, Artificial Sequence
  Description of Artificial Sequence: Synthetic peptide
  MOD_RES (7)..(7): Ser or Thr
KVSNRFX

SEQ ID NO: 44916 - protein, 8 aa, Artificial Sequence
  Description of Artificial Sequence: Synthetic peptide
FQGSHVPN
